United States Patent 9,487,797 (GENOMIC PLANT SEQUENCES AND USES THEREOF) - sequence listing, part 83

SEQ ID NO: 79124 - DNA, 4605 bp, Oryza sativa
atagcgaatttgctagggacaatgggtccaataactttgaataccctagaacagactgacttcggtatctctttaaccaccttgtgtttgatgactgcttctatcatcattatgaagtacacctctttgaatcaatatgcggaaaaatagctgataagttccatgggctgccgttggcagccaagacagttgcaccactattaagggccaatagaaatatggaatattgggaaaatgtcctgggaagtgattggtggaatatttctgatcatggtttgggaataaacgttctgccagccctaggaattggctgcctatatccagcgctaaggcagtgtcttctgttctgctcaatatttccaaggaattatgtctttgaaaaggaaagagtggtccagatgtgggtggcacatgggttcattcagtctagtgatagaagggatatcgttccagagaatgttgctaaaaattggtttgatgaactagttgataggtccttcttgcaaccaacagtctggcaaggccgttacgtcatgcatgatttgataagagagttctcagttgctgtttcttccaatgaatattatgtctttcacaggaattccaaggttcttccacaatttgctaatcatatttctgttgataatgataatttcgatcttcaatggggtcattatgatcataaaagattacaaactctgatgttttttggtcatcacagggttgacaaaaattatggcactcttggtagcatagtgagaaagtcaactagtctacgtgtactggatttgtcttacatttgcatgagtaatgtcagtcaggcttcagatgttctctgcaagttgtcacatcttcgatatcttgatctctcttttactggtatcaaagatctcccggaggcatttggtaatctataccatctccaggtacttgatctgcggggttgtataattgagaagctgccaaagaacatgaacaatttgatcaatctaaggcatttatatgctgattcacaaaccaccgcactgatctatgctgtaggccagctgacaaaacttcaggagttacaggaattcagagttaggttggaggatggttacaagataaatgagttaagggacatgaaagacctgaggaaattgtacattacaaatcttgagaaagtctcaagttggcaagaggctacagatgcaaagctggtggagaaaaagtcccttgactatctgcaattgaaatgggtgtaccaggtacctgaaagtaggtctacctctcagttgaacaaggatattctcgatggcctacaccctcacttccagttgaaaaggttgaaaattctgaactatatgggaattgattttccttactgggtgcagcgtctcacagacctcgttgctgttaacataattaactgccgatggttgagtgttctgccaccattgggagagctcccacgtctcaagaaactatctctttttggtctatcctctataactcatattaatgatcaagtatacggaaccaatgatgtgatctttccatatttagaggagctgcacttctagaattgtttagctgggagcaatggtccgaggcagaatataaactgcttattcctcacctacggaaacttggtataaatgcctgcagcaaattaagtctattgccgattgaaactttgagttcatcagtcaaagagcttcatctttcttcatgcacatcatatatcagtatgctgcccgcttatttgaaaagactgacgtccctcaccaaattgagcatacaggactgctctgccacattactaatcccgtgccattccttgacattactggagcacttgcagctggaaagctgtttcgatgtacattttgaagggggcatgcagtactttaccaaactgaagaagctagaagtacatcgctgctttgatgtcactcagaacatatatgaacaaacatcactagtggagagatattctctgatggggggtcttcagtccctcatccatcttgttatcgacgacagattcatgtattacagatactaccatatgctgaacactctttgttcaattcgaactatgaagttttgtgcctttgatctttccgagttcaccacggaagacgaggaatggctccagcaactacagtccctacaggagatccagtttgcttcatgtcgcaatctcttacgccttccttctaacctgaataatatgtgtaacctgaagaaggtcgttctgaacgattgctgcaagctccagtcactgccgctgaatggcttgccagataacctaaaagaattccatgtctcaggaggttctgaagtactggagcaacaatgtcagaaaacagatggggatgaatggcagaaaatttctcatgtgccatacgttcggataaatggcagaactatccagatgatttcacatgatcttggaagttagcaacacatgtataacaaggttactctaggttaagttatgtgtaggcattttgtgggatatcattgttggtacttcatcggtaggaattaggagtttctgaaaacttcaaaggtatggtttcaaaaaaccaaattcacattaactgctccggcttctgtcacatatctggatatacaagccactagattgtcagcgatctgctcaaagagggaaatgaaccaatcaaaaactgggaagtagccattttttaaaaaaaatggagagtgctctgattattttctgatgttttcacgtttcaacagaagccaatttttcatcgttttccagtgcagactaaggtgatctttctccatggctattacatttttattatgttctatgatatataaatccaatttttggtaaacagctgaattttgtctcgtgatgacagattggtattcggagcgatgcagaattgcagataccatcagacgcactatgactgtatactaatatactgtactactgaattcgcacatcacactgagcgttgtgtgttgtctggtagattgctagtctctggtatgagatgcacactacatatatagttacgagttatgacttcatattcattctcctatcgaatagtaaaagagcttttaaatgattatactctatactgttgcagcttgcacctgcgcagttctgcgttgcacctcttcagaaatgataaccaccgaggtttcaaaataaatgttcaaacgaatgatatgtttcattcgctgtacttgtgcttgcaaagggcaacgcaaaatttgtctaagagcaagtttaatagtcatacaatagttggctataaaaatatactataccattaatgctcgatctcacatcgcatacactcataatgtcttggagtccgtgttgcagccgactataaatctgtagcccgctttcttctctctcttctctttttttctcgatatgtggttatagctggcttatagcttgctattgtacctgctctaatgagttggtttggtttgtggtctaaataggccttaccaaattttgtcaatgccaatttttggtaagttttgacatgactaattttggtaaggcaaagttgtatttggattgaagccaaaatagcctaagttcactattgaaatggcatattttcttaggcatgccaaaatttggcttcaaaccaaataaacactaaacactattgaaattgtcaaatattggtaagcctaatttagacctcaaaccaaaccagcccaataccacaatcgagcatatgtggatctatttgaacgaaactcttatgtcttgccacactcacatgtccacacgaagtaaataaactgtacccatgtcattcttaccaggacaaaggcgaatcatggaattgtacaaggcagcaggcataaacagcagagaaaacagtacttgtataaaagtagaacaccctgattcatagggaaaagagagcattcaaaattgaaatctttttacacggagcgttggatggtttggcttattactcatatatgtccacaagcatgaaacaaagttattctttgcaaggaaacccagctaatgaaagctacatttcgctctcagacatcaaacatgaggctgaatttggtggcaagaggaatggatataatgacagctcccagggcagcaccaaaaatacggtgtgagattgagaacgtagcactcagctgcggcttcttcaaagggagatggggtgacagtgggcggtttgcaacaggagccgacaggggacgacttgtgtgcaggagtcggtttccagatgggaacatctttggtctcagagctcctaggggtgaagatgtgtagctcctagcttgtccagaacttgaggattgtctcagatgatctatgttgttgaaggatgagtttgagctaccaagggcacctgaaaacgatgaaaaaaggtgagggcatttatttagttgtttgaagcagttgcaaaacatgtacatcaaattatacaatatacactagcgtccagttcaataaaaaattagagactaacctaaaaacagtgaaaaccatgtctcgtgtaaaccaatgacgacttccattttcttaaaaaaaaacaataacttactctagtgtggttgcaagaaatttgtgtccta

SEQ ID NO: 79125 - DNA, 21060 bp, Oryza sativa
caaatcatggtgcaattaggcttaaaagattcgtctcgcaatttacacgcaatctgtgtaattatttttttctacatttaatactccatacatgtattcaaacattcgatgtaatagcgtgaaaaattttgtttggaaactaaacatgcccttaaaatacatactctctccgtcccataatataagggattttgagtttttttttattgtttgaccactcgtcttattaaaaaaattgtgcaaatataaaaaacgaaaagttgtgcttaaagtactttggataataaagtaagtcacacaaaaaataaataataattctaaatttttttgaataagatgagtggtcaaacagtgcaagcaaaaactcaaaatcccttatatcatgggacggagggagtattttaccttgatttttcttagcacgttttttatactgtttcgtgtcagaacttctatataaaagttgctttaaaatataaaataaatacatattcacgtttataataattaaaacttaattaattacatgctaatggttttctcgttctacaatatttaattgactttaattgaacgaagaagtcattcaattgacttaattgtttagtgggtaagaggtatatatacaacataattaattgttagtggataaaggccaaggggcatagaactatagatacaacataactaattcctgctttaattgacttaattaatttaatttaattgctaatgactttaattgaacggatctagtagttgaagcccgatgctttaatgtgggatgcatagagttaagtataaaaataacacatgcatataagttaaaaatactgtgaaaatgaagtggggatggtgatgatttgaaatattttctaatgaataatgacgtgacatatctatatgctgtaatactttctaaaaaaaatatttagcgttagttaactcaaaattaaactaatcaacacctaatatttcggaaaaggagatagcaaattaattgttagtgggcaaggggtatacaactatacatacaacacttacactaccataacatcgcgcattagcaggacaaagctgtatcgcatccatatatatgatccaaataaagcagggaaatccaaccgagccgtgctcgaagttaattaaaccgtcgcatcgagcaggtgatggaccgccgcggcagaggccgggacggggcccgggcacgtatactacatgggtacgtataggccattatcgtcccaaccaccgctacagggcaagcagagaccgacgcacgcatcatgcgtcgtcctacttactctacgtacttcctatagtaaagaaagtcatttagcacagcgatacggtctctaaaatacaattttgactttttgtttctataaaaatatttattgaaaagtgatatatgtatatctttatgaaattatttttcaagacaaatctattgacataagttttacatttttcaaattcaacaacttgagagttatttatgatttatattcttaaggtttgacttaaacattgtcctaaacgacttcttttacgagtacgaagatagtacacccttcctttaaatactttgtcctacttactctctaataattattttcacctattttttaatatcaatatttctttatatcaaaatataaatcacaaccattttttcaatatttaatacaagatactcatgcatgactgcaaataaatagcaccttcgtcttctccttagcttaccttttaaatacttccaccctcgaagtctcccgtcgtactgggtgcatacatatgaatacctagtcacgatttggaatttcgagcctaaaaataattgagattgagggagtgtttgattgggactaaaattttttagtctctgtcccatcggatgtttgacactaattagaagtattaaacgtaaactaatgataaaacccattccataaccctggattaattcgtgagacgagtctatttagcctagttaatccataattagcctatgtgatgctacagtaaacatgtgctaattatggactaattaggcttaaaaaattgtctcgtgaattagctcttatttatgtaattagttttgtaagtagtctatgtttaatactccaaattagtgttcaaacatccgatgtgatagggactaaagtttagtccctggatccaaacacaccttgagggcccctttgatttaaaggaaaaatataggaattttagaggatttcaatcctataggaaaatttcctatgaagccctttgaaacaaaggagtgaatcatatccaatcctttgaaattcctatggaatggacaatcctatagagattttggaggaaatttagcaagagcttcaacctcttgctaactttcctttgagtctatctctctcatctaattcctgtttttttttctgtggttcaatcaaacggtcattcctatgtttttcctgcgttttgcaatcctctgttttatacttacattcctatcaaaatcctacgttttttctattcctacgttttctcaatcttgcgattcaaaggggccctgaatggttttacgagagaagagataagagataatttgatccatatgtgtatcattcaaaggctagaaataattagggtgatgtggctcaatgagagaagagataaataacattaactacacttagtactaatgaactatataagtatataggattggattggtccaaacgagaagatgataataattctttattgatacctgtgttagtaatagttatggcttgtatattgggatggagagagtacctctttccatatgaaaggggtaaaaatttgtatttggatatgctacatgacactttcattattgaacatcggatggattgatttattgtatccaatgcaaataaaatacaaatttatccatgagacatgtttcttttttaacttgatcaggtctagttccaactagatttagaccaggggagtaagaatggttcaaatcagacctaatctccttacaagccgatggagcacacaagcaaaatggtactttccacgttatttctctcttcgtttataccaaatatcataagataacgtgtaaagtgtccagcagctaattacaatattttctgtatcattcatcgaatacgcgtttttaaatatcatgtagtaaatatcataaactttgagtatcttatagtaaattttgtaaaaaaaaaaacttatatagttgttggctagcggttgctcgtgtcgtctccttcctatcgtcgttgatgatgggctttgggcgccgcgttcctttcgcccgcccgtcgtccggccggtgcggtccggtccccgcgcgtggcgtcgtcgcgcgcgtaaatgctcgcagctcgcaagagctaaggcgaacacgcgtgctttgctcgagctcgtcgatactcgataggcgaggcgaccactgtgcgtgtgcgtgcccacctgcgttgcgccatagtacttgtattttccgcatgcgtccgtccacggtccatccacgtatggcctggccggcgcggctagctaccagctgcagctctcatgctcacacacgcatttccgattgggcctagcctctccattcatcaggtcaggatatgagcatttaagcacagctgttctaattagcctacggtcattgtaaatcatcttattatgtagtcccctatttcacaatgtaagtcattctagcattttccacatttatattaatgttaatgaatctaaacatatatatctatctagattcaataacatcaatatgtatgtgagaaatattagaatgacattctgaaacagaagaagtaacacgatggtaaaagtacgagacaaagggatatggtctatacatcaacaagccgatcgcctggtttctttcagtctacctacacctcaatctacatttttacggctaagattattttgagattcgtccaacaatcgtgtcctgataccctcttctctcttcccccgatctccaatcacactatcgccactcgcccatgagtcggcaacgcacggatgcgatttgtctatcctcctcaccaccttctacacgctagtgccatcaccacgagccccatcaactgttacctccctactcctctccatgcctccatagtcacatatcttcatcaactccaacgactttctcccaccctggttctcatctcttgtgtctgacggctcgcgtcactaaatccattggcatccctttcccttgccaccaacccctttatcttgtactccctccgtttcacaacgtaaattatttaagcatttcccacattcgtattgatgttaatgaatctagacatatatatctatctagatttattaacaacaatatgaatatagaaaatgttagaatgacttacattgtgtaacagaggaagtaactccgatggtgccatcacgttgcctcattgcccgccctgcatcttcatgtccactatccgccgccgtgctctagttctttgccacccaaaccattaccctaaagcggccattgttgcccccttgctcactcccatcaccaccaaccctaacaccaagatttcgcaagctagagtttagaaatcattgatattgagggcttgccaagaagaaagttagcgtgcaattaattgctaagccctcaccatcctcctccctctctcacgtctagctagaggctaaagacgttgcccaataataaaatctcagtcgactgatagtaaagacggtactacaagtaattaatgattggtcttaaatacctacggactatattattcattgtacctccttctttgcctctaagggtgtgtttagttcacgctaaaattggaagtttaattgaaattggaatgatgtgacggaaaagttggaaatttatgtgtgtagaaaagttttgatgtgatggaaaagttgaaagtttgaagaaaaaatttagaactaaactcggcctaaatcttgtgaattatatctattcagctagggcggagacatgggtaggacaactaggggcacataaccgtactccaaagtctggatgaccatgtcaatacattttaaaaatattacactactggaaaaaaaaacatttttactggaggccaaaacatatttttcaagcgtccataaccttcgcctgcaaccaaacacctgcaaaaattgattttcgcaggtggccaaatccaccctcatgcaaaaatatttttaacgtaaaaaaaaaaattggctgccatccagccctacccgccgccgcctcccctccggcgaccgccaccacgagctgtgccaccacaagggttttgggagagagggaggggaggggagctgcgccgccacgagctcaccgcgccagcccgccgccaccgccgaggggatgagaggggaggggaggaaaggggagggaagtcaccgtccggatctgggagtgggagcgctgccgccgaccttcggcctccgcctcctcgccgcctcagccaccgccctccccatgatgccgccagatccgcgaggggaggggagcgccgccgacgaccgccggcctccgctgctgcatgcagccgccgtcgccgtcctcccccacgatgcttctggatccgggatgggagggccgccagccggatctggaaggtgggagcgccgccgctgacctccgtcctcctccgccaccgacctccctcctccgtcgtccgccccgcgccgccggccaccaccggcctcccccctcccccctttggcaggatctgggagggaggggaggcgagccacaccgggggtgcaccgtccccgcctcgccatcgcggatcccaccgcccacatgcgttgccgtcgccggttcccgccgcccccgccgctaaacgcccgtgaggagaggagaggaaaggaggagaggtgaggccggctaagggagaggagagtgaggacttagaaaaaatctaagtgatgagtggtccatttatactccacacctattttcgcaggcagaccacataagaggtccgcctgcaaaaataaatggtatttttgcaggcggaccgcttaagggtccgcttgcaaaaatagattttcgtaggcagacaacgagcttcaccccagtttatatttttgaggcggtcattttactccgagggtcatgttcgcctgtgaaaataaaaccctcacgtctgtgaaaatgctttttctagttgtgttaaaaagaagagcacagcacgaaaatatgtaaaccacactaaactcatccctaggctcgaaaataaaatcggttgtgcccctgcgtcggagaggttcgtttggtcccaaatcaagtggccatggacagacgaccaattgttacttaactcgctagctactagtccgtcaatgggtctcgtgatgatgattgaccatagatgcacatccatgtagccatgtgtgacattctggttcaattagcatatgacatttgttgcttatagatgttatgtgtgtatgtttaataacacaatgctaattcagtaaggatggaatcaacttatataagtggttgtctctctagcactatatctctggggttaaccctttaatctaaagtgaaaatataagtgtaaatggggtattatatgtgtaagtgggggtgcctgtcaaatagagtggagtgcgcaattttggaggcttgggtgttacaccacgcgagtgacttaatttcgctcgcctttgctcttgtttctgtatgcacatttggaccggaatcgccggatgcatacttgcaatgcacacacggacacacctacgcgtacagacacaacaaactctcgcacatcatgtatatacgcgttctcgattatctgtttcttatacactgtagagcaaacaaacttcccccaagctgtatatgggacaattcatgcgaaactagtgtatatagacgcgcattcgcgcaacattaaccccctctatattgagctcctttacatgtttttaggattcatttgttctttttcttcaaataatcaaattgtaattaaatcattagagtatatttataaattaaatagtttttattaaatgacttgagtgttcatttacaatattacttattgttcgtgaagtgagcatagcttaatcgttaggttctagaacctacactcatattcaagttctagtactaagatttagtactgatactcgtatttatggccaattattctttcagcgatagtggatgtacccatttgcattgtgtttcttaaataaaatcttatttattgattaatactattattaataaatacatggactccaacataacatgtgcagtggctaataaattgtacataattaaaaaaatattgggaacatattgaatttatcatcttatatataatttttttgaatgttttagagaataaaatcattaggaggtctacttagaatgtaaaaatatttattttattctgatatgtaatgaatgaactatattagcacgacaacaaacttttattgcaattttatccaaaccttatattaatatgtaaaacgaagtttacataattttattaatatttgttatcatctttgtcgtagcataagtcgttgccttctcgccatctatgctacagcattacccttatccttcacttatttttcattagtgcacaagtattatagcatgtatacatttattttttgcgggtttattatgtatatttatatttgaatcgtacaaacctaatgattcattatgaacgatctggcatttagctgcctgtttgtaatagtaataattttttcgttgatataaccaagtctctgccgtgtatttttccctccttttatttgctctttattatgtcccatgtgtgaggaagccagggaggttctggtgttgtattggtatgctggaaagctcgagagaacgccctatcactatcaggttcctttactgatatgatcctacggctctctttaattttttcatcatcggatggcctgggatttttggcttacgtggacgtatcaggtgatccttttggatttagtaacattttaaccttcacttatagagatttccaccttagatctaactactttctacattcggttttctttttaactctttttttaggtggacaaccatagccaacagctatcttgtcaagcagccattaatcctctcctacttgtgcagttgtgcgtgctgtgcctgcctgaaacatgtcgattacggcccaattaagatattgttagctatctgggctttcgagctggaataacgaactacgtgggcttcagtttgccctcttgctcgacagcacgtataaagcccaaattaaaaaaaaaaagagagtacctatacatctttcgaaagatttttatgatcgtatcacacagatttttaatctttggattaaaatctgatagatataataaaaagcaaaaagcaattaagaaacatcataatggacactaaattaccatatcctcaagaaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtgagaaaatcgagtgagagataaaaaaaatctttcgattgagatatagcaaaatcgaaaaaaaaatactacggcccataatgtgtcgtttgatattcttgattaaatctactcttttgatatgctcaattagtactactacagtattactataaaacctgcatgctaataactttctagcatccctgcaaaatattaattctagcagacaacactcaatgcatgtctgacagtgtagcacgcagggagattacaagattagtccctgcatgatgccaaaggtgatcatcatacgtcttcattggcaacaacaaatagggacgtgctaaccacctatttctatggcgtttctttgtttttttgtttcagttgcagcgcaagctgtttttgatgtgtcctctgaacctacctcaccaaccatggtgatcatcttctccaaagctgcagcagcagagcagagaacattcatgccatgttgaactgtaaatttactcttgggaattagttgcagactgcaaacaaatttgcatcacaaaagagtcgggtcgggtgttgattcgccattgctattagtcattctactcgtgcctactgcttactttctcgatcgatggaatcggtgattcatttggttgggcgttgttagtacaaaattgaattaacgaatatcaaatcaaataatgaaaatggagggagtaactagtggtagtaatttattcgaatgtatggaagatgcacacataattgcgagtggcccttttactcgtatcttagtgggttaattactcacaaaacaacaagtctattacattatccatccctgatttcttcgtaaaaatagaaaaaaaaatctgtccttggttggattgttgctgctacatgcatgcatggtcctttgacaacttgtcatatgacagatgcagagtcttactccaagcagatgaaaatggaatgaactcctcaacataaaattgacaactttcaaatcagcccagagagatcagatatcgtcaaacggatagaatcatagaagtgcattttacctaaaaaagttgatgttttccacctttttttcttttcaatattagtatgattgtactggtactggctgtttgcttggagtttggacttgcatttgtacaattaaattccaccggcaacttacaaaggacagaagaaacctcgaccgacacccagagaaatgaacaaattcatgggcccaacataattattctaaagttcgtggatacttagcttctcatcgtctgattattaatttatcagtatcaaccaaaaaaaataaatttagaggttattttgaggtttcatcgtaatttatttttcagcactataacttttaaaacactaagctttgttataaattattttttattttgcttcgctcctagagcaaccagcttattggcagataagtcacgaatttggaaattattcaaaaattttagacgataaaaaaccgcaaacatggtgtttctgggagtaaacagcatggtgttttgctccgtacttctccacttgtcagtgagtacttccttcagttccaaattcttgatgtcttgaaaaaaaaatcaacaagtacactacactgtctcactgacaggtgtgcccaggaggacactctaattaaacagcaccaaatcatttgaacggccatttatttttccagctcgctatagtacactcctataaacccaggtaacccagctactaatccctgacaaggtggccccactctctaccacctcagtgggccctcactcctctaccctcctcctcatcgtctcgactccaacgaatcttgagccctttcgccctctctctctctctcgcctccgccctcctcgcctttctcccccacctccacctcctccgctcccgaggcgagatctcgccgccgccgccattccccaatccgccccaaaacccccaccccccaaaccctccgatcgatccgagggaggagccaatcccgcgctcgaattcgttcgccccgaatcagccgctggatgcgtcgagctcgaggcggcggaattcaaatctgagctcgccgttggcgcggatccgacggggatggcgacggcggtgtcgaagtcggcggctaagccgcaccccaggtcgcccaccaccgcgcagccgccgaacaacggctccgcggcgggggcggcggcggggggcgggggcggtggagtgggtatggggcccgcgggggcgacgccgtcgaagaacgcggcgatggcggagctcaagtcgagggtgctcggggcgctcgcgaagctctccgacagggacacgcaccacatcgccgtcgaggacctcgaccgcatcatccgctcgctgccgtcgcccgacgccgtgcccatgctggtgcacgcgctggcgtcggactcgccgggcctcgcgtcccccgcgcggcgggagtcgctgcgcctcctcgccacgctctgcgcggcgcaccccgacgccgccgcgccctacctgcagaaggtgatggcgcacctcgcgcggaggctcaaggacaccaactcggactcctccgtgcgcgacgcgtgccgcgatgccgccggccagctctcggaggtgtacctccgacccctggcggcctcggctgccgctgaagcgggcaatgcgactgtcacactgttcgtgaagccactgtttgaggcgatgggggagcagagcaaggcagtgcagggtggggcggcggcctgcctggcaaagacggtggagggcgcggggcctggacctggcgtggtagggatgtttgggaagattggtccgagggtttgcaaattgcttggtggacagggagtacaggctaaaggggcacttctcaccatcatcgggagcttgtctcaggttgggattgcgcgatatttttctttatgcatgcaatatgttcgatgaattgacttgacagatgccaggtggtagaaatttgtggtagacattactaaattgattatttttcatggacatttagttttctgtctgaatatgggaaatgttatcataaattgtggccaaggggtaggaattgtttttgtgataagtgatgtttggtgctgccgctgcggtcgaatgtagttcatcatgtaatcagttttggatgttgcctatatgtcttgctgacaactatatggttggaaattgttcgtgttgtgaagaatggtgagttatcattgagacaagggtttgatattttcaatcattattacaatgtgccattttgttttgcacctctgaatttatggatggttaggacttaggagtttagtatttgatatcctaccattgggtacataagactgttgttacttttgtgtggtgtttggccccatgaacaatggatagtaccacagcattgtgatttaatgtttagataagcgaataattaaccttttgctttgcctctggtagccttttattctttttagtacttcagttgaaacattgaactgaaacatacattgatgctctaagcgaatgtgtctcctaacacatgctttgaatggtactattgggaatactgtgccaagcattactgtgcgatacatatcttataaatctctgcaatgacataacatcagattcactagctctccttgtttgaataattgttgatatatttcttgtcaggttggagcaatcagtcctcagaatatgcctcaaacattgcaaagcattcgtgactgtctcgagaacagtgattgggctactagaaaagctgcagctgatacattgtgtgtcctggccacatattcaggccgattgataggtgatggaacagctccaacaatagctgctcttgaagcttgtcgcttcgataaggtaactaaaactttaactcactcaacccaaactgaaggatctgttgctcttccatggatccttttcagatgatgacaagtcattgttacatgcattatgttgcattaagttgttcttgtcaatccttttcaggtaaaacctgtcagagatagcatggctgatgcagtgcagctatggaaaaaaatggcaggagatgattcgaacggtatcaatttgttttttagtttaaaagtgcatgatgttatttaggattttattactctatgcttattgcaacataatttcattcaacagatggtaaaaataaggaatcagctgataatgaagggaaaatggattcacctaataacaatgacaaagtgaagggcagtagcatggctgaaaaagcagcagttctcttaaagaaaagacctacattaaccgatagggaattgaaccctgaattttttcaaaagctcgagacaagaatcacagatgaattagctgttgaggtggttgtaccccgcaaaactttacaatctcatttacaaagtgaagaggaaccagaagatgcagatggcgatcctgttggtccagctaacagcaatggatcagcagatgatgaagcaaatttgactcaactgcgttctagctctaattttcaaaatattcgagatagatgggctggccagagaggaagtagaaacaaagatgcaaaggttagggcatctgatgttgaagataggaatgaatctagtgcaaaagattctgcttcagcagcaatgaatgttcctggagaagggccttccttaaataataaaacaaactggttggcgatacagaggcagttgtcccacttggatagacagcagactagtctaatgaacatgctgcaggttagtgccatgtttatttattcccgtgaagaaattgttggaatttcttttttttgtttttctgttaagaaataattcttgaggagaaatgtccaggatatcacactttttttatgtcctaattggtaacatcagttttttttcttcttctgaatatgtaactatctgctaatgagatttgtcactgcttgctatgctttctgagattatattgtcatgtgttatgtttgtcttagtgatgtgctgctaggcatcttttggtgtcagcaatttcatgttgtcttctaaaagaaagtagtgctacgatattacacagtagcccaaataaagtgagcttacattatttagaacaaaacattatgttggctttagaagggatgttagtaggtagtagctttgatgtctatgtaatgttgtacattgctaaagtctacaaaaaagtactttattgatggtttatcaccgtttcttagtttgggtttgaaacagaaaatttcctgctttgttttgttgtacatgaaccttttttccagtaattcacaaatgtgatccgttgtgatgtactgatgtatgccatctctgaggacatggtttttagttaattgggtgtctgtgggctaactacctaatatcacttctttttttaatacaattttcaggatttcatgggaggatctcatgacagtatggttactttagagaaccgagtgcgtggtcttgagagagttgttgaggaaatggccagggatatatcactatcatcaggcaggagaggtggtggccccatgctgggctttgattcatctcctggtagatcatctatgaaatacaatggttttcatgaatattctaattcaaaatttgggagggatcgtgatggacgggtgggatttgcagaaaggtacttttctggagatggtatgtcttctggtgtaagaagctctgaaccatgggactcgtatgcttattctggatcaagaagtggtatgaatgccaggagagggttggactctgtttcatctgataacagggtgcctagaaatgaacgaagcaatgatcaagcaggacctaggcgaggatgggacaaaggacagggtccatttaggtttggggagggtccttctgctcgaagtgcatggcgagcctccaaagatgaagcgacactggaagctattagggttgctggtgaagataatggaacttctagggcagctgcgagagttgctatccgtgaattggatggggaaactttgaatgatgataatcaaggggatgaaagaggaccaatttgggagtcttggactcgtgcaatggatgcgatacatgttggtgatatggattcggcttatgctgaggttctttcaactggggatgctgaattacttgtaaaattaatggagcaaactggaccagtagttgatcaactttcaaatgaagttgcaaacgaagtcctacatgctgttggacaatttcttgtggaagaaagcttctatgatatagctttgagctggcttcagcaggtaaagtagtatgttccattgtaggaatataaaagttctgaagagacaggtgtttactctgacaacaatatcatggaaaatgttaacctgtgttcagactaaaactggtgttgatataataaaaatgacattctgtgttaaaagagtagaatgctctaaattgcttaggaatggatttaaacatattttgacagttgcatgctattttagcactactgctctggttccccttcctggttcaaagccagccattcatgatacatatgattagcattgcatttgcaaataggattatctgtagcatgtgatggtgatcggaagttttgtaaggctgaaaacatctgatactgataccgggtgtttcttcaatttccaatttctgcttagtatactcgccagttttcagacagtgtttgtgtctatagttttacacattccttgcattatcatttggctccactcttgatttgtgagttcaatttggtttcgtcccttataattcagcaaacaaaaaagagctttgaaaggttttgagttattaaagaatgctattttctttagtaacaagaatggagaaacaaggaatggcaaccacaataaattaatttttcattagctatatgcttatccaattgaagtaactgaagcactcttaagatgtcttggtaaaaaagtccatttggatggagactagaattttgactgatttacgcttggtcctttgccctctcaaacagaatcctggcttttcatttggtctagaatgaaggcctctcacttttactggattgctacaaggttgaagaaaaaatgattgtgaagtatgtgaaggatatttgatgctatcttcaatgatcaaatggccttctgtttgttggatagttgtttatgttctttgtttgctcaacaataccaataataattaaggttctgtctggacagcaggtatgcactggcatgcttgtgaaactaaacagttgcttcaatattgaaaaccaatgcaatactgtcatggtgcaacttatgttatgtccagacatacagaataagttagtaagttgtcagatgatggttataaactatagacttttgaatataggagttatgttgctctaacaaaaagtttgaaagaacgcgtagctgtcttttttctttttttggaagttagaaagggaggtagacttcttttattgaacagaatatgatgtactctccgtgctccagttgtttgtatagagatgttaaaacctttgtttggtccatgcatttattgttttgtttttggggataggaaaggagtattactttgaagtacatacccaagtgctgaatatcttgattgttgttgcagttgactgatctggtaatggacaacggatccggttatcttggaatccccctagatgcgaagaacgacctcttactgggattacacgaagctactgccattgagttgcctgatgattgggagggggcgacgccggttcagataatgaagcagctagcttcatcatggcggattgatctgcagcagcttatcagttagggccatcggttgttgacatgagttaatttcatttgttcatttctgcctattttttctctatatatcttgctattagggctataagtattaggtttgacagaacctttgagtggaactgtgttgacatggattggtgttgtacggggaaatatgatgttgatattgtttacctcataacctgtgttggctttcctatttataatttggaggatctcaatttttacattttttactggctcaatttatagttttattatgcatcttgaactcttaagacaccggttgggctgataaacctaacgcacaatgaacagacaaaattgtaatttggacatgaatagattgtacattgcttttgttctttcacctaaaggacagaggctggcaggcagcaggagattaaagatatcctgtcgagcttaatgcaggccgacaataatttgttagggaagacaaaacttatcccagatgatggttgcagacagagatagccattgatcaatttgaagatggattgatatggaaatcttaaagcacgaggtattaatttcatgctacagtcaaaatattttccagggttaatttcctgctgcagttcaatctttttagtgttctcaaccctcaggtaatctactgctgcgcgtggtgaatctgcgctttgttatggctgattgtgatatcgactcgaaacgatgtggtcagcatggaagcgttttgctgaatctgaaaaactgatgtggatgatgttgaacagcgagcctcaagctaccgtggtccgtggttatcaaaattctcccttcttggaaattgttgatgaacagcaagtctaacaagatagagaattactactatatttatcattcaggagttgaactcgtcgcagcggagaggagcaatgtggtcgagctcgacggggagcccgttggccggcgacggcagcgggtccctgacgaaggtgttctcctcccccccgcagcagagcctccacctgaagtgcctcaccaggtagtgcatcgtcaccagcgtctccaccctcgcgagctccatcccggggcagatcctcggcccgccgccgaacgccacgaacgagtacggcggcggcgccgacgccgccgcctgggcgtcgaaccgcgacgggtcgaacttgtccgggtcgtggtagatggccgggtccatgtgcgtcacgcacggcgcccagaacacctgccaccctttcgggatgacgtagccgccgtcgagctcgacgtcctcgagggccctcctgaagctgccgaacaccgggggcaccatgcggagcgtctcctgcgcgacgcgccatgtcagcttcatcctcgccacgtcctcccatgtcagcgcctcgccgtctcgcttgctcctcgcgatctcctcgtgctctggccatggcgttgtcagagggattcgatcttggcaaatggaaatggtgatgtgatgtgtgagttacttgccttggaccatggcggcgaggatggcagggtcgtcggcgaggtggcggaccatgaaggtcaagaggatggcggaggtgtcgtggccggcggtgaggcagacgatggagttgtcgatgatctcctcctcggtgagcagcggccggccgccgccgccgtcgccgtctcggaggctgacgaggtagctgatgaggtcgtccgatggagacgactcgccctgctccaggttggccttcttctccctcaccgtcgccgcgagcagccggcgagccctcgcgctcgccctgaggctccggcggaacgcggtgaacggcaggtcgagcggcaccgcccacaggccctccagcatgtcggcgaacgcggcggcgagccgctcccggacggcgccgcgcgcgagcccgaacagcagggtggcgatgacgtcgagcgtcagcagcttcatcagcggcagcaccgcgacggtgcggcgcccggcccaccgcccggcgaggtggcgcctgacctcgccgtcgatcctgcccacgtaccgccgcagcatctccggcctcaggaactgcgccagcgcgccgcgcacgcggcggtggtcgtcgccgacgagctccagcatgttcctcctcccgatgatcgccgcgaggctccgcggctgcttgggcgccagcgcctcgctgaggaacaccgccttgttcgccgccgggccggcgaggagcaccgtcggcgcgccgaacagcgacagcttcgacacgggcccgtacctgtcgatcctgccctgcagccaccgctcggcggtgttgcgacgcatggcacgcagcagggacaggctctggccgaccagcggcaggccgagggatcccggcggcaggttgcgccgcggcggcggcttcgtcctcgtcgatcttccggccaggtagacggccagcggcgtgaggaaggcgacgaggagcgcgacgacgacgacggcgagtgccattgcagcgatggctaactgggacgatgagtgtgaaagggtttatgtgttgagacttgagagagaccgacagaatggcatccgcatacttctttcgtaacggggtgacaggaatctgatttaagccgctttcatatgtaattaacaactatgtcaaagtagaattgtttgcagtttttttatttgacattcatattttagcagctggacccaagctaataggaaccgtgttacgacgtcccattggcatggtgggagatgctagccaaaaaaaaaaaagatgcgcctaagaaatgcttgcgtaccttgatcctactggttatttgggagatctggaatggagagaacttcaaacaaaagaagacttcggcccctggccctaggttgttcaacaaaataatggaagaaacatgaacttggaccctagctggtgttaaaaagctagtgagtttcatctctgtacaactttacttttttctaaccctaggggttgtatttttctcccattttatttaatgatagcacagtctcgtgctgattccaatcaaattttaccttaaaaaagacaaaatttgctacaggacataaaaaaaatgtgtaattagctaagggacaccacaagatcgtgaaacgactgagaaacacttaaaaaaatgtgtaatttgttgttagacactttcatcattattttatcatttttgggctagatggaaagagaaacaattcaaaaggaccagattgctcttggggctagattatttgtagcgtcggtgtcgtcgtcatcgatgcgcgtcgctgcgtgtcgttgccaccacggttgatgcgcattgctgccgcagctaatgcacgccactctctgcgcgcccgatgcgtgtcgccaccgccaccaagacacgccatagcagatgtgcgccgcaggcccgcaaccataatcgatgtggtgagaggagaggagctgagaggagacgagtgtgaatgcgtgatgcggcgtaaatgttttgggatgcggcgtcgaagaggagaggaagtgggattagggtagattgcctattgggttgtgatgggctgggagacctgggctaggaaaagctatgtgtgaggctaggccacacgagtagggctgggccacgagtggttaggaaaatctaaaaaaattataagtactagtcaactaatttttttctcacgagtagggctcaggcccaagctgccctagacccagttccgccctaactccctcatcgtttcttttattaaaaatacatcatattattaaagcattttgcatcctaaatacaactatattacttagactaaccaaaacataaaagtttttattggtgaaagataaagttgtaggggtcaagtgtcaaattataagagtgcgtgcttggtctgtcacgttcacgtcacacgtgggtgtacaattcatctaatcacttctctactattataaaagatgtttttgccagtcctttggtacatcatctgtgtttgagtcagtttttaagtccattcgctttacatatccgtatttgattcggtttttttaagatcgttcgcttttagaaatacaaaaaaagttttataagaaatatctttaaacaaacttgcatgataatttgagacgatcagactcctaattgcagcttatgattttgtaaaaaaaatttctttcactcgttgcaacccacgaatatttttttttctagtaataaagattcggtcgtacgcagaaaacaagtttttaatagtgatgggttgggaagggagagccgcagatcgagtcctgtctctctcagccaacaccgatttctacttcacgtgggctgtgcccgagcttattgggagagtactttgtttaaagggacacgtttttcaaaccattaaaggatgtgtcctttaaaaaattgaaataaagtcatttctaaaattagaataactgatcatacgcaaatcaccaatctcttcctcgtttttgtctgtggtttacaaattccctctgtttcgactgaagcctaattcttgtttcatgctaaaaaaattaagagaaaattgagagaggtgaggatattgtttgtgaaaaaaaagtcaaattttgctataggacatgcaaaaaaaacgtgtaattggccataggacaccggttgtatttattatttatggatcaaaataggtgagatatttttctaaatacccggattgccccttatctttcc

SEQ ID NO: 79126 - DNA, 3427 bp, Oryza sativa
gaagtggttcaccatgcggttgtcgaagtcctcgccgccgaggtgggtgtcgccggcggtggccttgacctcgaagatgccctcctcgatggtgagcagcgacacgtcgaacgtgccgccgccgaggtcaaagatgagcacgttcttctcgccgctgctcgtcgccttcttgtcgaggccgtacgcgatggcggcggcggtgggctcgttgatgatgcgcatcacgttgagcccggcgatgacgccggcgtccttggtggcctgcctctgcgagtcgttgaagtaggccgggacggtgaccacggcgttcttgatggacgagccgaggtaggcctccgcgatctccctcatcttgatcagcaccatggacgagatctcctccgcggcgaactgcttctcctcgcccttgtactggacgacgatcatcggcttgtcgccggggccaggcaccaccttgaacggccatagcttcatgtcactctgcacggacgggtcggagaacctcctaccaatcaaccgcttcgcatctgcgtttgagattgagaaaaatcgcaacaccagtgagttcgattgctccatcgattcagcagaaaatttcaaatcaacaaagcaatacaatggtccaactgttcaactagcatttattatcaaaattctacacagcactacagcagtgagactcaatcttcactaaatatataaaagcaaacataatctccaatgagttcgattggtccattgattcagcagaaaattccaaatctaatctactaaagtaaatccaagaagcaaacataatctccatctattttagtggcattcatcaaaattctacacagcagtgagacccaaatcttcactaaataaaaagcacgatttcgatttggtcgagaaactgttcatatactattccagtggacctaacaacatgcctgtgcacaatgaaccaaagcaaaattgacatattaactcctttgggaattggcacgagcagtaagcaagtaaaattgatctgtaacatatgctcaacttttagctacgcgtgaacaaatcgcagaacctctcctaacacatctattcagaagaagaaaccacggagttgcagaactgattccatagctactccaacccatacagattacagaggacagaaacataattaccagaggacactagaacagggcatcatattctcatcgatctagtacactcttttacacatccaaaactaaaaaaccacggtgcagatcgcgttcacagtcacaaccggcgcaagcaaaagtggaagcagggagagggagggcgggaggatgcagggtaacgtaccgaagacggtgttggttgggttcatggcgacctggttcttggcggcgtcgccgatgagccgctcggtgtcggtgaaggcgacgtacgacggcgtggtccggttcccctggtcgttggcgatgatctccacgcggtcgtgctgccacacgcccacgcacgagtaggtcgtccccaggtcgatcccgatcgccggcccttcccccttcgacatctcctcctccttctcctccctctccaaaaacctcgcggaatagaaagcgaatattcgcaaacgcgcgctctcggattggattgcttgctgctgggtggaatttctctctctttctgatttctcgaacgagacgaagcgggggaagaggggaggggcagaggttttgtggcggaggtggcgggggtctagaacgttcgcgcgcgggcgatcctggccgtcggattgggggttctggaagggtcgggagggtgccggttcgcgtgaaaggaagaggggacaaccaatcaggaggcgacacggtggggacgcgttggtgggccccgcttgggcgcgcgctttttgaacggtctcttgaggtctgggaggttctacactgtgctcgtgacgatggataggcggagtcggtcctttgtttccggaaatcctaattcgctaacgtgcgaccgcttgatttctcgcgaacactttccaaattccaacctaagggcccctttgaattggagaaaaaacataggaattttagaggattttaattctatagaaaaattttctatgaagttttttgaaacaaaggattgaatcctattaaatcttttgaaatttctatggaatggccaatcctatagagattttggaggaaatttagcaaaagcttcaatctcttagtaactttgagtctatctctctcatctaattcctgtgttttttctgcggttcaatcaaacggccattcctatgtttttcctctattttacaatcatgtgttttacacttacattcctatcaaaatcctacgttttatcaatcctgcgattcaaagaggccataaataaagacaagactcactagagattatgggtagggttaggatttcggaggtaaagggagatagagccagggaggtgcatcgaatttagagggatggcaccgaaggtcatgaaaaaaggacagcggcgagatagcgatggcggcgccaaagccgcggggtcggccatgggccgtgggccggtgttggtggcgggggcaaagctaaacgaaataggggaggaggagaccgaccgagcaggcccgcgctgacaagttgacgcctttcagtgccgacaaggccgggtggtggcacggtcaggaggtggtggtgggagaaggttggagtcgaaactgacccttgtttggatttcgccataggaggagcggagggagttcgccagaggaagctcgccggagaggccgtcgccactccaggagcccacgcaccgtgcttcagcccccgctcctgctcccgtcgttgatgccgtcgtccacagaaagaaagtcgcatgttaaaaagaaggtagagagagtaggaggaggggctaatgcgctgggctgttggaaagagttcgcggtcttcgagcgccggcccattgcacccacccccttgtttcggtgtttggagcggagagaggcaggtgtgggccgtcatgggcttttgttgcaccctgtaccgcgaaaacagctgcacagatgcacaagatcgattcgtccaatggaattgttcagtacaccgtagctttctcgcctgttttatgcttggattttgacaatatcaaatttgataaattttagcgctgctaaattttgatattgttatattttagtttgatgtgtttctaaaatttgatagctttttatgagaggaaaattccggaactaacaatttttgatagtatgcgattgatcaaatcatatttagtttgttacctaatcaaaatttgatagggttgaaaatggtaataaagtgaacatgcttcttattgtcaaaaccaaggtgtcgaggagtgatcctctctagcgggaggtcgtgagaccccccctttgtgagttcggccgggggataaggcgcgatgatca

SEQ ID NO: 79127 - DNA, 1192 bp, Oryza sativa
ccccaagggggtggggaaaaggcaggccgcacggccacgtggccagatgggaaggttatttccctctaccgtgagtacccccgagcccatatcaccgacacaaggttatcaaatattggtggcgttgaatgtacttagtttagtgcctctttaaaatttagtagtgtttttatgaaagaaaagtttcggaggtaccttttttatgaaatgatattggtaagattatgtttaatttcaagtagcaataaagcgaacatgctcttaacatttctcgcgtgattatatatgtgtttatatgttaagcaatttaaaattgtcaaaaccatgctatgtttggtttattactacattgtattctcaataacaaaaggacgctacataagttataaaaaacatcatcaaaatataatcatatgttcttccatatttaaacttttgctacggtgaaaactttcttacatattaccgtacaaaaggtatttatttacaataacaagaaaccatacttaaaaaactttcttcctccactcaattttatttggcattgggaggatacggagtatcacaacatatttactgtaaaagaaatggacacttgacagggctgatttgtatgaaatcaaatatactctaaagatcattttggaagtccaacttacccccaccccctcaacttatgcaaaaatacgaattaaccctcattttcaaccctccccctccccctgtagtttgtttctgtacccttcaatggctcatcggctacctcaagccctccacgattagctacacacttggttgccacctcccttgttgaaccaaccaccattattatcatgcgtcttttacctgacttgtacatactcaagtagtcgatgacatctcaagctcaggatgagacagggataaagtaagaggaggaagaaattgaggtcactacaacctcacttgaccaaagcctagctcgagtcaaggcgaagctcacctagctctgtatcgtttgtggagagctcatcgaggatgctgtggacgaagaaagagagatagacgtcgtctggtgctccgcatccgctcacgttgcctcaagccacgcttcgcccgcaacccagtcatattgcctagagctccatcacccatcgtgaatgcgtcatagttctagtggcggaaacaataggggagagttatggagtaagga

SEQ ID NO: 79128 - DNA, 546 bp, Oryza sativa
atgttccaatgctgtacgtaaagtagaacatatgcaggactaaattctcataattctatttattctaatgtttctgcatgctattacaggttttatcagaatatagaagaagaggatttgattttgtaacgcaggccatcacctgtccaacatatttgaaagaccttacaggcatatctgatttgaaaaaaccatttgcttctaaaatttcagccagcattcctgtttctaaaacttcggccagcattcctgtaaacctagagaagctgtccagtgcccgatgtctacttttaggtgctggaacacttggatgtgatgttgctcgtattcttatggttagtctttgtccagttctacttttatgttgaactacgaacagacttaacaaaacatttctttgactatggtggaaacaaaacttttcacgactgtggtgtgcggaaactaacagtagttgacagtggtcgagttgttgtgtcgaatttggcaagacagtcactctacacatctgatgatcgtgacatcccaaaagcatcagcaatacta

SEQ ID NO: 79129 - DNA, 1473 bp, Oryza sativa
tatacttattttttgataaaaagtgttgggtattcccgggaatcatggtggctccgccaccgaaagtaagatgatgtggttttatgaaagaacaaaagaagaaagataatttagaccatatatctaagggctaaaaaattgagatgatatggtttaatgagagaaaaaaaagataattcgaaccatagattaatcatctaaagactaaaaataattaatgtgatataacttaatgagagaaaaaaaatagcataaactaagtgagaatgaactatataggtatataagatagcgaggacgctcagcaaccttctggtgccaaggagtgatgttgcatacacgaagaagaaagcagatcacaacatatgctgagaagcaagctacaactgaacctttgattgaacagcaacagctagcatcaaatagatgcatattagtattattattcagtatgtagaagtacgattgacactaatatagacatgagaagttgctgctactagatagatgcatggcttttgttcatctttcccttttgttcagactctttggagttttagtaagagcaattttctgtagctgaaaggctacgtgataatggtatgcttcgtcaggctgttcttggctaaacctcgaggattcttttttcgaggatagaggatttttttaatcgctctactttctacatgccgaataaattttctggatgaaagccaccaatttggagcgcttgctcatgagagaatgtagcattgttggtatttggtcacatataaattaatctgtaagcgcacggataccactataccaccactataagtatgccaacggtatcgaatcacaggatatgtatgtgtgtatatttaagaaataattcaaccaaagacaacaatgaatagtaagcttaggataaagaggattcatatgaattaattaactctaacaggagttaatcctatcgaatgcttcgggtaacggctctcccttggtctaccaagacgagtccgccatgtagctctatgatatacctaaacgtggagagatacaagggactgacagagctatcaccatctaccgcctacctcactttctatagagcacacaataaacgaaggtaacctttaacctagacactacgtatacgttattaattaattactactctagcctcgggcaaaaatcttcttccttatctagagtctttgttctagagcactcagtataaactaagcggcgaaaccacaacgatgagaatatatctgacttaagtaagtaaactaaatactaaaatgatatcacaaataacttatatcgaagaaacattctcgagatacaagattggagagaggaccaacaactgtggcgctccttcagaactatcccgaatgtaggccaacatctctagaacatcccagagagaaaaccgccattcgggcactccttccgaagcttcccctcactctcttcctatat

SEQ ID NO: 79130 - DNA, 9003 bp, Oryza sativa
ttcagaaaaggagtcggcaccaacccttgattgatttgattgcttgtatttcatagaaaaatagatttttctatacaagtttcatcaccaactaaggttaggtcccaacgtgtctatacactagagatcaaaatgtatacactgcaagatgtagtccaatgtagagtatacattgtgattatcttggcaaccactacctacaagtgttgggaactgattgaattcggttattaaaaaaatcaactgcatccgtccagttaagaaatcaaattgtagcaccggttgctagatttttatcttagagaaattttattgcccttggtagttaccggggtactccctctagtaaaaaaaaagtttatgataaggttcagtcaaattttaaaatcccaataatcaatataagttcatattattatgagaaatataatttctttttgacgcagaactacatatatcatttctttcgttttcaaactaagtgtttgagaaattattgatggttaggaattttaaaggtttgcatgaatctttctctaggagtaaaatatttttgaccaaaggaaataatatattctctaacataaaactacctttttaccaactagttatacacacacaacaatgtgtctatatatcatcccactttcctcttgttttttgacttatcttgcacgataacatcatcaaaaattacacgtgaaggttcgttactcctacacggcatgcaggcgacaaaagtatatatggtctagttggtcacaaaaaccaattcgtgaatcgtgatgaggtgtgcttaaggcgatccaaagaaatctttttcttgtgcaaggtgcgcagcacacactggtccaaacctctgaacaataaattattaggagacaactaagtggcaaaagatttatactagcggccgaccttgtgaaagttgcaatgggacaccagctttaattagctttaatttttttctcttggcttgatttggttaatttgctttgctccaagtagtgtggcccattgccgattaagcaatgaataggtgaaaccaaattgcattagcaaacccccttttgtggtggccatgcatgatcatcacttgctatcacgtaatgctcatgctgtttcttcttgtttggattattgttgctgatagggtgcatgatgtggtttctgatgtgaacaataatcaggggcaataagaacaatgacttaaaatccttacgaatatgttctttgtgatccacaattttattattatatggtgtaacaaggattttagatttgtaagctgtaaaatctgtttgataaaatcaaattttggccaaaaaaaacagatatccagatattcccgtaggcagtgtttaagcgtttatttcacctgttgatatacttatatattgacatgtttgtacatatctcccgagcaaatcgaactatttagggtcagttcggttcctgccttactacaatataaattaattaggagagttaattttttgtttattgaataaagcaaagtgtggacgtatcatgccacctttttgccatgttatatacgcatgtgagattaacaatgggccaacttgacatatattttcccattaaatcttgtaattacaaaaaaaaaagatggtatacaaattaagtggcaagccacacggttgtagccatgattagtttacataagcataattttcatagatagcggtgctaaacatgatgggctatcaaaacattgtgtatttttatggtggttaattcttaatgctgatagataggatgaatcattggtttgcacagcaatctatatatgtgttgtgcatgatcttgatagggggcatgactagtttctttatccaattgtcaggacataaatagcgatgtgcttcaagggaaggcaaaggagaaaaaggtaatctttttttgtgtttgtggtttgtgatcccacttgtgtatacttttgctcctctttaggtagtggtagggctgtcaagcaagttaattaagtatttctgaaaagtggaagataccattcaagtttgttaatttgttcttgttggttatcatcagtttatacttaatagattaaaatactgcagcccatggttagtgcattatagttatgcatgcatgctgctcctgaaagagacttgaagaaaaaagagaggatcaggaaatttatttgtttttaatccttaaaacttgacttctgaccatatcaaatatgcatcgtgatatatagctggtcatttcttgtttcaatatttgtagggaggatatagaaattaaatatcagctcaactgaatcattcagccatgcataaagaaacttgttggtatagctattggtttcttgcagtcttcataatttaatgaactgattttttttcagtttaatgtggtgccatcctattgatcaatagtatccatctcatgaagcctacagacactaactgcctaactgtctaagtaggcaagaatagaacaagtcgtccacacttgtctgcatcctttttctccatctttcttttttttgatatctggtggttgcaacatcaattactactcatcacataaaaccaaaccctacaagatttttaacatgagtcctgcaagaaaacaaaagatttttcaagccaatcaagaaacaaattctttcagacagggtggtaggtgtggacattcagatcttgattgagtgtacaccttaattgcacctgtcctaaaactgtttaatccttcttgtttaccttatcacacagagcagtactgcagtactagtccaaaacaaagggcatcaatgctttgtccttagaagcatattttttatgaatcagtaaagggaactaattaaagatgtaatccttccctagtcttgatcaaagatcttattctttgtgattgattgacagggtcattccacctaaattttaacagaattaatcgaatcattcatacaggtcggttgcgttaatattctaggcttcattagaaggatattattgatcaataggatggaaccatattaaaactagaaaaactagatccttggtttagaagactgaaagagaacaacatatggcttttttatatacatagctaatttagtaagattaattgaaaacgcaaaaggtcgtcagaaatttgacttgaggggatattaaatttgggagattagcgaagcttaacttcatttgtcaatgtgcgtacataactgaagcagatatgtcaaccaaagagatggaaaagtccagcaggatcgagcaatcaattttcaggtttaatggattatatattcaggacattttcgtgagataggcgccagttttggggtctatttatatatatatatatatggtttcatacatttccactaaataagttaggtacggcattgttatttctccgaaataggctctttcaaaatagagcaattttacggtccttaagaaggtaccatgaggtaccacttttttctattgtaaatttggtacctcttgatatctatgtactattaggtaccaaattttacactgaatttttttttgtaccttatggtacctcctgaaggaccgtagaattgctcatggtcctcattgctcccatgttacctatttaaagaaagttaatttttgttagaaaaataagttattctaacccaaacatggaataaactttacagttcatatttttttccaaaaaaaatacatgtgaaaatattcaaacttgggtaaaataaaaccaaaccaaatataccattagaactgtagttaaataaacttaaattacaaattaagcaccatggttttaggcttgacattgtgtagtttttggtgaatgaaaatctacaaacctttcaagcacctgaaatacaacaaaatccctgaagaaatagttgcaagagtttccatttggaagagccttgatcgatccctcctacccacgcacacatcacaggtccacaagaccacaacatacacggtttgcgttatgccctgtgcggcaatgtcactgtgcgattagctggactgatcacgtctcccaataataagccgtacgccggctctggcctaaccagaaccacactagaacaggattagcaactttagcatgcagcagctgccaatttgccactgacgcctctcccgtccatctttttccccgtgtaccacttctccgtccgtatgcatgcgcgaccatctccagactccacagctcacgagatgcctgccttttgctccctgcagctgcagctgcaggccacaatagcccaagagtgacaccaccacatgaccgcaacaacaattgccgcctcgcctgcgaaagccaccaagagctagtagcgataaaacagcacaagcttaccatgtcatgccaccgcgtaatccgtgtacacgtacgttgtagtaagagcaagtttaatagtatagctccactactagctccaaatcatctataaccaatgtaatagtcaattcataccatagttgcttgctatactattaatatctggtcccacctgtcatacacacgttacgtcttgaagttcgtgctgcagctggctacaaatctaatatatttatagctgacttatagcctgctattgtacgtgctctaatagcttaaccgagaaatgtggcgccgatctatcgccagagagacccaaggcgaaattaaacgtaacagcgacgacgcgccctgaaactgaaagtacgtacgttgcgttccaagatgcattttgccatggtcgatcggaatttcttctccttaattttggctgtgcctgtctgtctcagcctcagggggacgctcaaaaaggtcacacggttttctttttcccttttttttttcgttttgttttttgttttctgggggaagataaaaaaaatggatggaatcttcggctaagggaagttggtgggtaccagaaaaactaacgcggttctacgtagcataatgcgcaaggcactcggttcacggtaatctgtattgggcgtagcttaagaaaataggtcccctaggccatatcgacgatgggtacatatcattgtttaggtgacaaaacaccggcgcgtacgaagcccccgtcgaatggcagccaaataaaaaactaaaattaaaaattacaaacttaattataagattcattttgagatattttcaacctagcttttttcgttggtttttaagtaaaaaaagcacgtatttaaaagttttacctgtaaatttaatttttattctctaataaaccgttttgggtttattagggaaaaggcgaaacaacatggcctcgagacggcatggagaattcgcgtgtgtcgtctcgtcgtcccagcggagacgcttccgtttaccggttcgctctcgaggaggaaagggaattagctgggacgacacgggtgtttttattacaaaccgtccttgcccgtgtccgtgagaagggggaggaacgacatgcagggaggcggtactactgtcccgtggtagacaatctgaaatctgggttaattgtttatttgttcgttcgtagctagtatattagctctttttctaagggtgtatttgaaactatgtgtggagattatgggtaccctatacccacacggcatagttatccgactggttatatggtataacttatagagaaaattcgatctatagcacaggaaaaaacccggtaccaaaatatagcagaacaaattttctacttcgactaaaagcatagggcacaaattttcttgcgattcataccacttccgtcacatttgccatccaaacatgtgagttgacatgaaaaaaaaactcatttgcccctcttccctccgctagcgctcttctcactcggcgacgttgccgcgcccgtgtcgccgacgctcggtgagctgacggagccgcgcttcccgcccgcccgctcgctcagccgcttccgatcggcgctcgtcaccacgcttcccaccgttgcccgcgccagatccgtcgcaccaccactggatttgtgcgcgtggggtggagcaccggccagatccgcatggggaggaaggcggtggaggaggaggtggagacgccgcgcttctggcccgccagctcatggccgcctactcggcggcggcggcaccgcccgaggtcatggagctgacaaagcccgccgcccgcccgctcgcgaatcatcccaacatccgccagcgcgcgccgcagcccgcctgcataagcggcaggtcatcgtccctgtcgccgttgtcgtcatcgccggcgtccccgttgttgttgtcgttgtcacgtgcaagcagcggcaagccagcgcggcgtggcgtcgtggcaagggagatgctgttctgcggcaccgagtacggccaccacgggccacatccatccacgccgaagctagggccgcccacgtcatcgtcgttgtcctcgtcgtcaagctgccgccggcgcgggaggctcgccctctatcagcaacgccgagtgccagacggggtccacctcgccgtcggcggcgacggcgagccacgcacccacgtcgttgaagagcgtgtgtagctcgctcgacggtggcggggagacgaggcggtcggcggtcgccaggcacgccgatggccgccacgccgccatccacgagggggcggaagaggagacctggtggggaacgtggggaacgaagggcaaatgtgtccgacaaaaattttctccactccgatctaacaccgttacttcaaaatgtgacggaagtactatagggcgaagaaaaatcggtggcctatgctatggatcgaaagtggaaattttttgtgctattttttggtaccgctttttttcctgtgctatggatcgaattttctctaacttatatttatagaatatgtaacggataatgacttaggtattacgtttccttctatattatggaatggcctaaagtcctggtttgataatattgtagagtagatttagaaaaccgataccgtattggttaagatttctatcttgtaatcatgtcccccccatcctatataaggtgggcaggagaccctctagaggcatgagacacaactagatcgtcagatctataatacacccggcagatttaaatccccaaacaggagtagggtatcacctctcattgagagggcctgaacctgtctaaatcctttgtctccgcatccatccacttttaagtctcgtgcgctacccctttatattgctgaaatattgtttcgacactatgggttaggagaagattgaaaagacatgtaaaacgagataagtcattagcacatgataattaattaagcattatttcttttaaatttcaaaatatattaatatgattttgttaaagcaactgttttataacaaattttgaaaaagaacaccgtttaaccgttcaacaaaagtaggaggaaaaacaagacaaatttcctctcaatttgttgcttccgaatgtagttacttgcattttttttttagaatgaacaatactggagtacttgcatttgaataaggactagggctctaataagtccatgagcttggacaccgtacctctttatcatagtaaatccagcgcaacacaaaataggctaggtcccgcctctgctcataagtcttgactagaatgaatggatgaaattaacattcaagaccaagatcacaaaggccgtcccttctttagtcgattgatgaatatataatataaacatcgatggcacatcttataaatagaaagaatctattacatgccactggctttgtcacatgtctacgatttgccactgactttgtcacgttctacaatatgctatcgacttttgtttaacttctacgatttaccatcgccgtccggttagtctccgttagtactgtacaaatttgtcgaaatgaccaaaatacccctgggacaaaacctttcaaaatttggataaaaattcgaaaatatcatattttaagtttttggctaaattttggatgtttacaatcttatgtttataatatgttattttgataattttatctaaattttggaagtttttgtcctaggggtattttggtcatttggacaaaattgtacagtgctaacagatgctaaccggacggtgatggtaaatcttataagttaagcaaaagtcgatggcatattatagaacgtgaaaaagtcagtggcaaatcatagacgtgtgacaaagttagtggcatataatagattctctcttataaatacgatagcaatatgcagagaaagggggtacgtacgtacgagtacgacttccaactttgtttcaaagtcgtcgatgacgacggccactgcccactagcagggccaagtggtacacacacatatatcgttcgtgcattcgtgcgatatcgccaccgggtccatccgtgcatttgcctcaaaaccccacacacacaagcttcacagtaaccatgcacaattgagcgcatcacttcagggcagtacgtagcaaccggcatagccagaaacaagtcacataggttcatctgtattcagtcactagctgaaagactaggctgaaacaaggttcacaatcccaacgaaaaccagacttctcgaaccggtttgcaataccacaaaccactcggttttttcgtcaatttgtttttttaagaaacaataaaattattcaaattttatcagtttttaccggtttgctaacggttttcatgaaaaatggaaatattgaccgtgagttcttttcagtccgataagaggctttcacagcacacatacttatcgtttagctccaacctgccacattaaagatttcacgctatatctgtctcttctattaccaagtgaagaacgtgaagccaagtaagacatgtgttcctcgttaggattcgccagggcggggcaaggaatggctcatgttgcatgttgggagaggcttagctccatgtgacgcccctataccatgtgcgggttggcaacgatgagccacttgtattatgagaaaagcggattttagacttatgactccagtt

SEQ ID NO: 79131 - DNA, 22555 bp, Oryza sativa
aaaggagccttcacgttcgctctcatgatctagaaattctcacattaatcggagaaaaagaaaaagcagaatctatatagaaatacaatttagaaatagctgaaattcggaattaaaaaaaagaaatattaaaagaggagactagagtccatatagaaatacaatttagaaatagttgaaattcggaattaaaaaataaggaatattagaagtggagactagagtccatatagaaatacaattaggaaataactgaaattcgaaattaaaaataaggaatattagaagtagagtatagagtacatatagaaatacaattaggaaataaccgaaatttggaattaaaaataagaaatattagaagtagagtatagagtccttatagaaatacaattaagaaaaaaaatagaaatttggaattaaaaaataaggaatattagaagtagaatatagagttcatattggaatttaaaaccaactaaaattcggaataaaaaggagctttcaggttcgctctcatggcatagaaattctcacattaatcagagaaaaagaaaaaacagagtccatatagaaatacaatttagaaatagctgaaattcagaattaaaaaataagaaatattagaagaggagactagagtagttattacacattagtagttttgaaaagttattgcaaaatttaaaattatgttgtcattgtaatatattataataatataatgagaaaacatatatgctattatatgagagaaaatataatgatgctagccgcgcaatatgcgcaggccaccatgctagttattataaaccgaataaatagcttagaacgagccaggcaatgctgatgtagaaaatttctagtttgagaacagtggtatgcatatcccgaagttcataagctgaaaagattgcaccctaaatctaatgtattgtaattttcctgtactgaaaatgctgagggggggactacaaggagccaagccgaggcccgtcaccgccctcacggacgacacgtcgccagacagcaccgctagcgactgccctccgcggccaaggagcacgaccgctccttcgccgggaacagcacaccgtcgccgggacacacgccgccgcaccgcctccaccacgccccatcgcgccaccgcgcacggcattgttgctctcctccggccaggtccaaaagcagggtgccagatccagccacgggggcgccagatccgaagcttcgcgccgcgctgatgtcagcccccacctatcacgcgccgcgtcatcatcctcacgctgagccgtcgcgtcgccgaggaatggcctcgccgccgccctcacagttggccgcgcggaactccggtggcgcgctccggcggcggcgaggggggagaggaagggagggggcggcgggggctagggttcaccccctgtgccgctcgcgtgagagggcgacgcgggggtcgtgccggcttcgtactcttccaattgaggataagatgaactgatgtgataagtagtacgggattgtacttattttaaaacaaaatttgaatataaaatcatacttattttagaaggattgtagtatttggacttgggagtaattttactgttcttggtattagaaggtaccatttcttttatataaaacttggtatttctcgaggtataaaaaacatacggttaggaccgtaacgaactgtgttagctgtaggtttgcatctgttcccaaggtgatttaatttgagcaattgcaaatagctttttcttctttcactcggcagctgaatcttgcttggtggagtactcgggccgtgcacgttcatccacgggtttgatttgacattggtcatgagcgcgttttagtggacaaagtggtggttagcatagtgaaattgtcaacgcgagaagcagaaaccaattgctgttgctgtcgccggtaccaatactgtatggtgttcctgttccatcagaattcagtcgagtgcatggcagctcattcttgtggcccatcacacaattaatctccgacgatgtactgtacgtagtggagcatttagattagtaattctcgaatacattttcgtaagggttaagtgggcatatgtaacgtgttcactccttgttactatctctgttttcagatgagtgacatcatcagcatagtccgcaatacacattttatcatcataacaattttacactataaaaaacgatttttcgtgatgttaccctatattttacgctggcgtccatatgcaaaaaccgccaaaaaaacataacaataggtggggggctacggaccaccagcagaaaccaatttttgctgataaccacgctaagagaaatgcctaaaaaaactactctatttttcgagacgaacctcttaagtgtctgccagtttttcgaggcggacctcttaagtgtccgccagcgaaaaatctcattttcaccggcagtaggtaaggaggaccactgcgaaaaatgttttgggcgaatatataaatctactgtcccccacccccaccgctcccttctcccttcccccactgcgcggcccctccgccgcctctcttccttctctctcggtttcaccttcttcctcccttctccaccgccgccggctgccgtcgcctctaccgcctctccgcggtggtggggcgtggcctcctcctctccaccgctagccgccataagctcggggccggattcggccgctgcgacgatggtggaggccggatctgccgccgcgacgacgggggaggctagatccgtcgccgcgaccgccgcagggccactagtctctaaagactaaactatatatttaaaaaaacattaccaatataactttatgaaagagagtttctcataaaaaaaaatataccaatataacttttcatattttaaatatttttacgtctattaaatttttaaggtttcaagatttgactgcacttacaggagatactactatacaagaatcaacgagaaacgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctcctcctcctcccctccgccgcacgacgggaagatcgcacgcgtgcttgtcctcgtgccagtccacggctccgcgcgcgccgtctttctcatggtctttctcgatgggtaggatgcgttctttattcatgttgatctgccgtagatggggggatcttgagccggaggagtagctagtttctttgattatgcgttttggggtctagcggattttaacatgagatggtttctctttagcgacatttttttttgttcatgttgatgtccacggtgattgttctagttatgtcatttttatcttcaagacttaaatgctttgaatcgccggtatagaccagattattgtcgtgaagatcgacgtattttccgagctgaccctctgcatgctgaaaattttgtagtgggttatatctagattatatgtgtattgttgtcattcaattagcacttaaacttctgtagcatgaacattttcatcattttcctgtgaggacatcggatgagttcctttttttttctcttcttgttctaaaattgttcggtaatcttgtctggctttgactgatgggctccaatgatggcatgaaatctttgagacctgacattcttgtgatgacaaacataagcatatttcctgagacccaattgaggttttaaccattggtttgctgaatgtgtcttcactgttgaaaaatttgtacacacatttgcttcaaattatgcacatttgattattgtttataggcctgcgatgtccattccacattcagtatttgttaagctgagtgcttttgtttcaaatttgttttgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgaaagcagtcaggatatggtggtcagaccaagcctgttttccacaagaaggtactgtgacagtttatatatgattatgcagtgttgtgtgtgactctctgttcattagaaacgtacggtgtcatgattgatgtagcagtgatatgtgtctgtacaatgcatgtggcaataaccatcacgtagttttaattgcatgtggctttcagctgtgcatttttcatgttatgatacatggttcctgttttcaggcaaaaaccaccaagaagatcgtgctgaagctgcaatgccaaagctgcaagcattactcccagcaccccatcaaggtattatttcattgtcaagactccagagctgaaaattatcatgaatcattattttgctggatgtgttggatgctcacttgcataattgttctctgcagaggtgcaagcatttcgagattggtggagacaagaagggcaagggaacatctcttttctaaattgcttgctacctactggatactatagttgttggtctactgtgcttcaatatttcaatgttattaggagcttatttaagcagaccatatcaatgtattcaagtatcatcgtctgacatttactctagcaaggattggctttctgctgaatcaagttttgttgcttaatgctcgttgaatccaatgtgatgcatgtgtttatattttgctgcaattttatcttacgacagttctatttaccttagtcctcagtatcccttttctttttttgttatcttacctgctgtcttttgattagtagttagcaaacatagagcgacccactttaattacttcccgtgacatgaatatgacctcgagagattagtctagtgaacttcctttttcagactgaatgttgtattgttaactgtactggcgtttggtcagtatctttcgaaagagatggaatgtagggacgtaattttattgcaagataattcatttgttcttgtggttcagtatcttggaaggtcttgtgatattagtgaattcttttcgtagcattgcagtacttgctctgtccttaatgcatgattcgataggctacgcaatcccgtttgtagtaatgaattaaaaattatatattattatgaaccgaataaatagcttcgaacaagctaagcaatgctgatgtagaaaaaaattagtttgagaaccgtggtatattccaaagtttgtaactgtcataagctgccccccaacccacccaaaaaaaccggatggcagcaatcacaacttagcattgctgctcatggcaatgttcatatactatgagtgcgggttagttcagactacagacacgtgtggtaattgtttttttttagttttttattttgtttgttaggtggtgtttggatccagggattaaactttagtctttgttttagatactaatttagagtattaaatattgactacttacaaaactaattacataaatgagagctaattcgtgagacaaattttttagggttaattggatagatgccattataaaatctttagttttgaaatataccgttactattaaactatttagaaacatgccattacaactttttcaggtattggaaatatgtcactgtacaacctttggatgtgtttaacaaaaattttagaccaaatcgctctcgtcttctcctttgtctccaccctctcctgttcatcttctttcttccatttctttcccttttggatctggtatcttagtattcttcctccacatctcctttctcggccagcaacggcggtgttgtgctgcaccatctagtttcccttcttcccttcgctggccgcatcaccaccttctcagtttccagcctccccgaggtctactgcaacaaccaagacgcggagcatgtcgttcttgaatgtccagcacccggacgcccaaggacgtgcccctgtcggtgcagctggagtcattcgcctacagcggcttcaccatggcgtggtccacgtccaccgattacgtgctcgtcgacgagcgcgccttgtgcacagggccggtcctgagttttcaagctctaggacaaaaacttacgtggaggcccctatatatatacataaactaatatatatatttatagtcttataaacatgtaatatttaatatttgatatgataaaattatctatatataatattttaaaactttcaaagagaaataatataatcataaacacttacttggcactttcaaaagtttcttctaaaatttcaatgaaatcatccgaacattttttccgttttcttttttcgctaccggatacatattttcttgacaatatgattaatgttgtgctaaaaaataatcattaattattaagtagtacaagctaataatttttgatctataaagaggaaaaagaaagatagagaaaattaccttagacgacgactgcgaggcgcgagcagccgatcggccgatgagggcgcgccgccgggcggttggcctccaatcgacgtagtcagccagtcatgcagagccgctgcgatttgctgccgattgccgtgtttgcgttgcggtttgccgccgtttaccgtttgcaacgcgacgcgaggcgtgatcgaggcgacgggaacggagtcagatcgcttcacttttccttcgctcctcttcgtcttctgtcttcgataccatacatgattcaggactgagagcgatgctgaccctgggggcgtcgtgggccatggcccatccgccatggggccccctaaattttgggggactcgggcgtgcgcacgggctgaccccccctagggccggccctgcttgtgcatgatcctgacaaagtgactattactgtgtactcctaatctcacagcagcaagaaacgggaggaagaagatgaacaacagaacaggagagatgggggaggcaaaggaagaagacgggggcaatttggtccaaaatttttgttagacatatccaaggggtatgtaatggtatatttccaatacctgaaaaattataatggcatacctccaaatagttgagtagtaatggtatatttcaaaactgaagaatttacaatggcatgtatccaattaacccaattttttaagcctaattaattcataattatagaatgtttattgtatcatcacataggctaatcatggatttattaggctcaatagattcgtctcgcgaataagtccaagattatggataggttttgttaatagtctatatttaatacttctaattagtgtccaaacatccaatttggaagggactaaaaaattttagtccattccaaacacctccttattatttttatcaaatagccacgtaagcgtcatgtcaatagcacgtgggacgaagacccctagtcaaaggcgtcatgtcagctaaaaccggagacattgctaccgagagagctcgtttgcacagtttgaagaaggcgtcatgtcagccaaaaccagaaatattattaccgagggacctcgtttgcacactttgaaggatggattgtatatggttttcggataaggatgaaaaacagactaagcgacaaagtaagagacctaaagtgaacttatttgagggataaagtccacttggacttccttaactataagggaataagttcacctgacgtcccttaactttaagtcgagttcgtctgaggttcctaatccacaataaaatctctacctctcaactaatcataaaccgtgcgaaaaagatcacaaaacagacggagcgatgaagtaagggacctaaagtgaactcattttgagggataaagtcacttcataactataagggaatataagttcacctgacggccctcaactttatgttgagtttgtctgaggtccctaatccgcgatagcaaaaatctctacccctcaactatcataaaccgtgcaaaaaagatcccaagacaatattgatccattttctccggttttgctgacgtggcatacggtgggacccacatgtcagcgtcctgtcttctcctcttttcttttttctttttttttcttcttgtcttttctttcttctctcttctcctcttcccttcttctcctagcctgagaggccggcgggcgggcgagcaggcgacggcaggcggtggcggcggtgtgcggagcaggcaaggggtaacgggtggcgggcgagcgacggcgcctcagagagggtgtggtgtgggcgtcgctgtgctgtggcgggcggagcggggtggcggcggtggggtgcagaggacgacgacatatggaagtgatggcggacgctgtaggggacgatggcgaggaggacgaagtaggccgggagaggatgactccgacgcgcttggggtttcaccaggagacctcgccttcaccgtcttcgtgccctcaccagagtcgttccaccgcgtcctcaggctgcggcgtcccaataacaacgttgccgatgggtgggtctcacattttccttctatttcacttacatgtgggactcacatattattttattcctattttgctaactaggatgccacgttagtgaaaccaagacatctatactgccataggacataaattgaacggttttgtatatttggggtgaagatttctggtattgaggataagggatggcaaacaaactcggtgtaaagttgagggacatcagatgaacttattccaactataaggcaacgcatcacggtgcatggcccatgggctgcgcattctggcccacaaagcagcacacgcaccagtaaaccctagcctccaggagctcacccgtataaagtcgcagaccttctccttcccctccccgccgccactcgccgcagcgtgtcgaccagacaaggcagcgcctccgaaaccctagctccccgccttcccctccgcggccgccaaaatggtacgcttcttcctcctccccgtccgcctctctccgccgcacgacggcaagatcatgcgctcgtgtgtcctcgtgccagtccacggcaccctgctctggtcgatttgtagggggattgcgttctttattcatgttgatctgctgtagatgggggcgatcttgagccggaggagtagctagtttcttattgatgcggtttcggggtttttagagatttaacacggtttcgcggtttctctttagcgatttcttttttcatgttgatataatgatatccacggtggttgttctagttatgtcatttttatcttgagtgctttgtgtgattgtttttcaattgtgggtagagaccagattattgtcgttaagatgcatgctctgaaacgcggaatttttttgtaatgggttatatctagattatgtgtattgctgtcattcaatagtcttttcttaatacaaggcgcaaccgtcttttcttcaagtaccagtatacaaggcggcaactgctcaactccgtacttggtgcatgcaagcattgaatggatggttgcatgagctcatgatattcggttcattagtttaaaggcaaaggatccaccactcggatgcttgcatgcacgcgcaaaaactgcaggacacgggtgcatgctgctttggcactagatgcgatgaactgatcaaagcgtcacgcattggaacgcgctggaataaatcggtacgatgggtagttataggttttcttgttctccgagtccaaacaagttatgccttgtattaaggaatggagggagtagcaattaacttctggagtaaacatttttcatcatcttccttgaggacgtgggatgaattcttttttttatcttgtgcgaaaattgtttggtaatcatgtctggttttgactgatgggctccgatgatggcatgaaatctttgagacctgacattcttgtgatgacaaacataagcatatttcctgaggacccaattgaggttttaaccattggtctgctgaatttgtctttgctgtcgaaaaatatcgattcacatgtgcttctgattatgcacatttgattgtgttgtttataggcctgctatgtgctttccaataaccagtatttgttaaatttgtttcatatttcttatgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtattgtgacagtttatatgtgattacgcagtgctgtgtgtgattgtctctcttcattagaaacatatggtgtcatgatttgtgtctgttcaatgcaaacatgtggcaataaccatcatgtagttttaatgtatctgactttcagctgtgcatttttcatgttatgatacatggttcctgttttcaggcaaaaaccaccaagaagattgtgctgaagctgcaatgccaaagctgcaagcattactcccagcaccccatcaaggtattatttcattgtcaagactcaagctgaaaattgtcatgaatcaatcagtatctttttagatgtgttgggtgctatcttacattattattctttacagaggtgcaagcatttcgagattggtggagacaagaagggcaagggaacatctcttttctaaactacctactggatactgaagttgtgggtctattgtgcttcatacttcaatgttattaggaacttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggcagttttatctccctaagtcctcagtgtctgtttttcgttatcttacccgagtttgcaatcctagagcgacccacgtaaacgaattcctgtgacatgaatccctgagaggctagtctgatgaacttccgtttttcagatcgaatttcgtatatggttaactatactatgttttgttcaatatcttcgtaacgagatggaaggtatggaatactatggatggaggtgaattgaaagataggccttggtcttgtgattgttatcttagaaggtcgatactaatgtttggtcttgtggcgttagtgaaactgttttcgtagcaatgtttggtcttgtgatgttattgaactgttttcgtagcattgtattacttgttccattcttcatgcatgatttggataggttattgacaattgtttatagtaatgaattaaatattacactcctaaattattataaaccgaataaatagcttaaagcgagccaggcaatgctgatgtagaaaatttctagtttgagaaccgtggtatgcatatcccgaagttcataagctgaaaagattgcaccctaaatctaatgtattgtagttttcctgtactgaaaatgctgttggatcggacagccgtggtgattggttgcgttcattttcaagttgtagccaagttaaataaagtatagaaggatatgcaagtagcaacatcggaggagtgccatcgcagtgatcctcccaaaaagcacgaaagaaacatcttcattggaacctaagcagctctggccttttgagcccagaaaagctatccttgattcaagcacaaaccgtcatttggttatatgctttctccaaatactagcatgagtaaattgcattggcggtacacgaacttgctaggtggaagcaatctagtacataaacttataaaacgctcattttgatacacgaacttgttaggtgcatgtgaatcaaggccaaaagaaaaaacaaagctaatcttattttagtgttaattaggatactacataaacacatgtgtgagaaaaatgctaagtacatatacatttgttcaataaaaaggggttaataaggcctaaagattgtatggagaaagacacaaaaatactgagaaatagtgcaaggggtagaacaaagaataataaagcacaaatgcatgtctcatgtccacctccatatgcacatctcgtcctaatcagtgtataacttagtaaaattgattatgatgtgtcattttgaccttgtttcacatgcatcgaacaaattcatgtaccgaaacaagtcttttacaagttcgtgtagtaaagtgcatccatctggcaatttactctactagcatttgaagctaaaaggctttggccttttggagcccagaaaagctgttcttgattccagaacagatcgtcatttttggggtatatgcctcctccagaatcctaaaattctcatttcatgtaaggaaaatcgcaagtgtccaacgctgaatccatcccagagatctcagtgagcaaattgcacagcgccagttgggactattcaaggattttcagggccatgccctgtacccatcatccatcacccagcaacaaaacaagccggaccgtagtgtgtcaagcatgcactgcttctgctctccgatctaaccggtagcccccaactcattctgaaccacaccttgtgttttggaccacatcacaaaattcagaagcagcagcagcagcagcaaagggtcaagcaaaaaatctaacagctttatttaggcagatccacctctctacatcatcatagtcatagtacaagaactcgacgaattcagaagaaacattggcagctacacctagagaaagaaaaatgaaaagaaaagaagatctaatatattacaagggatccttggatatatgctcatagcattgttacatcccgagcaccgagtcgcgacttgtggcgaaaacgggtgccatttccatgcttatgccattactgcttcgcctgaaaaaatgagatgttttttttttggttagagattcagacttatgttcatgaattggctcttttgtgaaaaatgtgatttggtaaaacatgtgcggaaaatctacctgagagtagatgaaagttccgagaatcgcaatggcggctccgagggcgttgatgggctggaccggcgtgtggaagatgatgatggaggcgacaatgacggagatccgcttcatggtgttgccgatgctgaatgtcagtggtgagatctcgtccaatgacatgtaggacacttggttgtacaagtggtagaacacactctgcgccgccacccacctacaaaaccacagagaaatccatggccacatgaatcagctggattatcacacaaaaatatcatcaaatcttttgatacttcttatttctctttcagaatgaactgaagaagatattgccgcttaggaggaaatgatagtgataggacgatcctatatctatattaattgataatggttctttttgtatagaatacttgagtgatgttactgaaagtacaaagtgttgcatgctgaaactgtttgaaagcttaggtcaagcacttatcactagaaattttttgcccaattgatacccaaaaatctcaactgacgtgatggttgtgacagtgaaacggtgagaagtggtacaaagaaaagcatgtgaggctcaccagacgaagtttggaccgatctcggcgacggctttttgccagccggcagcccacaccttgggcccctccatggcgaaggcgaaagggaggaggatgaccagcgagagcatggagaggcaggcgtagtagttcatcccgctcaccgacttgcccttcatccccttcttggagaatatgttccggaacacgaatgccaggttcgagatcatcgcccccatgaatcctgcatcgaattttcagcaatacacgatgaacagattgatgtgatgtgtcaggtttatgaacaaattgtgcactttttcgtggctggtgtatatttctttatctgacataagaaaacatatctttggttaatggacagttcttgttctgaagaattcttggagataatatctatttttttaatcaaaaagtgaggatatttctggtgtatctgctgcaagtatctccaggatttcaggtggagagacagagagatgcagagtgtttgctcactcaccaatcatgttgaaattgagctcggtgatggcggcgagggcgcatccgccgatgattgggaggagggagaagtagaccggcgccgggaagtgctcgccgaggaagaacctggagacgagcacgctgaacgccggctcgccgctcttgatgatgtgggtgaacgacaccgccaccttcgccatgctcaccgtcgccgccacgtgcccgatggtgtgcgcgatcgccacctgctcgtcccacaacgagcaaaaacgaatccccaaatccaacgaacgcgtcagagattcagaatagaacagaatcaagaaggaggagacgatggtgtccatggtcaatgcgatctcaccggagacagggccttccagaaatcgaggtcggtggcgggcgcctcggcgatcctggtggcccaggaggcgagcatgatggcggagccggcggcgagggagagcgtggacgtgagccacgggtaagggaacgcgttgagcaccttcttgttgtagatgttgaagatcacgttcagcgcccaccacgtcgcgaagtagaccccgatcttggcccgcctcgccgcctcctccggcgccgcgcccgccggtgcagcctccaccggccgggcgccgtcggcggtggcggacggcggcggcggcgccggtgacgcgacgcgcgacgccaggaataacgggtcctgctgccggtacagggggcgcgccgagagggagaggggacgtggcccggcggcggcggcggcggcggcgaagaggggagggaggtggaggggcttgaataatgccatcttgggcgccgtggcggtcccggccgtggagagcttgacggaggcggcggcggcgagcatattggcggcgggaatggtggcgccggcttcttcagttacagttactgtgttgtgttgtagccggccgtccgtacgtctatggcggcgatgggttgcggccatagagaccgctcgcatcgagtcttcttcaatccgactataacaaattgctagctagttccacgccctccaacgcccttttagggaaggaagcctcaaaggagggagggccgccgaacaatgtggttgaggacaatccaaggaaaagggtggagacgaagagggagctggacaaaagataagtggtagaggggggaatcctacagctagaagaacatcaaccgcgtcaacagggaaggctgcaagaatagtagccattcaagccaaagaaaaccgtaggcactaacataaaagacctgacctaatccatcaatcaaggagcatgctaaaaggagatctagagagagggagaggcactggcaaatcctaattgatggatcagagccaagcatgttatggcaaggagctcgttggctagctcaagggcgcctcaaagaggagggaggaggagggatggggatggaagaaggtgttgggcaaggtcaccagtcccgcggggagaggggggtccgaggccagagcctgccaccggtgccacggattcgaccagatccagccgctaggagcgcagatctgcacgccaccagtcgggggcgccgggcctagccttcatcgccggctgaggggggggggactataaggagccaagccgaggcccatcaccgccctcacggacgacacgtcgccagacagcaccgctggcgactgccctccgcggccaaggagcacgaccgctccttcgccgggaacagcacaccgtcgccgggacacacgccgccgcaccgcctccaccacgccccatcgcgccaccgcgcacggcattgttgctctcctccggccaggtccaaaagcagggtgcatttttcatgttatgatacatggttcctgttttcaggcaaaaaccaccaagaagattgtgctgaagctgcaatgccaaagctgcaagcattactcccagcaccccatcaaggtatttttgcaatgtgaagattcaagctgaaaattctcatgaatcagtatctttttagatgtgttggatgctcacttacataattattctgtgcagaggtgcaagcattttaaaattggtggagacaagaagggcaagggaacgtctcttttctaaactacctactggatactgaagttgtgggtctactgtgcttcatacttcaatgttattaggagcttaatttaagcagaccatatcatgtattcaagtactctagcaaggattggctttctgctgaatcaagttttgttgcttaatgctcattgaatccaatgtgatgcatgtgtttatgttgcactgcaattttgtcttatggcagttttatctccctaagtactcggtgtctgtttttcgttatcttacctatgtttgcaatcctagagcgacccacttaaacgaattcctgtgacatgaatccctgagaggttagtctgatgaacttccatttttcagactgaatttcgtatatggttaactatactatgttttgttcaatatcttcgtcacgagatagaaggtatggaataccatggatggaggtgaattgtaagataggccttggtcttgtgattgttatcttagaaggtcgatactaatgtttggtcttgtggcgttagtgaaactgttttcgtagcaatgtttggtcttgtgatgttagtgaactgttttcgtagcattgtagtacttgttccattcttcatgcatgatttggataggttattgacaattgtttatagtaatgaattaaatattacactcctaaatctattatataattaaaggaatagaaaaaagagcctccacgtttactctcatggcttagaaattctcacattaatcggagaaaaaaaaacagagtccatatagaaatacaatttagaaatagctgaaattcggaattaaaaaataaggaatattagaagagaagactagagttcatatagaaatacactttagaaatagttgaaatttggaattaaaaaataaggaatattagaagaggagtatagagtccatatagaaatacaattaggaaataatagaaattcggaattaaaaataaagaatattagaagtagagtatagagtccatatagaaatacaattaggaaataatagaaattctgaattaaaaataaggaatattagaagtagagtataaagtccatatagaaatacaattaagaaaaaatagaaattcagaattaaaaaataagaaatattagaagtagagtatagagtccatataggaatttaaaactaactaaaattcggaaaaaaaaaaaggagcctctacgttcgctcccatggcctagaaattctcacattaatcgaagaaaaagaaaaaaacagacttcatatagaaatacaatttagaaatagctgaaattcagaattaaaaataaggaaaattagaagaggagactagagtagttattacacattagtagttttgaaaagttattgcaaaatttaaaattatgttgtcattgtaatatattataataatataatgagaaaacatatatgctattatatgagagaaaatataatgatgctagccgcgcaatatgcgcaggccaccatgctagttattataaaccgaataaatagcttagaacgagccaggcaatgctgatgtagaaaatttctagtttgagaacagtggtatgcatatcccgaagttcataagctgaaaagattgcaccctaaatctaatgtattgtaattttcctgtactgaaaatgctgagggggggactacaaggagccaagccgaggcccgtcaccgccctcacggacgacacgtcgccagacagcaccgctagcgactgccctccgcggccaaggagcacgaccgctccttcgccgggaacagcacaccgtcgccgggacacacgccgccgcaccgcctccaccacgccccatcgcgccaccgcgcacggcattgttgctctcctccggccaggtccaaaagcagggtgccagatccagccacgggggcgccagatccgaagcttcgcgccgcgctgatgtcagcccccacctatcacgcgccgcgtcatcatcctcacgctgagccgtcgcgtcgccgaggaatggcctcgccgccgccctcacagttggccgcgcggaactccggtggcgcgctccggcggcggcgaggggggagaggaagggagggggcggcgggggctagggttcaccccctgtgccgctcgcgtgagagggcgacgcgggggtcgtgccggcttcgtactcttccaattgaggataagatgaactgatgtgataagtagtacgggattgtacttattttaaaacaaaatttgaatataaaatcatacttattttagaaggattgtagtatttggacttgggagtaattttactgttcttggtattagaaggtaccatttcttttatataaaacttggtatttctcgaggtataaaaaacatacggttaggaccgtaacgaactgtgttagctgtaggtttgcatctgttcccaaggtgatttaatttgagcaattgcaaatagctttttcttctttcactcggcagctgaatcttgcttggtggagtactcgggccgtgcacgttcatccacgggtttgatttgacattggtcatgagcgcgttttagtggacaaagtggtggttagcatagtgaaattgtcaacgcgagaagcagaaaccaattgctgttgctgtcgccggtaccaatactgtatggtgttcctgttccatcagaattcagtcgagtgcatggcagctcattcttgtggcccatcacacaattaatctccgacgatgtactgtacgtagtggagcatttagattagtaattctcgaatacattttcgtaagggttaagtgggcatatgtaacgtgttcactccttgttactatctctgttttcagatgagtgacatcatcagcatagtccgcaatacacattttatcatcataacaattttacactataaaaaacgatttttcgtgatgttaccctatattttacgctggcgtccatatgcaaaaaccgccaaaaaaacataacaataggtggggggctacggaccaccagcagaaaccaatttttgctgataaccacgctaagagaaatgcctaaaaaaactactctatttttcgagacgaacctcttaagtgtctgccagtttttcgaggcggacctcttaagtgtccgccagcgaaaaatctcattttcaccggcagtaggtaaggaggaccactgcgaaaaatgttttgggcgaatatataaatctactgtcccccacccccaccgctcccttctcccttcccccactgcgcggcccctccgccgcctctcttccttctctctcggtttcaccttcttcctcccttctccaccgccgccggctgccgtcgcctctaccgcctctccgcggtggtggggcgtggcctcctcctctccaccgctagccgccataagctcggggccggattcggccgctgcgacgatggtggaggccggatctgccgccgcgacgacgggggaggctagatccgtcgccgcgaccgccgcagggccactagtctctaaagactaaactatatatttaaaaaaacattaccaatataactttatgaaagagagtttctcataaaaaaaaatataccaatataacttttcatattttaaatatttttacgtctattaaatttttaaggtttcaagatttgactgcacttacaggagatactactatacaagaatcaacgagaaacgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctcctcctcccctccgccgcacgacgggaagatcgcacgcgtgcttgtcctcgtgccagtccacggctccgcgcgccgtctttctcatggtgtttcacaatttgtaggatgcgttctttattcatgttgatctgccgtagatggggggatcttgagccggaggagaggagtagctagtttctttgattatgcgttttggggtctagcggattttaacatgagatggtttctctttagcgacattttttttgttcatgttgatgtccacggtgattgttctagttatgtcatttttatcttcaagacttcaatgctttgaatcgtgggtatagaccagattattgtcgtgaagatcgacgtattttccgagctgaccctctgcatgctgaaaattttgtagtgggttatatctagattatatgtgtattgttgtcatttaattagcacttaaacttctgtagtatgaacattttcatcattttcctgtgaggacatgggatgagttcctttttttttctcttgttctaaaattgttcggtaatcttgtctggctttgactaatgggctccgatgatggcatgaaatctttgagacctgacattcttgtgatgacaaacataagcatatttcctgagacccaattgaggttttaaccattggtttgctgaatgtgtcttcactgttgaaaaatttgtacacacatttgcttcaaattatgcacatttgattattgtttataggcctgcgatgtccattccacattcagtatttgttaagctgagtgcttttgtttcaaatttgttttgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgaaagcagtcaggatatggtggtcagaccaagcctgttttccacaagaaggtactgtgacagtttatatatgattatgcagtgttgtgtgtgactctctgttcattagaaacgtacggtgtcatgattgatgtagcagtgatatgtgtctgtacaatgcatgtggcaataaccatcacgtagttttaattgcatgtggctttcagctgtgcatttttcatgttatgatacatggttcctgttttcaggcaaaaaccaccaagaagatcgtgctgaagctgcaatgccaaagctgcaagcattactcccagcaccccatcaaggtattatttcattgtcaagactccagagctgaaaattatcatgaatcattattttgctggatgtgttggatgctcacttgcataattgttctctgcagaggtgcaagcatttcgagattggtggagacaagaagggcaagggaacatctcttttctaaattgcttgctacctactggatactatagttgttggtctactgtgcttcaatatttcaatgttattaggagcttatttaagcagaccatatcaatgtattcaagtatcatcgtctgacatttactctagcaaggattggctttctgctgaatcaagttttgttgcttaatgctcgttgaatccaatgtgatgcatgtgtttatattttgctgcaattttatcttacgacagttctatttaccttagtcctcagtatcccttttctttttttgttatcttacctgctgtcttttgattagtagttagcaaacatagagcgacccactttaattacttcccgtgacatgaatatgacctcgagagattagtctagtgaacttcctttttcagactgaatgttgtattgttaactgtactggcgtttggtcagtatctttcgaaagagatggaatgtagggacgtaattttattgcaagataattcatttgttcttgtggttcagtatcttggaaggtcttgtgatattagtgaattcttttcgtagcattgcagtacttgctctgtc

SEQ ID NO: 79132 - DNA, 609 bp, Oryza sativa
tagcataagttacccaaataatcataagcctcaacgtgaagcaataaatgtacggaaaattctggtctttctggcagagatccaactttgactgatactgcttcagactctttcttaaagccagagagctctacaaatcctcacgagcaagaatgaatgggctgtgtgaaaggtcctacaaaggaagcctatacatctgatgctgaagcacataccatcgccactaatggtgaagaaacttcagtggttaacaactccagtgaaggatatggagtaataaaaaagagctctgtagaagaacctaacgttacaaacttttggtctgcttcatcgacagtaaatgatgagacccttcagtcagattcgagtgaaatagttgatagaagtcagcttcttccatcttatgaatcatctgaatctaaagattcttgggaagaattagctggtggtagcaataacagttcaaataccctggcaaactttcctggtcatgtgatttctggaaaagctacttgtgattttgagcgaaacaatgtccagtcagatacactgtttgatatatcaaaggtcagacccgataaaaaggaacaagacagtgaacctttgtct

SEQ ID NO: 79133 - DNA, 609 bp, Oryza sativa
tttttcaaaattggtgatatgccactgccgtcgcgtttccatcctcccccctgccttttccgtcttctttcactgttgttcacttcggcaaggttagcgccaggagccggacgtatggcacgcggcgctcgctggcggcggcggggatctactcggcgccggcgttcttggcctacctggcggcggaggcgtcgcccgtccacccgctcgctgcgcggaacaaggcccgcgccgccgccacgctggtgcaggcatggcgcgcccgccgtcagcctcaccatggccgtgcctaccatggctcccctccccgtgcccctgcccatcgcccccatcccagtctctcctccgcgagccttacgcctgcctcggcagccgccgtcgccgtcgcctctacctccgcggcgggaggaggagggggcggcggtgaggctgaatacgaggtctccgatgaccaccgtgctgcgcgggagcgccatgagcgcgtggtgcaggagctgctccagcgccgccgcaccttcgccatggccgtgcctaccaacgacttcgccgtgcgggcgcgcctccgccgcctcggtgagcccgtcacgctcttcggtgagcgcgagatgg

SEQ ID NO: 79134 - DNA, 1064 bp, Oryza sativa
atcgtgcaacgaatactacatatgcagttcaaataaaaaatattatatttatatctagtgctgttcagattaatgccattttaaatcatatatcattttttttaaaatgtcaaatttgtgcaccatttagtttttttttaccaaactatgctaaatacataagaaatcctgctaaaacttggtaatattgctaaattgtcaaaattttgacaccgccaaaatttaaaatttggtaagatttaaattaactataatctaaacataccatttatatagaatttggaattacaagttggcttatatcaattttaatccatcttgttaaattttataaaaaaaataataataagttactccctccatttcagattataagacgttttaactttggttaaagtcaaactgcttaaagtttaactaaatttatagaaaaaaaatattttcaacccaacacaaatttattataaaaatatattcaattattgatttaataaaactaatttgatattataaatattattatatttgtgtataaatatctactgaaggagtacttggtagaccgcatgcggtactttctggtataatgaatgcacattggtccggcagctagcgatcgagctgtgctagtgctaccgctactaggaggcgactctgcgccagctgtcatggtcgacgccatgtccggcggcgtcctcgtcgcgctcatggtgttgctgctggtggctgcgcctgcgctgctctcgcggctggagccgcgccggcggccgccgcctgggcccgtggcgctgcccgtcgtgggacaccttgcaccttctggggaggccgttgcaccgcacccttgccgcggctcgcggctcgccatggcgcccgcgccgtgatgggccttcggttcggtcccggcgcgtcgccctcgtgtcgtcggcgccggcttgcgaagagtgccttggcccgaacgacctctcgttcgccgacaaagccgggcttccgtccggggagatcctgtcgtacgaatggccaccattggcaccgccagttaggttcgtactgggccacattcgccg

SEQ ID NO: 79135 - DNA, 531 bp, Oryza sativa
ggcgttgatttagcttccaggcggaggcgcgtgtcaagatttggtcaagatagggtgggtccccacccaaaagaagagtaggtagaagtggtacatgtggtatccccttgagatataaaaggaggaccttgcccacaaagaaaaggggggacgactctgagaagacttgagctgggggaggagatcgagagaaaaaagaaccagaagagaaggaaaaagaggggttctagagcttgaactctcttgctccccgactctctgtaactcttcctcacacatatccaccagaacacaggagtagggtattacgcttctcagcggcccgaacctgtctacatcgcccgtgtctcgtgcgtttgctctctcgcgtacattccacagatcgagggtgaagaacctcacttagcgcccctggccgaaccggcaaaggggggcctgcgcggtctcccggtgaggagccccacgctccgtcatctggcgcgccaggtagggggcgcgtgcgcttttctaagcccttatcctctttcgtgt

SEQ ID NO: 79136 - DNA, 1964 bp, Oryza sativa
ctatataaaatttgaattttaaaatataagaaattcaaataatttttttgggtagtaaatgatttcaaacagaaaaattgtcaaaaataaaattgtataatttatcaagatctataacttttattttggtcatttctctatatgactttgtttgaatagtttgaatttgaatttaaaaatataacaacttcaaacaacgttttcaaatactaaatgatttcaactgaaaaagtcatcaataaaaaatttatataactcatcaagatctataacttttattttggtcatttcttcatccgataaagtgatagtaacattattcataaaatttacatatatctcatttggttttataaactataagagagatgtaaattttatgaacaatattactatcactttgtcagataaagaaatgaccaaaataaaaattgtatgtcttgatgagttctacaacttttatgttcatgaccttttcaactaaatttatttactacttccaaatattatttgaagttttgaaattcaaatttttaattgataaaacaaagtcaaaaaaaatggcaaaaataatagcagtaaaaatacaataacatgatagagcatgatttagaaatacaaatacacaatagcaaaaatcatttgtgagtagtgaggggttttttattccgataaatattcttcaccgtatccgtttcgcttcgtattcgctccgtatttgtattcgattctgtttttatatccgggtttccgattccgatttcgatcctgaaaagaattatgaaaacgaatatgatagagctaatttcggaccgtattcgatctattttcatccctagcgggaaggaaccgactgatcgatcgagcgcacagggcagggggcggcaccgctcgtcgcgacgcaacgctgatccagccgccagccgtccgtccgatggatcgcacgctgccacgaggccagaacagccgaaatggacgccatctcggaggcttgaggcaatgacaatgaggcggctacagaaaagagaaacgttaacacgagacgatgatgcgatgcgcggccgggtcacgtactgagctgccaaagccatggcatagctgccaggacgatcatgcatatgcttcttggtgatgatctgtgcacgtacatggtgtgcgtagcagctggaaatgctgacttgggtgtatacatacgtacgcatgcgtacagctccctctctctctctctctccctgaggatacggccgtgtccgggattacatccgttatccacatgcatcagaattgaagcggtcaacaaaaaaataaagaagaagagagagagcgcttgtttatccgatggtaaaattcgatttatctgcttcttagaacgacgggtagatgtagatagttgtagtatctgttactaaaaaagagaggtgagaattacatgtgtcaatgtgtgtaggttctggaaccatctacagttattatttcctctctaaaaaatctacagtgttggcacgcgcggaacaccgatgaacaactaaaaagttggctaaaaaaggacgggaccacctatacatttgtcgacaaattttcttctgaaaatttgacagatgtaattatagtacaatcgtagtataattacactgtaacttgtatgtaattactctgtaacttgcatataactacagtgtaacttgtatataagttaaacgtaattttaaatcgttagatctattacaaaatttgttctggtgaggaagaaaaaaaaatcacatcacacatatatgtgaaagaatttattctcacaacctccattttatcgaaataaatgttatggagagatttttgaaagttacatacatattacattatagttacagtgtaattacatgcaagttacaatgtaattacactacgatggtactgtaattacatcagtcaaatttttggtagaaaatttgtcgacaaattaatat

SEQ ID NO: 79137 - DNA, 12932 bp, Oryza sativa
cgcgctccgcgagctcggccactgcgtctcggacggctacggcgtccgccgctccctctccggcgggcggcgcctcctcatccaggccaacttccgcgagctgtgcgccgcggtggcgaacggcggggccaggttcgccgcggcgctggggcgcagcggcgagtgcaagccgccgggcccgcacatgtgcctcctgagcgactacgggtgccacgtcgccggcgcggcggggcggcgcgcgcacgcggcgaacgcgttcctggccgggtggtacgcgtcgcggccgctggcgtccggcgccggcgccgcggcgctccggatgtgctcgcagcccacctgcgggcggccggagacgcggaagcacgagttccggcggtgctccgtgtgcagcggggtgatctactgctcccgcgcgtgccaggcgatgcactggaaggtggcgcacaagagcgcgtgcgtgccgatggcgcactggctcgtcgccgccaacgccggcgccggcaatgcggtcggggccgcggcggcggcggcggcgcagatggcgatgccgtgacccgcggcgacaccgcgtccgggagcgtgtggtggtcgtagctcgccatctccgggatgctcgcttgtgtttcctctgctccaccgtctttgcgtctttagattatcgctcattaatttactttcctgtacttagttccttgttagtgttttaagttaagccaagcctttttgagagggagagagaactagtagcaactcttatgttaatttcctttttttttagttttgagtattatgtttcttcttgtttttgtacatcggtaatcaagttttcatcaaatctacgatgaaacaaaaaccaaacaagtttttgaactccattctgagaaacgcattcaatctttgatcgaggagcagtagtaaataggatgggatggtcggttcggttcgtatcacgcaaatggggtggtaggaatcataaaagtgaaataaaaatctggaggaaacgagcgggcaagccgtgaaagaaacgatgggggtgaccgcctgcttttctggtaacgcccctacggtctgcgatgcgagtcagcgtacgaagttttttttttgtttttgggggcagtcataaattcaggcaaacaaagtgagcagctggctgctgccaagtgccaagcggttgaaaagcggcacacgggtcgtaaatatttggcctgtagcgtggagtggcacagacagacagaccgcacacggcagcagagagaggagcaagcgtacttttggcgcaggcggaagcgaagcgcctcgcgaggattcgggcggggggcctctgctgtttttcttctgcgcggaaacgggacggggcgaccgtcacgaatctgtggttctgaagtctttggtcctttttttttttttcggggaagggagaaatctttgatccttttatatttataccgtgtcaccgtcctacacttgtagcggtgaaaacgtacggaattgttgcaaatcctcgggagaaaaataaaacaaatacaaacgggacggataggttttgttcgcttaaagacaacggataatcttagtctgcgttctttgttgggagttcccaactcccctcgttttctacgcgtacgtttttcaaactactaaacagacggtgtgttttttacaaaaaatttatatacaaaagttgctaaaaaatcatattaattcatttttttaaaaaatagctagtacttaattaatcacacgttaatgcgaacatcgttttgcgtgccctccttccgaacacagcaaatatagatacaaatacaaatatttttttcctcggaacaaatacgtcggagttttcaacggataccgataataagatggatatccaccgaaggcaagaaacatgaaaatttctttcttaatttacacttcaacttagtactctctccttccaaaaatctgagatctatttctttttcatcaaaaccaagaagcaattaactcactcaacatatggcgaaaccaatgaacatgcaaccaataagtattagaatagcttcttggtttccaatcaacaatttaatttagcacatagtgactataaatatgactcagatttgtagagaaaccaaagaatgaaataggtctcagatttttggaaggagggagtacctatttagattttcttttaaagaaacacagttaaaatgtacacacttacaacgtgtgcacactcacttttattaatactcacgcacacctacacctatgaacaccttcaaaagtttgaaccggtataatattggctagaattttttcctcccatactgttctagtgcatcggcctttccttcaacaaagtggcaagaatgtgatctggctctataatttgtttgtataaaaatgagatagataatagatagtatgcccacttttaatatagaccattataatcttgacccatatattaatctgtggcttattaacatgggaatttgtaggtgtggagactaaacatgaaggcttatttttctattattttattaagttaatagattgcacttggggtaattactattcgttggagggatgagcttgggtagacatttgaaaccatgggtccaagatcgaccaagcgttttgggtgaacctgatgcaccctagagtactcgatagtaataaatacaaagcaactatataggtttgtgctgaaagtgcagttcacacctttgagtccaagtgaatgtgttttgaggattgtcgatgtcacctaagggggagggggtaggtgtttcatgcaattacaaaaactaggaacggaaattagaactaacgggacaatccgatactgctacagacagtccgacaatacacagtattggacaatccgacattagccggacaatctgatcaaacgcagaggaaaataggaagtctcacctactagagtataggcctggacaatccggtaccgagcggacggtcagacaacaccaaatgcacgacaatgtgatcacaacaagacaatccgactttgtatagagagtataaaacctatgataaggtatagcacttcgcacactagttttaaactagttgaaaacctatgacaaggtatagcactttgcacactagaaataggagatgatcaataagatataaatatgcaacaaataagatccccaaatcgttcaacatgaaagcataagtgcaaagtaaaaagctaggaggcactaatttgtttaccaaaatttggatctagccaaccctacatctccattgaggggcttcgaaaagccaaatctctttcaacccttttcctattcaagctaccacctccgatggtgccttggtctcttcaagcaaccaccacagacaagcttgtgctccaagagacccactcagtcccaagcttggactccaagcaacttccctctgatgaagcttattgtaccaagcacccaccgagatgatgctttgcttccactattatctcttctcttatggaggcgatgtatataaccttcacaaacttctcctgggcacaccacactccacttggttgaccgcaggcttccccttctcttaaaaatgctcaagttctccaacttgaaacacaagcctctctttttctctagcagcacacaagctatagcaaactcttgatatgggggagaacaactaccctaaatgtgtaagaactcactatcaaggttaaactatccttgaaaggatcttcaattagctgcttaggctattggacatgcacttggcttgctcaggtagtagagggtccaaaagtcttaaaacaactccacggcactgggtatatatagccctaacccctccaactagttgtttctagttgttgctagaagctgccaaaacctgtatggtgcaggacaatccaccataggtgttggacagtccaccatcggggtggattgtccgccaccataggtggcggacaggtcatcaccgggatggattcccgaataatccggtaccttatctgattgtttggcactactaaactcaatttgtctgcccgtctcagacaaagcttctcttggatagtctgctcgctcctggactgtctggccttcacttctccatcttctggctgactcgaatatgggcttgcccgtacaatccactccatcccaaactgaccagcctttatcttcttccttccaagccttatcccattcacttcttcttcaataaatattggtccttagcaacttgtgacttcttatggccttgaccggtccttcgacatttcaccaagcacttgctccttcaccactacatcgagtccttctcttatgcatggtccattgcgtagctaagtcttgccaaccctttactacatcatgccatcttcgatcacttatagccttgcatcacgatgagacaatattttactccctcttcatcatcatcttcttcatcgagctgatcccctactaatatatcgtttgccatcaattagccaaaagcccaaaacccactaggggcatagatgccctttcacgggcctccgaaggatataacaaccttactcttgtctagatcactataagtaagaattcgtacaaagctaagagctcttgatagtactagtcgatttctggaaagccaacccctcctaatgagcatcggatgggattttacaccctttgactctcatctctctgctgagaggaaaaaaaacctttgaactccatgcctgttttgctgtagctgtagatggtttccaggacgccacgtcgggtccgtcatgcatatctaagctatgtgaaaatgagacttttggatacaccatatcctactacattaatgcaatggaatttggagttaatacgatggacaagctctgcagtcggtgcaccgctcttttagctaacatatcatctagcagaatacactcccatctatcttgcttgtgcgagaacatcacataccctttcccgaggtgacaatgggttctcaaagtaagacacctggagtgcgggagccgtccattgctagacgccgacacacgccgccccttggaaagcaataacccacctactcatcttgactcattttagtcaaagaacacctggcaatcccctagcaacccttagtaatagcgccacatcgtccccgacggttaggcagttggccccatgctacactgcgtgggacatatggttgctccgaggagctttgtggacacaccttcgacccgaagttgattgactctaatagtcttagacattcaaccgttctcgaggtttgtaagtcatataggtggtggacccgaggacctccccgcaagacctcagatccagcctaggctggagaagcgatggtccatgacctgcagggtttttccgacttatttaagcaatctggtaatgtgaggggccccttttggccattacactattccatgttaaacaaactggccatatatacgaagggatccccttggccatgatgctaatatctctttccacaaatataaagatgtagtgtttaaaatttatttgtaaatataagatctctagagtactatttctgctagtacccttaatttgatttttatccaatcttacccctaagtaccctcacatctctttttaatgaagaatcattgccatttatatttcttcttacctatctatcgcaagaatcgtacaagtactcctgccacagcgcgcggtatcactgtcattgttatgttccatcacgcgattcatgaagttaactgtcattgttatgttccatcgcacacgatcgaacgagtgtcgtgcctaacacagaaagggatctatatacttagaacaggtacttaattagggtgctcgatcgtgattaaccgccgtgaatcagcaagccatcgagacaaaaaaaaaagcgaagcctggaatggataacaagtaaagaaatgtcaacccgcaagtagcaaacgcatttgtccaaaccatgaggttgttgcccgtcacatcacatcacacacgtagtagtagtacagcacgtgctgtcgaaacagtagtcggaaaggcattggtttgatgcctccgtgtccttttcttttagctacaagaagagatctaggtgagcttagttagcaaattaatgtatcgaattgggaagattaattagttaatcagtttcccaattagtaaggagcaaggacgtgttcatgtggtccattagccacactgacgtctggctaagctagtttacgtaaggtagcttaatttctaggggcatgcaggacatgattagttggttgcttccttcatactaatcaaacaacgagttaagttgcggcagagaagaaatgtttctgtatttaacaatcgtacgaaattttttgctcgaaaataaccaggaaagcatcactgacaattctcgaccaaattaaagtaggcctttaaagggtcacctgcaacatgtaggtcgcggttaaggtcttaaaatttctctatatatatttatgctatgaactattgatatagatatatatgtgtgtgatatataataaaacgtaggttgaggagagttcttttttcttttgtttatttaaaaaaaaatcaaagtactagcaggtgttacctagtagttgtatattataaaaaaatagataaaaaatttgtgtataaaacagactagaattacaaaagatataaccagcttaagaatagaagagctagctgttaacagaggttgagagagagagagagccatcgtgtcgccctcgcgcggaggctcagggacgaaaccctagccgccgccgcccctcctcctccctcctccctgcttcgccaccgccggagctcagtgccggcaaagccgagcgacgccctgggatggcggcggcggggtcatctccctcggctccatctcgtcctggcgcgggcgtggcgatgacggcggcgggatggcgagattgcggcgacggcgcggtggtggggctctccgcggcgacggcggtcgggctttctacggctccggcgacgggcgacggcgtcgccatatccggtcgtcccgcttccaaatctggccgaggtgaccggcgacaggctcggttgacgccggcaccgctcgggcgtaggcgggtggccggtgacgggcatctccggtgcgggttcgtcggcgacgacggcatcgggtcggtggtggctccaccggccagtggtgctctcggcggagcgcgctccagcaccggctgccgcgtggacctggccgggggcaacaggcctgctgtggtttttgccggcgacagggacggcgcttccatctccctccctcctgttcctccagatccgattctccccttcttcagtggttgttcttttggtgctcacaggcggtgtggcgcccgctcccctcttcttaggtgctcctcccttcttaggctaggctgtttccaatcgatgccgggagctccttggttcggtaggggtgacgtgtggagttggtttccggcgtcctgtcttgctggtcgtcggccgcgccgtaggtttgctatagctaggttcctgcgtgtgaggtggtctctggtcgagttgcagtgtgattgactgttgaggcggagtcggagctgcttgtcttgcaagcttggcaacgatgaccctcaacagacatctcggcaacgcaacaagggttcggaagtggagcattttgagagagcctcgggtgaaaaccttgcctagtgctatcctaggttgatgatatagacgcctgtgggcgccgtttcctccttggaggtatcgtcatgctggctctctctcccttcaggtgaaaaccgggttccgttcagaatgggcgttgacagcatttttgatgttgttcccttgttgaaggcttcgctcagaaggtttctgcaccactagaggacgtttggtggttctggagacctcgttcgcattatgttgtcaaagttgcttgcctttggtaagctcggcaacgacgacttttgtgaggtctcaatagttgctttcttctccttttctgtaaaggtttttatcggtttcccatttaattatccatgtttgttctgtttttgggtccggtttcccttattaactgggccaattctcttcttctataaattctggcaggagaaactcatgccgttggttcctcgaaaaaaaagttgttaatagaagttgtaatcttttgctttggaccatatagcattatagctagcttatttagatgttttttggtgtaagctagccagcgggtatggcttatatccattggaaataagaagtaagcgccatcaagaggtgagtaccataattaacttttaagtactagaaaatttcatatctcctcaaaactaacaactgagagtcatcaaactttacaataaaaattgttaatgtagtactataaaatcacacctagaaaaatatacatgcatatccataagatgccggtggcagatccagaaagaatagtagtaagatctgagcaaactagatagagttatagatagagttacaatcccccttctatctaaatatggtaaaacattttaatggggtcttcgtggggactctcatagtcttcacgccagtagtgggggctcgagaccttgccgctctcttgctggatccgcccttggatgtgggtttagttgacctccaaaaatttttcacgaacacccttgtaagtacattttactccctccatccacaaaaggttatacatatattcacatttgagtttttctaaataagttgtttctatttgtagtctttatacattcaagacttggttgcatgcttaggagtcatggttgcattcaagacttagttaccaataaattaaatgttttattagaacctaaggagtcatctaaatactcattggttgcatgcttgcatccactccttgattttgtaacatctaaggtgatttaatttcttattggtcttggtgttaaaagtaatatgtgtaacttttctagatggagggagtatatgtaagtccaatttacataaatggcctcactaaaatataaattgctactaatcgactctgggttaaaaagttacttcctccgtttcacaatgtaagtgctagaaagtcttacatcgtgaaagggagggagtacagatctgccacgccgtgtatacccttgtcgatgtattaacaaaaaccccaagtgcttattactccctcattttctaaatatttgacgccgttgacttttttaaacatgtttgaccgttcgtcttattcaaaaacttttgtgaaatatgtaaaactatatgtatacataaaagtatatttaccaatgaatgaaatgatatgaaaataattaataactacttaaattttttgaataagacgaactgtcaaacatgttaaaaaaggttaacagtgtcaaagatttagggatggagggagtattaaagatttaatagtagaaactttagttagcaagttgttgagagatcatctatcgatggttcaaaccagtacgtcaatgatgaagcaggcatgcatgctcaaatttttacattttggtcctttctgaaaacttattttacaaatagtcccctagaaaaacttaacccgggaattatcctttttggagcgctagagaggctagtgccgtggtccaacatggcggcgccgcgcccgtgccactgtggcactagggctatcgtggccgtgctgactgggcagaggggggggtgctagccactctggcaccgcccccccatacgacggtgccagcctggctggcgtacccctcctggaagggccgcgcccttaaaccccgtcggccctaccacctttctcctccccacagccatttgcgccaagtcccagcccgagcagcagtagttcttctcccttactctctccccctcacctctgcacctcaaatccactcaatttgaagccgtttttttgcgggattttttgtggaaatcgaagagaaaggtagactcatccattcccccctcttttttttttcatttttatcgattgaatttgtagatcggagggtaaccctagaacccctttcttgcccaaatttgtgatttttagcatatgttcttgggattagcttgttgtagtgctgtatgtgtgcaatgtactcattgctgagttggtacgggaagacttggaggggcaaggagagaagaagagacctttgtttgaaaatgatttatgggaggcaggaccatcaaatagacattgcggtagtgatgatgtggacgaagcgagggagatgaaaagggagttagtacaagaggggcttgatctaagtgaacatttgtcggagagtgtacattggtcgtcgtatggaggcaaccctgaatacccggcgcaagtagcaggccaatatgtgaatccagatgattactttgttgtcgaattgagtggtggtcacgattctgtttcagtagaagtcaatagggaggaggttgatgaggaggcaagtgttgagaaatatgatgttgaatttgctaaagactattatgatgaccgtccattccctccactaattaacaatgacaagttagcattagaggaatgtcgtgcgtttcagaaggtgtttgggagaaagccgaacattcatgagtttagggacctaacacatacccatggtgcaatactagatggcggaatcaacttagatcagttgttagaaccattccaggtggatggtctcaaaaaggatttagagttcccatccatggtaacattgaagctatggctccaggagtacgccatcgtgcaccatcgtccataccgtgttgtcaattctactacaaataggaggtatatgttaaatgtgaaaacccacggtgcaaatggaaggtccatgcaactaagaggtctagtggcacgtggaggatatcacgggttggtaaggcacatagttgtgctactgccgaaggttcagggagacaccggcagctgacatctaagttcatagcaactaggttatgcaatgccataaaattgcaacctacactctgtgcttctgcattagctttgtatatatttgaggttttccagtatagggtgaagtatggcaaggcttggagcgcacgagaggaggctatgaagctcatttatggagaatggggtgaagcgtacgtccgtttgcccactttgctacaagccattaagcagagaaatcctagtatggtctaccacatcgatactcatcctgataggtttgtcaacattggaggagtgaccaagaaaatttttatgcgtgcattctgatgctttggtccttccattgaggcttttaagcattgcaggcctgtactagctatagatgcaaccttcctaactgggaaatacagcggtgccttgatgactgcatatcggctgatgcggaggaccaacttatacctttagcttttgccttagtggagaaagtgaattcacgagactggtgctggtctatcgatcttgtccgacgggttgtggttgggccgcacagggaggttgtattatctcagatcggcatgctggtataatgaatgccatgaggactcctgttccaggattgccaccagttcaccaccgatggtgcatgaggcacttcagtgctaatttccacaaggccggtgtggacaagcatcagacagaagagctcctaaggatatgtcagattgatgagaagtggatatttgagagggatgttgaggcactaagacagcgtattcctgaaggtcctcgtatatggcttgaatatgagttgctggacaaggataagtggtctcgtgcatacgatagaaacggctaccggtggggttacatgacaatcaacatggccgaacagttcaatagcgtgctagttggtgttcgtaagcttccagtgacggccatagtatcatttaccttcatgaagtgcaatgattactttgtgaacagacatgatgaagcagtgaagcgagtccagtcaggggagcgttggtccgccaaggtagctagtaagatgaaggtgcaaaaaagcaaggcgaacaaacacacttcaaggtgtttcgataagtagaaaaagacatacgaggtcacagagaggggtggtataacatgtgatggtgttagattcggcgcaagagccttcaaagttgaagttaaggggaactcatgttcttgccaaaggccattgctctaccatatgccttgctctcatctcatccacgtttatctgattcatgtaattgatgagaaatcttccaaccgaatgccgtatcagttctcttcaagagccgttgtgaacacatgggcaagtcgctttgagccatacctcgaccccacacagtggccaccatacgatggtgaagaatttgttgctaacccagatttgaaggttaaaacaagagggcagaggagatcgaagcgattcaagaacgaaatggactcgggtgttggtggttctagaaggaaactgccttcaggtgttcaacttgatgctgcgccggtgcaaaatagatgctggttatgtcaccaggagggtcacaagaaacctaagtgtcttaagcgtccaaaaaagaagaagtccaaaaaaatagtgttagggaggtaaatcttttgttttcctatttaagtcaatgcatgttttattcttgtctatttagtgtctatttatttattttggattctcgcattcattttctttaaagttatgtcatgcaattcttggtaactaacggtgaatttattcatttttcatgtaggatggccgaggaggaacaaccgccgacttacccagccttggaggagtactacgaggcctgtcatcgcagggctgcgatcgaggcgggaagggtatgaatcggcatcgattcacttatacctaagtattagtagtgtgtgtttgacattatattaactaattgatttacaattgctaatgcatgtacttcaaccgctccgagttagagctcatgcccccctcc

SEQ ID NO: 79138 - DNA, 6881 bp, Oryza sativa
  unsure (1)..(6881): unsure at all n locations
tcctatatgtacagagagtccgtgaatgatctgaacaatctacttggagccacctatgctgctgttttcttccttggagcagcaaatttgctcacacttttgcctgtggtgtcagttgagaggacagtcttttaccgtgaaaaggcagcagggatgtactctccactgtcttatgcgtttgcacaagtaagttctgaacacccttacaagatatgcttatgcatttaccgatgtacgatgaacaaggtatatatgagccttcctccagctagaacctcccaattcaaagcaggccaaaaagaatgtttttttttttttgaaatgatgccaaaaagaatgttaagcagcagaggacaagtcgcttcccttctcgtatttgacatagtaggataaggaggcatgttgaaagaatgtcataaggagacatttaagagattggatttgattgtctgtcatcacaaatgcatttgcgttggccctaaatatatgtgtacatcagcataatctggattgtgaggaaaaactcccaatagtctgatttcaagagtagaaggggctcggtatccggattcatagtttagggtgggtggtggactttagtgatattcaacacagctagtattcacacctctggtttttgtagctggaccttttatttaggcgaacttttagagtatgcgcaggatgcatttcattgtttacatgtcaactgaagtcttaaaaataccaaaatatctactgaagcttctcccaaaaactgaatgatgtgcacagggatttgtcgagttctgctacagtgcagttcaaggtgttctttacactatcctcatctattccatgattggctatgagtggaaggcggacaagttcttctacttcctgttctttatgattgcggccttcgcctacttcacattgtttagcatgatgctggttgcgtgcactgcttcggaaatgcttgcggccgttcttgtttcatttgtgctctcctcgtggaacaattttgccggattcattataccccgtccagtaagtgctttcaataagaagtgatgctatcggacttacattatctaggctctcagcttgtcatacatctctgaaatattttctcttgcagctgattcctgtttggtggagatggttctattgggccaacccggtctcctggaccatctatggagtgattgcgtcgcagtttgcggacagcgaccgtgttgtcaccgttcctggccaatctaccaccatggtggtgaaggatttcttggagaagaacatgggctttaagcacgacttcctcggctacgttgtgctggctcatttcggctacgtcatcatcttcttcttcctctttggatacggcatcaagtgcttgaacttccagaaacggtaggaggccggtgtccagcaggatgtcaatccgaggtcacgtttttggagtgtaaagcaaatgtagcaacttaataccgatgctttttttgtgtagatatatagtctgttcgatatctgctagcttgtattgacacttaatgtacaacattatttactcaaatgttctgagtttatggtatattattctttttctatgttatcgccatcttgccattttgctttccttattccttgtgaagttctgcatgatccactaacaaccggatatattggtacacttggaagttgtcccgctttgccatgcctgttgtataaactgagaattgtacttgaaatttcgcaagaagatatatgtctattacataaagtgttttttattttgtaactcttttgattggtatttgagaagtgggaagcaaacaaagtgtgcatgcactcgagttgtaaaaatccaccaactccctaaggtttgaagtgtgcaggtcatcaggctaagaaagtgtgactagacatgactaaacctttgcatgtctaggttagacacgaaccaaatggccattgtattttttttttgaaaaaaaaaagacctttgtattgtatgttagcgacaacagtagggaacctctgtagcttattacaatttagatacctgttcatcagccatggatggatggattatcaacaggagtcccacaaggattgagtagcctaatttaactgaagcaagacactgtacatggtgccaaatgaggaattgttgttttgcatttggcctaaggccttttttttaatgaaatacgaatgaaagctgatggggatggataagttaaaatattatatattacgaatttagcaaataacttgggaaaaggtgatgaagatttacttttgaaaacttggcacgagtaattcggttaataatccggtggttatcagctagaaaaaggaaagggagggtgtatagttgaatgccaaactttaccgcaccaaagttggccaagtttaagggcctgtttggatggttgctgcactttgccaaacttttgagtcaaaagtgtggcatgttgtagtatttgcagtaccaaaatagttggccgtacttgtggcatattttggctaggagatgaatttatgccatgtgagatataaaagaggtaaagtttggtacaacacaagtgtaacatgtaaccaaacaaccacatcgaaaagttaatcttggttaacttttaggtgcgctaaagtttgccattcagctgaacaccctttaactttttgaggtgattgtttagttacatgacacatttgtgttgtgccaaattttactacttttatacctcacatggcataaactcatcttctagccaaaatataccatacttttggctcaaaagtttaacaaagtgcagcaactatcaaaaaaggcccagtactccggtactccctagtccctactttggcctagatgagtaagcaacgtgctctgctaagaaataagtttgcactgtcacgttctaaatcttaccaaattattgcaagccaaaatccaaacatatttggtaaagctgctaacgtgctttcggctatccctaccaaaaacgaatgccaaaatctccccaacgaaccaaacgaaatatgtgattaccaaatgtaggtacttaaagaaaacgtggactcgaaataaaactaggatgcaatcatgagaaattctcctagcaattttgtgcagaaaccatttgaggacatgtgcccatttttaggatcccagatcgctgaacaagtggagaaaagttcgagagatcaacatttccagtttccacattcgtccttccgcttacgccgatcacaaaccataacggtttaccaagaacttaaaaacaattaaaaaaagcttttacatatacattattagcaatttaaaaacaaatattacaaaaataaactaaggtaaaaaaaaccttaaaaaaacttagaattaaatctaatgttaattttaaaatccttaatacaccttaaaatcaccttctttttcctctaaggcccctttcgacatagcaactggtgaagattgagtacaggaacgcaaaatgagaaaatcattagtgatgattaattaagttatactaattgtttcaaacttgaaaatagatttatatgatgttttaaatcaacttttacatactccctccgtcccaaaataagtgcagttttgcactattcatgttcaacgtttgaccgtccgtcttatttgaaaaatttttatgattagtatttttattgctattagatgataaaacatgaataatactttatgtgtgactaaatgtttttaattttttcataaatttttcaaataaaacggacggtcaaacgttgaacatgaatagtgcaaaactgcacttattttgggacggaggtagtagaaagtttccgcgcgatatacaaattagtagcgtaaaaagcgtgctaatagaaactaaagataaaatccgtattttaatccaccaatccgaaatgattagagacgccaaaaggcccactttactgtagtgacccacgagtgctccatttcctttccttcagtgtctcagtcagtggatcactgtgtcagcacaggcagaggctttgctcttgctccggtccaagccaaggtgggcgccccgcaagatatcttcttcttccccaaatcgaggacccgattgcggcagctccggtggccggagcagctccctggtcgacgcgtcgccgtctccgtcccggtcgctgccggattccgcgcgcgtgggcgtccatcggatggcaattggcaagcgctaagacaaatcccttgattttttttaatccgttggacaggcggcaagatgattaattagcatgtttgtttgtgtcttcgatgatatctttccctattcaatttttgttgttgcagggtacccgcgctcgccgtttcatccggtgagcatttcgtcgagcagttggtaggcggggggagttcggggtttcttgattcatggggaggagctttgccgttgatttcctgcgctgaagcagttcatcgtccagtttcttgggcaatcgtttctagggaagcaaatgagatgtctctgctgctagacgcgagctctgttcctcgtttttaccattctcagaacttgacgattgagcatggcagattagggtcgtagagaaaacggtgttcgtgtcagcttcttgaggtcagagagccaagaagccatttgggtttttcttggttcatggaggaaatgggctctgctcagctttctgccctagctgtgtgtgtctgcattttcggatgcctagccatggctgatggccagaacgtcactggaggtgatggttcaaggccagctgagctgcgcatcggtgcattattcacatttgattcggttatcggtagagcagtgatgccggctattgagcttgctgttgcagatgtcaatgccgatccaggtgttcttcctgggacaaagttgagcgttataacgcaggataccaattgcagtggctttcttggaaccatggaaggttagggcttccttcttttccatcaatttttcttttatggaattgtccttaccaatttagttgtaatttacacattattctctcgctttcattgtgcatttgcaattagcatatttcccttttatcctcnnnnnnnnnnnnnnnnnnnnnnnnnnnncagttgaaaaccccaatcagtattgtttttaagtttgtggaggtttcctgtcaggattcttaatctaatccagattcagtttaacttcaggttgcaaagtcgtagagccatgctaaggtagctctacttccatgatatcatgggatgtgtgcaaattgaagccctaatgaatatctatgatctataaagaatacctagaaatcagaactttcctgtctttattttttcttcacagaacttcgcttttgtttattctcactaaacgtaagttgtcataagttatatttatcttgcactgaaagcttgtatatatgagattaacaacgattcttcctgtgcagcgttggagcttctggctaaggatgtagtcgctgtattaggtccacaatcttcaagcattgctcatgtcatttctcatgctgttaatgagttccatgttccgcttgtctccttcgcggcatctgatcctaccctttcttcccttgaatatccttactttgtgagggctacaacaagtgattatttccaaatgagtgctatagctagcatcatcaatcaatatcgatggagagaagtcattgccatctatgttgatgacgactatggtagaggtggcatcacagcattaggtgatgctctagcaaaaaagaagtctaagatagcctacaaagccaaattgccacctggtgcttcaaggactaccatcgaggatatgttgatgcatgtgaatgaaatgcagtctcgcgtctatgttgtccatgtaaaccctgactctggcctggcagtttttgctgctgcaaaatctttgggaatgatgagtactggctatgcatggatagcaacagactggctctctgcagtgttagattcatctgatcatattagcactgacagaatggaacttactcagggggttattatgcttcggcaacatgtttctgattctggcattcagcattcgttggtttcaagatggaacaatctgaccaggaatggaggtcattcaagctttagttcttacagtatgcgtacttatgattctgtatggttagttgctcgtgctgttgaagattttttgagtgaggggaatgcggtatctttttctgctgatccaaatttgcaagatataaaaggaagtaaccttcagttagattccctcagaagtttgaacaatggagaaagattactggagaaagtttggcacacaaatttcacaggggtttctggcctggtacaatttactgcagaacgagatctgatccacccagcttttgatatcttgaatattggtggtacaggtttcagaaccattgggtattggtcaaacatttctgatctttcagttgttgctccagaaaagttgcattcagaaccactggactcttcaacaaacaatatagagcttcatggtgttatctggcctggtcagacgtctgagaaacctcgtggctgggtgtttccatatcacgggaagccgttgaggattggggttcctctccgcacgagctacaaagagtttgtgatgccagataaaggacctgatggagtaaaggggttttcagttgatgttttcaaagctgcagtaggcttgttgccctaccccgtttcattcgattttattttatttggagatggtttgaagaatcccagctacaatgaccttattgagaaggtttctgacaacgtgaggaacatcccatatcataaaattctagatgttattgcagtttagtgtcttcacttgtactatatttacttatttctgtttctgtaccactcagcactttga

SEQ ID NO: 79139 - DNA, 16697 bp, Oryza sativa
ccaaaagtctcaaagctgagagcggagcacacagattcctttttccaggaatatgcaggaggcagtgtgctgttgtcccagtatggcacggatcaaatttatccatcttttttttcacctttactttttactgaaatttatacacatacccttttgaagcagagttgcatacccattttctttttttggttgctatacaacggaatctccttcagacgtgatgataccgattagttatcaagtcctaatacctaatcggtatcgggtgatacatatcaagtatcatacgattctaccacgtattaggtgatacttggttattcctattaggtatacgattcttaccacatagaaggtgatacttacgagatattaggtgatacctattaggtatcatgcgattcttatcacgtagaaggctatacttgcgagatatcaggtgatacctatgaagtatcaggcgatacctactagataataggtgatttctactgggtatcagaagctggacatacctgacgccgacgccgacgaccactaccgcccttcctccccttggctctagccaccaccgccgctccctttcctggctccggctaccaccgctgcccctccctcctctagctcttgccaccgtcaccactgcgttccttagcttcggccaccgacgcccctcgtctcttcgttgatgtatcccccgccgccggcttggccgcgacgcgccgctgcctcgacgcgacacagatggggtcctcgacaccacggcagctcaccacaaggggctcgtcgccggcggcctcgtcctcttctcgccgagcaggtcctcttccccagcccgcgccgaaggtcctcgccaataagcggcaaccacctcctcctcatggctcaggcgttcagctctcgcttctctttggataggcaaggaggacaaaggatcccgtcccaactggatcccggtgcgtagcatttccgtttctttttttcacattttttatgggtgtctatttcacatggtaattagacagctaattccaagcttaaaacctggcttaatgctactgctttttatcctaggaatctattttgatttctcaagaggatgtcttctcgtaagcttaaaaaccattcaaatggttataaaaaaaattctaaaaaaattaacaacactcatacaatttacttcctccgttcaaaaaaaaccaacggatgtgaccccctcctaatacagtaaatctaaacagcacttaatccaaatttgttatattaggagatgtcacatccttttaggttgtttttttggtgacggattttttttttacggagggatggagtatatctcacacagctctagcacgtactcctatctcacacagatttatcacaaatcatacacttttttttaatatcttctacactgcactttatgaatatctcatgtcctgtcttccacaggaaaaaaagtgaaatagtgaaaagattcagaattaggaagcatctaatcacctaacttgacagcaatcagtttcaagtggccaagtgccaaacagtttcaagattacttacaacttatccgttccctccatatatctctctcccctcttctccacctctcgctactccaccatccaacgtgcgagaagccatggcatccatcccgtgcaccttccagctgagcgcgagggcgtcgtcggcgtcggcggcggcggcggcgaggaggtcgccgcgggcggcggcgaggctggggtggctgcggccgtcgcggctgagcgcggtggtgccggcgagcgagagcgggagggtggggccgacgtgcttcttcaagttcgggaacaaggacgccgagggcgccggcatctacggcagccagggcagggacgacttcgaccgcgacgacgtcgagcaggtgagccagcttctcgttcttcctcctccccatgttgccttaggtgttccttgattgctccagtccatggggaatgtgctgacgaatgactgagatgctaccttaccactgctatattacttggtggattggtaattctgatcctaatgtgagacatacgaagtagttgattgctatacttgctagtttggtttgaggacaaatgatgcagcatttgatttgagttgaattaaggcatgtctttttccttatgcttatacttatcaaccaacatttgaattttaaatttggagttgatttagaggttttttcattgaagtatatttttcagcatttgcttttaaatctctaagaatatacatataaaagttttatttacaaattactttttatttgcaaatattccgtttcgcttgcttcgcttattccgcgaataagcaaaacgatggctcgtatcatagccagcagtagcaaagaggaagagaagaaaagaaaaaaacaacaatcacctcgcaatttagtctttgtagtttcatggacaaaatgcaaattgcagctgcagggtatctgaaattctgaatatgctaatcaagaattcaagatagctgtagactagcacattcagattgaagaacagcacctgaacatggaaagctctagtgacaagaaagattcagaatagtaactttgattcctgagatgagattctgaatgtatctgaatctttctgtctgcgcttgtagtacttcaactacatggggatgctggcggtggagggcacctacgacaagatggaggcgctgctgaaccaggacatccacccggtggacatcctcctcatgctcgccgcctccgagggcgacaagcccaagctcgaggagctcctccgcgccggcgccaagtacgacgtcaaggacgtcgacggccggacggcgctcgaccgcgccgccgacgacaccagggagttcatcctcggcttcgccgccaccttggccgcctgatcgatcgcttcgccgacgacgacgaccttgatgcctggatatgtttcggctatactagtatactacgtatttatcttttcttatttttttctttttcaagtttctccaagtttttcttgtgtttggtagagtttagccgggaaattcacaagttgtttacagttcaagaggaagtagcttcatctgtatctttcactttcttcgctgtgtgaggctatgctttgtagaaattgttgttacaagtagtatcttccactgtttcaatatgaaagtaagaagaagctttggatgcatgatactattggaattggaagctttgatgttcacataataacatgttaagatgccaaatcctaacagcaagcaatagcatgaacttcaagcaaagcattactgcaacagcaagcaaaacttcatcctttattgtctcagattaactgctatgtccatgttgccgtcagtacatgttctatgtactagcctagaattacaaacagcatttcgccgaaagattcacttgggggaaacaaacagtctgcgaccacagcctcaacaacgaaattacgagtataaactctataaaccccctcatgaatccgccagatcatattattcttttcttcttctatattcatcttggtatatatttctataaggactgtgaatgtactcctacctacaaaacattgggtaaatggcagttgtacttcaactttggatgtgaccggagcgcttgctggagcgccgtgtccaccgtcacgccctcgcggaacagcttgtcatacaggaggcagatgaactgagccatgtactcctcatcatcgaaatctttgctgcgatcgccatttttctccatgtcgctgtcttcccagtcactcgtagggctaacaggttccgcctcagactcggaagcctcatcatcggcaatgacaaacttcccgttctcaaggctgccatttacttccatcccatggtatactatagactgggaatctggaggctccatggccgacgagatgactgctttggcaccagaatccatgaatgctttgaccaggccgtgagcaaggccatacttaccactgcatacaatgatcctctccctccatgctccaacctgggaaacatgtatgtaatgaatcaacattagatagtgccctaaactctagatacattgcaaatagaaaaaggcatgctaacgatttcagcatcactagatgtaaataacacatctttactacagcattggcagcaattagagtatgtctgacatttggttcctgactaaattttttcagtaatgtgaggcattgatcattggccagattttggtttggtcaatagctggccagattgatcattgaccaaatatgctcttttctatgatatcattttgatggctgcaccatgagaaaaatatgaaggtttgatcttaaatttatagttgactggaggaatcaactaccagtaatgtactataccagaatttagttggaaattagcatccaatttcatcagatgtcacttgcatgaatattttgtcacatgtcctttctaagcacaattaacacactacataagaatagaatttgaagagcatttcagtggaagtgctagctatccaggctggcatataccatccatcgaacatcttcaggtgtcatatgagcagcaggcactgtcctcctgaacatataggcaccaatttcttgattatcttccattacctgcgacaagatagattattatatgcataatgatttgtcttggaaacataaagaaggaaaacagttcctacttgtgtttggcgccctatatagcggtggtgaatcccaccaatttcaaacgacggccactctgcaaccaactcagacaaacatgaaatctttgacaaggaatatgcaccctttctcttacatccatgcaacatggctgacaagctagttttcacacactggagaaacctgtctgcaagttcccctggttccgcaactacaaacacatcattctgccagctgcggtagtaatttttgcatcacataatcaaaactagagaaaaaagtaaacacactgacgcttatttcagtaaaagaaatcgtgataaaaaatacctcaatattgagccagttgaatcgttttgaagtgccatatgtatcacaccaacttgaggcatattttgcaacttatcatatagtgattgaacatgtacagatggctgccatgacttaagaggtgacgttggcggcgaggactttgcagttgggttgccatccaggctaagcggcggaaccaggtcaattcggccaattctttgggtgccctctggactatatagaagtggactagatggaaaactgccagtaaataagggagaagtaattggagtcggaagtgtggtagctgcctttccaaacccagaagcactgttcattagagtaagcctgataccattctgggagcagaatgtttcaagcgagcgggcatgatttactttcttcccaaaatcaggactatatgaagcctctacaagtaaaaccacacgcctccatcctaaggtaggattactttcactaaaacctgaattagaggattgaaaaatgaatcaaccaaatgttccttcgaatcattacacaaagtgcaaacctggagaagacaaacctgaatttgatggcttgaatcttgaaaacaacattgatttggtagtttcagatgacttttcttcctcttggtatcttggaactaaaagctcacaaacattcttgaaatcttgaaagtttttctgaatgtactcatcagttgcagcttccaacttaagccagacagcaggatcagtctcatctagttccataccacaccgctcatcaactgccacagtaacaagattcccattctttcaatatcaaagtgcattggtaaatatgtactagaactcattaaacagtacactatgatcgagttgctgttctgtggatttccttggaactcaaattacctggattaaagcggaaatactgcatttctgggagcattggtatcagtgtatccaaagtttcttcaactctctctacagagcatgaactttctattaaaacttgccctgtgtccaagtagcgccacccacctctccgactctagatgcataacacatggaataaatttatatatataagcaatgtgatagatgtatagctcacaacgagatcactggaagtgtaaacttaatgtaccatagaagttaacttttcaaactaaaaacaaaaattattcatcttggatcagtcaggtgtttcttctagtaatgtatgccttgacttgtggtttccaacagatgaggctaatataagctacagattatatgtagtgtatcgaattaatagatcccattcccatattatgtcacttgcaaaacaaaaaaaaactttaatatatgaaattgactaaaattttagcctctaaaatttactatcctggaacgatattgaacctatgaaagtttcagttccaatataccgacatattgtacatgtgttcaacgtattacaaaattgggaaaacaatatttctttaaaatgtgaggaattcagtaaataattggttttccagcacatggattgcccattgcttggaaggctgcccaacacttaacaggggcggagacaggaggaggcaagcagaggcctggactccccccatggctccaaattttacactaaatttattgtagatttagcaaattttgagaaaaaaaactaacactattggcccgattcaaccatttttttttttgcatttctgtctctgccactgatacttaatagttgtaatgaataatagtgttaacaaaagagtcgacaactatgatgtatattaccttagttggaactgaaccacaccctattgaaactagacaatctattctcgtatcaggccacaaaagttgtgcctctcttatcgcaaagattgtgggattgttggctacaatagctccatcctgccaacgatttacgtctgaagagaaaggaagaaaaaaaaagggctataagaactgcggtggataacaaatcttgaggactcaaacaaatagaggcctactgttcttgcacaaaacaatatccacaactaagtttaggaatatctaccatcagagaaatcatccagataatatggagctgcagaagatgctcttatggcttcccatatgcgatgcttgcagctacccatgaaagcaccacgtttaataccaaccggtgcaccagaaacagcagttccaaccgtgttaattggtttaataccgaccggggcaccagaaacgggcgttccagctgagccaattgatgggctttctgtcatgactgatgatacttccacagtgccaggtgggtactggaacatgttatgaggttaacagatggcccaatattcaagaagagaaaaaaaaacttgtgaatctgcactcttcttcagtttcctgactaataagcacaagcattgacatggtcatgcacagactgtatatatggtaagaaaacaaacctggtaatttcggaatatatatggttgggcaggcatgacactgactaaagtagatacagcaaaaaccttcggaatgccttttacagcagactctataaggaggtcaccatcttcatcagcacacatttcctttagtaacctctcaaattgatctgcactgtgctgtaattaagactttggtcactaactacattgtgtcacatgaaagaccacatcaataacaagttattatgttatttacctttgatccatgtacaaccaccctaaaactctgtgatgaacttttaaaaagctgatcaatcttctccttccacgttgcagcttcatccttgggggcaggttcagcaaagacaagtttgcctggagaaaccaacagttcacttggcaacacaataagaaaaatgtggaaagtaagagccaaaagacactcaccaagttttgtgtatatttcttcacattgatccagagtcatctgcttgactccaagagccatcgcaagcatgccacctgtcgatgtaccacatatgaggtcaaacatttcatgtatgcgtttcccagtcccttgctctatctgtttaagaatttggacagtcgcaaggcctttcatgccaccaccatccattgatagaatgcgcagacccttctttgcaactggtcttcctcttattgctcgacgcaagttctcgttctcacctaaaaggattgaagagatattcacaaactaatcaacacatatagttattgaatattcaggaaaatggatcacataaattaagattcagtaccaaaacaagcatacctagaattgccaaagcacgtgcagctgccttgctgacacgcttctcttgtgaaagagttaagcgaattaaaaggtcgcgcaaactttcagagtgcatgagggtgcgacgagtctccaagcagaaagccaaattgccaactgcaaatagagatagacgttgcacctagaaaatgggaacagatacaagtgagctcaccggtgggtatcgaaacaacacatcaaccagagtctaaatccagatcatcttgcctcagagttcttgtgtgcacaaagtgttttcagtgacttcagaacgtctttcgtcaacattttttgagcaacatgatcagaaacaaaagttaaggtgactacaacttgcaatactgattctaattcttcttcattaaatgatttcagtacagcttcaataggcttcatgatatcacacttaataagtagcatagctgatgaaatatctgatcccagtgatgaaagagcaaggcatgcttgctcaacctgcaaaagtaacttctaaattaaaagaaggaactgtgttgtgcttgaaatgagcattttgtttccacagaactttgagcacaatgaattagggagattgaatatgtaccacatgacgattatcactgcttatcatgcttataagctgcctgacagcattttcttctttgctaattgcaacttggttgctacgatcttccattattttggccaaagcagaggctagcaaagggtggtgacaggaagagaaccgaaaaacaagtgaaaagaaggcactaagtttgtgcctggccgcaacgaagtaggaattattttcagtctggaattaaaaccaaaatacacacttatcaaaaggattgctagtagtgaaacaacctagctaacagaataacaatgcaggatagtttaccaacctcaatttgtacagtgacagatctaagactttccagtgcttcaattctaatatttgcaagtgtgagatgcctaaggttatgcagtggcaaaatttctgggagaaactctagaggatttccaaacaagcgcaatacacgcaacttaggcattgacctgttcggaacaaagaatgaataattagcttaatagcaccaacaggaagaaaccgtcaataaaaaaatgcctctgtaagacaattgaataacctgaaatccagtaatgggcggacaagcttattattctccaacgataattcctccagcaaaacacactgtcgcagttctgctgcttggtcaaagggaaataagatattagattggtgcatgggctgatgggcagttgatataacataaacttgaaagaccacaagtcttcaagtcttaaatacgctgtgaaacataatttttttaagtttttaatttagatgcaggcatgatcactaaccaggtacagaaactagcatgttgttgtcgactgtcagcactatcaatttcttcaaatcaccaacttcaggtggcaaaactgacaatttgttgttgtcaagatgtagcttctcaagaagtgcaaggcgagttaattcaacaggaagcatctgccaagttttgcatagcatttcatggttagatcattatagcatctacatgtccatccctaagttttcatggcaacagatttaggggacaaacaaacaaaaaaaaaacacaattattaggtgattgctgcataattcaagcatatccatctttgcacgactaaaccaggacgtattatacagatcagtacaaatcaagaaatcaaacgaactccacaaaaccaaacacaatttcatgaaaataggccacccaggaggtctgtctgacaagagaacaacatttggacagagccacagaacaagcatttctaagaaatcttcagtggtcgtagcatgcacaatgtgtggtcaaacctgataatcagaatctctatagctaaaagtaaaggtatgtgaagcaaccaaaacatatgcccaagcctcctttatacacatccaatcaaattctcccacaaaagacgacaacactacaatgccacctcctagatcactacagcatcgagcaatcacggcggtaacataattctacattgatcaggcatgtgttaaaacaataggccgtacgggatggaatgttttcgcacggatcagggggagggggaagagatagagaaatggactcaccagcaagccgcagttgcagaggctgagcacggcgacggagcgccagtggtcggcgagcacggggacgcccgtggcagcggcaccgtcgacggccggcgcgggcgcgaggttggatctgatgagccgcgagagcaccccggcgccgtcgccgctcccggccgcggaccccgcggcccgcgccacgcgcaccgaccgcagcgcctcccgcctcctgaccacccgcatctccaccgccaccgcaccctcctcgccgccgtcgccctcccctctcggggacagatcgacgcagacggcgtcgtgcggcggggggagcgcgaccatgagctgggactggagccgcagcgcgacctggtcctcgtcgtcgcccgccgaccagtcgagctcgatccggaacccgaactcgccgctgccgccgctcctcctcgccgtcggcgaagacgacgacgacgtcggcgtggagcccgcgctggatggcgtgggaggggagcccggctgctgcggcggcggcggctgctgctggtgatggtgaggaggtccatccgcgaggtccccgtagtcgagggtgaggtggaagatctcggagctccgcttccagcccagcccccacgacgccatggcgggcgcccccgcatcaaatggcgaggtggcctagggctagggcgatgcgaggaggaagacgaggcgaggtgaggtgaggacgaggagacgcgaggcggaaggaaggaaggaaggaagggaaggaagcggaggaggagggcggagggggagaggcgttgtgttgtggagttcggtttggtttggtttggtctggtctcggtggaatttcattttgtgttttttttttgttttttcttttttgggtgttttggtcggggttttgccttccgagatccactaccaacagtccgggagggtgtggggtctacggcgtctgctgcacgaaaatttggcgagggttttctagaaggggtgcactgtgtcagcgcacgaggttgtactattttcctggagttttctcgggcttattttcctggagtggtagtatcgtacttaacactttgagattaaagtttaataattgggttcctataaaacttattcacgatagctatgatatatagagacataaataagatacgtctactgattggtcaatattctttttcttagagcttgttcagattgatatcatttcaaacccaatgattaaaactttcactaaaattctcaaccggatgattaaagctttaaactcggatatatagaacttccaactctataattcaaactttcaactcggattacaaatcatctggtcagattttgaaatattcatgtgaaaacttgaaagcttcctattcaaacccttaaacttagaaacccgattttagaagtttcaactcgatatttcatacctaatactttacacattcaactcattttcgaaaggtcatcttcgaaataaaaaaaatttaagaactttggcaattcatacaacatgcgcgaagaagaaagggtgctatgcgtcagatctgaggaaggtgggatggcacctcgtcaccgcccttgtaaagataagagataagtaaggagagtggtgccatcactgtcttattgctggagatgaagaatggggagcgaacgaagggggtgcgcggagccttactatcttcttgccaaagaggaagaacatggagtagagcagaagagatgcccgtcggcacgtcgttttgctggaggggcaggggatctttccgctacccaacgatgctagagaacgcgctcgcctgtagtctgcgacgtgaggtgaaacgataagtggatctaatgtgtggttcctggtgaaaaaaaggtaaaggaataaggtgtttgtcactttagagtctagtgaacgtttgcagttatgatcccatgatgaaccacctagtttatacaaaatcaacatagtgagtttcacctagactctaataaaaaaaaattaagtccaacactagttaactttagtaggatgaaatcatatttgtcaaatgtaaagtagagactacctcatatgagatcttcatattcttccttggtcgaaagggtattgaaagggtttatataaaaatattaattctacgtagttcgagtaagcttaatattttgattatccaatccctttatttcttgattttaaaacatcattagaatgtatgtcttggtcattagaataagcttaatatgtatatgtacccaagtttgattattcgagtattttatttcctttttttatttgacacaatgtttttttccgctgatatttgtcacagtgtttgatgtgatttttttcaataacattgatcgaaaatgggtaaagcttgtgttctaaattggtaaagtttacatcgtagatattgttttattgccaaacaatgacgttttagaagatttagttaaatggcaaatatttattattaaacttttaaatactactaaaggatttgatattttagctgtcataaagatttatgaaatcaatatagcaagagcaacgcatactaaggtcttatttggcactgctacagatataagatttcttgaagattggtattcctagctccacaaatttatggatttgattttctgatttcgttggtaacattagaatgaatcattttatttctattttaagtataaaattttgaaccactataatttgacatacaagcttcacttcaaatccaatgtgaatctagaatctgcatctgtgtcaaacatggcataaattagatctcggcatatttcttttagagtgcattcggttggagggagtttttaaggagggatggatctcttatacagattacttgtcaagaaacaacaaggaaatggaataaaaatcaaatttcagtgttaatcttaccactaacgtccacctctaaacttccaatacttttctacttcaaagaaaataatcagtgcttaaaagttttggttctgtcatgctcacaacatgtaaaaatgtctttatatgtgtatttaaatttgagtaaattttaagatatgtacagtaatacaaatttctacattcaacccaaatttcaactcatgagtcgtgaccgaacccatgaaaaagtcgaacacgaacacaagtaccggtttcaaccttatcaaattttggtaaggcaacaaactaaacacacttttaccattgccacctcatcaaattttggtagttttagaagctctctctcttaaaactctaccaaaatttgataaagatatgaaaacaaacaaaactaacactatcaaaagttgataatatcaaaatatgttaaaatttgataatattccctccgtcccaaaatacttgtcatcctagatagtttagcatggactaaggtttgagaaaaaaaaagactataataccccccacattaaatggtatatggttaggagtggactagtagtttaggggtagaaatgaaagaaatttgaatataaagaaatggatgtaacaactagtactttgtagtgacaagtatattgggacgaattttaaatcttagggtgtgtttggatggagggttttgggtggttggatggagggttttgggtggatagaacatggcggcccattttttatggctgtttggttggagggcgaatgtgggattgggcggcccagaggggaatattcccctcaaatgccggatgaagggatcagggtgatttgcccggatgcagcctcccaagcgctaggcgagctgggcgaggcgggtcgcgtcacccctcttcgctagcgagaatgatggtgacgcgagcgaggcagcggctggtgcgagcggcgagggcggcgaccagcgcgggaggcgagctcggcggctgacgcagaagagggggcgacggcgagcgggaagagaggtgacggcggcaggatgcgagggcggcgtagacgagggatgtgagctcggcggcggcggaaggcgaacttggcgggcgacgtggaagatggggcaacgacgagcgggaagaggggcgacggtggcaggatgcgagggcagtggcggcgagctcggcgtagacgcgggatgtgagctcggcggcggcggaaggcgagcttggcggccgacgtggaagagggggcgacggcgagcgggaagagaggcgacggtgagcccggagacggcggtggcggcggcaggatgcgagggcggcggcggcgagctcagggcccttcttcccgccttttttttctttgttatttttcttttttttctctatgtggatttgtagtagtgtatatatatatatatatatatgaatttgtgatttgttgggaatttgtgatttgtagtagtatatatatttaaatttgtgatttgttgtatatatgaatttgatgggggtatactcaccttctctaagtgagaggtgaccacacctgctcatccaccctactctttccaactaaataaaaaattggatcaccaaatccaccttcatctctaaaaaaaaaagaatgtatcaccatattcacccaactaaacaaaaaattggatcactacattcaacaaaatatgtaccgtcatatcccatccagttttgacggtaaatcaaacacacccttagaaatacaactattatggaatagaggcagtaaaaaaaaaaatcaaaatttcagtaacaaagtgaacaatccgaaactcacgacacctctctctctctctcccagctggttcgcgcggccaccaaacacatcgcctcgactccccccacccccacctccagcgatctccgccgccaccgtcctgcccggtaagctctaccgcccccttcttcttcctcctcgccgatcgttctatccgatcccttccccgccccccgaatcttcatcagcgcccccagatccgcacgcctccatgcgccaccccaagcccgcctcccgcccgcgccatcaccggtgctacggccacccccgcttccaccacggccggccagccggccggccggcagcgcccttatgtcccgccgccgtctcctcctcctcctcgtgctccaccctaatttgctactactactaggcgaccacctttcccaaaccctagcctcgccaactggctcgtcagaaaccaaaccctccctccaaccctacccccgaatccttactcggacgggtgggagcttcatggattagcagatgccctggaagaatgggaggttttaatgttgggtgtgccaattgcacatggttgcagtgagatcgatctggttatctgctcccacaatttaatttgttatactattttctttttttgtaacacaattcaaagccttctgttaagcaccgagttttactgtagtacaaatgttgcgaaaatgcatcatttgatctaggtatgaagttcagtaggttcaactgattggcaggtctccagcattaatgctcttcctcaaactcagttttgcaaaacagaaaggataaatagattccttttactaaaccgtgattttgtgttgattaagacgattcattactgcttgtttgttcaggaatggagaagtaccagagcaaggcccggtttgcacccctcagtgatgctccatttgctctccgcggtaaatgactcttgcatgaatatgtctatatgccttgccttctggtttgcctttgatatatcaatcaataatatgggcagccaccctattgttcataatgcggtagccaagtacattatgcaatgcagtaattgacttgtagctgacgtaggacacaaatttcttgcaaccacactagagtaagttattgtttttttttaagaaaatggaagtcgtcattggtttacacgagacatggttttcactgtttttaggttagtctctaattttttattgaactggacgctagtgtatattgtataatttgatgtacatgttttgcaactgcttcaaacaactaaataaatgccctcaccttttttcatcgttttcaggtgcccttggtagctcaaactcatccttcaacaacatagatcatctgagacaatcctcaagttctggacaagctaggagctacacatcttcacccctaggagctctgagaccaaagatgttcccatctggaaaccgactcctgcacacaagtcgtcccctgtcggctcctgttgcaaaccgcccactgtcaccccatctccctttgaagaagccgcagctgagtgctacgttctcaatctcacaccgtatttttggtgctgccctgggagctgtcattatatccattcctcttgccaccaaattcagcctcatgtttgatgtctg

SEQ ID NO: 79140 - DNA, 65816 bp, Oryza sativa
tggtcgctttggctatgtaggaataatgtggtttttttataaaaaaaaagtgatatctttacctttgcaggttatatattctcttatccattgacttcgtacatgggctatcctacagaagcctgaagcctggttcgcgggatatggtagttgtggcatgtcaacatttggagaaggtggtcaaggagttttttactcagggatatgggtggcgatctaatcttagaatttgtggcccttaaaactctatgcttttggaggagatggccaaggagttgttcatgggtggcaatttaatctttagattgatggtcctcagtactccatgccattcttttttccttttgagtgtggttttgtatgttcggctgtgtgcatcttagttatgcagaggccgaaagtgttcttagtataattgtatcatcttgatgtaattgactgagttcaataaaagcttccattatctaaaaagagccttagtttgtctaaaaacagattaaaaatatttgtactaacctcaagtgcgctgggcagatagatgatgccgaaagcaaaagcattgtcttgactcttgatttagatgcaaaatttcctttaccagagcatgtgaatcgtgaactacaagcagcggagaaagaaaggagttatcagagccagccaaaatattgcattttacaatgcaagaaatgagttggtgcaacgtacacagaaaatgagtccacgtctggagaatctgcagcttcaggtataaagattctgtacaatctttccctccacacagatatggaacgtgacaaatgttgggccagtcctttcccaatgtctcactgtggaatttgcgctcctcttccttcagccattcttctctctctttcatcagactagacggatcatctttgtttctgtccaattctttcttcagcttcctctccacccatgagtacagctcccactctcgctcaggccattgatctccttcactctgctgcagccactcttctagtggttccttcttggattcgtcttcctctgcttgctcgttcagactcgacgacttctccttttctataaacgactgttcttccatgtgctgcttcctcggccactcgtgtccctcctgcatcctctgcccacgcgaccaatatttatcactttgatacaacgactcccctttagaactcttcggcgatttttccctccagctcatcggtattcctagtgactcgttcttttgctgcatttcaataagcttcgtccgcccatgctccagcttcctctctcgccactcgcccatcttcctcttctgccacaactcaatcttacgcccctctggccgcgcatctcctgttggattctggcatcgtgcctctagttcaaatgagcactcctctatttgcaactcttttaggttacctggcaggctgttgggtggtattgaatacatccagtggcagtacttcagagtgcacctcctcaaggatgacagagaggacaagctcgatgggagtgcatggcacgaataaatctccagctcctgtagagatgtgagatactgaagccacttcttagtaatgcttgtatggccctgtactatgtcaaggcgcaggtttcggagggagggagtttggggaataacaaattccagacctactttttgcattgtatcgccacccaaggtaaggtgggtgagagaatgcatagtgcgatcgatttgagttggggattgcttgtcttcttgtgctgactcttcatttgaatctgtaactactgtagaacaatcaataatcagtatattcttcaggtttttgatataccacagtccacttttaatgcacacatctccaaaaccttggatatgtaggtactccaaggacatcaattgtttacatggaatgattaatttgcacctccggctaccacctacctctaaacgtgtcagaccgtttagcccttgcaaatacctcgagaacgtatcatcatatggatcacaccacttaattattatctctttcgtggctaaacccaacgactcaaaaggcacctttctcaatttttcacatgaaagtatcttcagcttttttaggttccgaatgaagtcactactccctgcatatgtccagctctcccaattctccatatattcaaagcttagctcctccaaggaccaaaagaccacgtttgaggttccacaaatatcagagtttatatcctttattgacggcaaaccatccaacttgagtttttgcagatgctcaagctgtccaagtggagggagaacgttcaagtttttgcaccaacttatctctacaacccgtacatgcttgagctgccccacccaatctggaagttcaaatcctgagtaaccatacagttttagctcctgcagatatcttggaggagacaaacacccaagtatcgacttggacagatcaggcaaagtataagaccatcttaattctaaagctgttatatagtccttctcaactatgttagcttgaagtgcctctgcaggatcagtcaccatctcaaggtgtgaaatacaaagggaaccacccaaatcgttcatgtcacttagctcagttatcccgtgaccttcttctgctttaatatggaattcatgtagctcttgcaatttagttagcttcccaatgccattaatttgagcaattgtgcctgagctagcatgcaagtgacgtaggttgattaagaaattcatgtctccaggtaatttaccaaatgtacagcctctcaagccaagaacctgaaggtggcacaagctgcatactgaattaggcagtttcgcgatcccagtaaacgagaggtctaaatatctgaggtgtttcgttgagctaataacatttgaaagagcggacgtccgtcccagccatttgtaactccttgaagagaaggccagtaagcgtaggcttttggaattacacaaaaaattactaagagggagatgagtttcattattgctgggttgatgactgccgtcaagcaacataaaagtgcgcaattgttcagttttaaatttatctggtagtgtatctagggcatccatgtcaactgataaatagcggacatcctgtgaaacacctctcaccttattatcgttaccatggtattcatcagaagacagtgcacttgcaaaatcccagaccaaatcatgcataatgtattcagttttccttgctgatggctgaagaaaggccctattgacaagttcgtagaaccattccccacctacatcctccaaccttttgactccactagaactgtccagctgaataaaaccattagctatccacatctgaaccaatttatctttttcaaacacatagttcctaggaaatattgaacaatagacaaagcactgccgcaaatatccaggtaacgcactgtaacaacttccaagagaagatataattctgattgcaaagttatcatctgaaacattccaccaccaactatttaagatttccctccaatcagcttcttccaactgacttctcaatgttgccccagttacctttatggatagaggcaatccatgtaacctgtgtgatatttttctaccaatttctttgagaccttccgtggacaaacttctgcagggttcaacaaatgcatatctcctgagaagtgcccatgagtcatcggattgtaaaggatccagaattacagggcctgcagtccctacaaagttagctacactgtacaattgagttgtaactaaaactacacttccaggtgctcctttgcttagtacactccttaaatcattccatagcacacatatctcattccatacatcatcaagtaccaggaggaatcttttaccttctatgatatcctgaagttgagagtaggcactgtccaggcttgtcatataactgatgttatccttgggattaaaagaatagatgatctgttctattgtaaccaactggtcagttctgtcagtcatatagacccatgcagatatatcaccaaagtgctcccgaacatttgcgtcatcgaatatgaatttggcaagagctgatttgcccactccactgattccaacaatgggaataactgccggattccgaaggtatgtaacagcactgtcatgtggatgacgaatatattctaccttgttgctcttttcattttcggggtgtggggatacttctattgcttgctgtgtccatttagacatatcaattttatgaagagtttcagtaatccaacccttatgaggaacatgtaacttctcagcttcttccctaatcttaagtgttatttctgttggtacatattgggcattgtccaataccatgtctcttatcatagctatttcctcatcgcgaccaataagaaagtcatcaccaaggaaagatttgtcttggcgagtcatggcaacagaagatgaagctatcttatcttccttttcatctcctaaggcactctcattcaggggtggtgtgtcaactatagatttgccttgagaacatgcactggcaagtttactaatgacgtataccattctaatcatgtttctgtcatcagaggagagccaattcataacatcagagattgaagagtcaggagctttcacctcagattccatgtcgtcaagaagtccctttgcatcttgtgcagccttgttcaggtcctgcagccatgcaggggcaggcttgacccgctgcaggctgtccagacggaggaagcgaagcttatcctccaccacatccagcttcttcgtagttctcttgaaggagtcgctacttttgcccagagagcggcggagcttctggaccacttcgctgatctccaccgagagaagcacagcaggatgctcatatccaagatccattgatgcggaaacgtgtttgtcgaacttttgaggcaagagttgggggtgcagggctaagctgccgtgttgaccttacctctagtatctgatggaaccaaactttttatttagagaattagagggggcgtggggcctgcttgtgttaggctgagctggaccagcacattgtccaagacatagcataatttatttttacataaacatatacccctctatccacccgtataagcatctatctattatatattattaaaaaaagccttgaaagaagacacaccattcgttatagagactagaaaattctcacattagttggagaaaaaaaagaaaaatatcttagtcgtcagatcatattgggtttggattataatggtatagattgattgatatagctataaaatacaattatatctacaaaaatataagttgagagttatatataaagtctactgcgttcgttgggtggagaaagagagagtttatttcgttttccgcgcacacatttcccaaactactaaacggtgcgttttttttcaaaaattttctatagaaaagttgctttaaaaaatcatattaatccattttttaaatttaaaataagtaatactcaattaattatatgctaatggctcacctcgttttgcgtatcttcccaatcttctcaatccccttctcctcaaactctctataaaaatagaatttaagagttaagagttatatatgaaatccatgaattatagaaatactccctccgtccaaaaaaacagtgaatggatgcgacatattctagtacaacgaatctggacagatgtatgtctagatttgttgtactagaatgtgtcacatccagtattaggttgtttttttatggaacggagggagtggaagctaaaagttgtatatgaaatttatggattataaaaatagaatctaagagttgtatatgaaatccaaatgctcatagaaatagaagctaagagttgtatatgaaatttaggggttacaaaaatagaatttaagagttgtatatgaaatccagatgctcataaaaatagaagctaagagctgtatatgaaatttaggggttacaaaaatataatctacgagttgtatatgaaatccaaaggctcatataaatagaagctaagagttgtatgtaaaatctacggattataaaaaatagaatctaagagttgtatataaaattcagatgctcatagaaatataagccaagggttgtatatgaaatccaaatagatttctacatgcaatgatatcttttggggcaatcctctagttttattataagagtgctaagttttgacttaactatcaatagcaaaaaaaaaaaatcataaaaattcatggcataaaaaggatgttgttagatttatcattaaacaaactatcctaacatgcaacttttttaaaaaaataaattatttttatatatattattggtcaaaatagtacattgaagatcgatcatgtgaaagtctaaaagtacttatatttgtggatagagagaagtgggcttatttgggaaagcttatagcagcttctctaaaatcaaaagctcctcaaatattacagcttttgtccacattctaaagctgatgtagttgcgtaattcaaagataaactagaagctagattcaccttagcttgctataacacaacttgccataacccaacatgtcataaaaaaccatccttatttaaacccatggataagatgttaatggttttgagatttaaagtaccaatagtagttggttttataattaagggatcaaaatcagacaagtttatagtgaaaggagctagatacatattttttttaattaattgacaactctgatgtcattgcggggaaaaaaaaagaaaagtcagattcatcttaattcattgtctgaatgtgtatttaatccctattgagaaaaaacaaatgtaccttatgccactaacaacgaaggtcgactactgtagcattaagaatgctcccactcagattccattagctggctatgacccattcgcacacatgcccacatttaggtcaatgactgaacacaccaattagctggccatgacccattcgcactcagattctattagcttatgagaacatctgccagtcctcttctactaggatgcaattctgaactctctttcctgttccgtgctactagttgaagccttggagttggaggggcgacctcgacatggttggaggcggattgaccatcggcggatggttcgcaggagctgtgatcgccaacttcgtgggcaaggcgcgttccatcctggaggagcgccatgagctgcatggtgacgttgcgggtgtttaacgtggaggcttcccttgttcatctgcaagcagtgcttgatgtcgcggagcgaaggcccgtcgtcgatgataatttcaccggctggctggagttgatcaagaaaattgcttctgaggcggaagagctgctggatgactttgagatcaagagaatacaaaagagccaacagaacaaggttagcggttttctggcatacatgatgaagaatctgggttttgttgatgatgacatatacagactgaagactctcctggcaaggctcgacaagattgccagtaagtctggaaatttttttgacttgttaaaattgaatgattctaaagaggatatggtagggtttcttccagaaatacaagtagtgttccatggtcgtgagaaagagaaggaccaattaatgagcatcatatttccaaatgaagcacaagctgaacattttccagcatccagaatgcaggaagagacacggggaactgcaactgtgaaagttgtatgtatcgtaggcgaggctggggtaggcaaaacagcacttgctcaagtaatctataaccaccctaatgtcaagaaggccttcaatcagagaggatgggtctctctctctcaaaggtctgactcagaggatttcatcaagaaaatattttgttcttttgcagcagaacagcatccttttgattctgaaatgggtctggaaacactccaagctagttcggaacatgatctctccaggaccatacagaacaagagattcttccttgtccttgacaatgcaaaggataacctgcaacgtgaatggaagactgtgagagcaaaattaactggagcagcagcagggagcatagtactggtgacaactagatcagaagtgactcatgccattccaggaggtatagttataactttggataaaattccaacatctgttctctcgatgattctgaagcaccacgcgtttggactcaccagaaaagattctctggaatcaattggtgacaaaatagctggtaagttgcatggcctgcccttatcggcagaggtaatcgggaggcttctcagaacgaagttagatgaagaccactggcgaaatgtttgtgaaagcaattggtggaatgactatgaagatctggtcatcactaatcctgctttaccttcagtaacgattgcactggaattcctcagaaatgacctaaagaaatgtttgggttactgttccatgttcccatccagttatttatttgacaaaagaaaaatgactcaaatgtgggtgtgtaattctatgcaacaacatcaagaatccgcatatgagatcacagacattcgatggcttgatgagctcttgaacaggtcacttatccagtcaactgtatggaagggtaaatatacagtgaatgaaatgatcaaaaaagttgtggcctccataaatcaaacaggatgttacacaatagacgatttacacagtcccagacaaaacctttccaatatcatccacatggcagttgacaaatatgatttcgaagtgtcattggacctaagaaaacaaagcaaggtacggagcattttattttttgatggccagagaacaaccatgctgaatacagcccttaatagcatattgcctgtttcaagttccctgagggtgttagacctgtcttgcattgaaactaagatggaaaggccccctgatgtcatcagtacatgctctcacctaaggtacttggacctatccttcactgggatcacaatgtttccagactcattctgtaagctactccttttacaagttctaggtatgcgaggatgtagattcacagagttacctagggatatgaataagctagtcaacctgcgatatttatatgcagaagcttgcacactctctttgatacatagtataggccagctatccaagcttcaatacttggaagaatttgctgtcagtgaaaaggaggggtataggataacagaactgaaggatttgaattaccttggtggccatctttgtattacgaatcttgagaaagtggcatgtgtgaatgaggtgtgtgacgcgcgtcatgctgagctgtctaaaaaaatgtacctccagaagttggctctaaagtggaattcacagccagcaacacttgatggttgcacggaaactgtttcacacctaaaaccaaatggacaacttaaggatctcgagatccactgctacatgggagtgaagtttccaggatggatagcagatgaccagcacttcaccacactgcgatacattaaattcagtggctgtaaaaaattggtagaacttccacctcttggaaatctttctcaccttgcggttctaattctacaaggcttggaacaaataaaagatatcggaaaggaattttatggcagttatgacagggtatttccatcccttgaagaactgacgttccgtgacatggaaaattggaggaggtggatggatatagcaccaacacaaattattccacggatcagaaagattgtgataaagaattgcagaaagctagttgatctccccaaatttgttcttgtaggatcccacgaactggtagaattgtaagaacagaagaagccgaggaggaaaacatgacatgtttaaaagttcatgattgtttggcaatcatgattgatctcccaaaccatttgttggcgtcaaccgaggtatggaatcttcaaatctgtgaagtgtgcttccaaggagagtaagaacataagcaactaagggaggttcttgaatcttgaccattattgattgtattgaagtgagacagaggaagaaaagaaaaaaaaagctagccttgtcttctttcttgaatcttgatcattattgattttattgattattgattgtattttttcttctttcctggctattgtctcctaggactctagccttgtaatttttctcctgctctattcaatgaatcttcgcgatgtctggtgcggatcgttcaacaaccagatttctggtgtgaatcctagtttttaagacaattagtggtctatgaggaatgcaaaaaaggtttcaaagctatcgactacccccttggcttcattttcaccccaactagttcgggcccacacctcacccaccccaaggaggcaaacaagtatgtttaccgatctccttaatagccgtaccaagggataaaacttgctatattttgggacatatgaagtattttagaaggattggtttaacaaaatatgtcttcacaaaaccatattttgcaggttagcatcttaatgcatactataaggtttcaccagtaatttttcaacaaaaaaaaaatcaaggccccttgcagtttacaatggtcaagatggatatgtcagtttcttctcaaaaacttagaaactacagtgctatattttggttggctttcccatttccaccacacctatcatccatttcaggagcaatgattttcttgaattttgcagttttcaggttactgtgtataatatattaagaagttggtggctaatcttgaagaacaaaacaattgagtgaagaggccacggtgtagcaggtaaacaagttccctgactaattgcaatctcggaccataggaagagcaagaggaaaggcaaaccttttaccatcagatagtccacttctgtttatgttctttttacattatgctgtaatctgatatctacaggtttcttattgctcctattaatatagcaaaagcactccactggattttcgaaaaaaaaatactatgtacttcctttgtttcacaatataagatgttttaggttttgaatagattcatgcatggatttatgtatgtactccgttcttcatttatgtgtccaaattaatatgtatatgtgcgactctagacgagagatggagaagccaaaatgtctaataatatggaagagagggagtattatattttctatcaaccttttagctctcagagttacccttttttcagaatcattgacagagtgaggtacaatgtacatgggaactgctagtctgtagattgttcgttatgtattcagaggctgcacaaatagacctgaatgtttgaactatctatgatttgaagaattcgcccacttgaaacatgggaccttctagcaacatgaacagggttcacgcggagattagccatgccacaagaaagataaacatagcccgtattaccacacagaatgctgcaatgctatattatacacaaagagccgaagaggacaatcatatttaatactgagaacggcaggcgcgcgatggggggcgtaccttaattccgagttactccatcagaaagataccactgcattgtcatcgaataggacggctgcatgccaccgcatgattgcggattcccggccacttcagatgatcaaatcgacgccttcatctgtccgcacctggtgcagagcgaagagcggagtcagggagaagtgcgcatttcgtcgagcaagtggcgagcaccactcacctgggcaaagagacggcccgcagaagcaaccagcggaggagaggagggggagctcgcctgcatcacctaggcaccgcctgcctcgtgaacgccgacacggttcaggagcccgtagaggtagaggtagagcggctagggccatcggcctccgccggcgtgtcctcactcgggactcgggagagggcgtgaggctcgccgcctcgcgcccttcggggaagatgcagaatttttattttatttttctgttctgacctttattgacacgtctcacgcagcaggggttaggccttgttcagataaaaaaaaattgtggcaaaaaatgtcacatcaaatgtgtgatattaaatagaaaaaaaaaccaatttcacagtttacatgtaaattgcgagacgaatcttcttttttttagaaacacaatacaaacgcagacgctcacaacgtgcgcacactcacccctataaacgcacacacgtacaccctacccctatgagcacctccgaaagactgagccgacatgtcttgaaattgacgaagtcaccacaggcgcctcgctgtcgacgggttcgtcgcctaccactgaaagaataattagccgtaaatgcgagcacccgtgtcaaatctaggatttgaacttggatgggctggttccaccacaaggaacctaaggaacttttgcgagacgaatcttttgagcctaattatgtcatgatttgataatatggtactatagtaaatatttgccaatgatggattgattaagcttaataaattcgtcttgtagtttacgtgcggaatctgtaatttgttttattattagtctacgtttaatacttcaaatgtgtatccgtatacttaaaaactttatacccaaagcactaaacacacccttaggatttctttcttttaactttacttgacggagttgcattgcttcagctcatttagccgtatccaaaatttaaaatttgaaattaaagttaaatttcacattgatgttttaagtcgttaaaaacacctataaaagttgttcctataaataatattttatcgctaataaatcttttggataatcagttctagacgaactgatggtcgactataaagaaaagacaattatatacataaaatttgtagtaattgaactacatactgagaaatttcggctacttcttaggtccaacaatataagcatttctaggttatttttatcagattataagttgaggtgattaatatggcaagtactcattccaacctaaacttgacttgtatttacagctaattttatatgttataagtactggacaacacgcccgttgagatcgaatgtctggtgacttcataaatattaagatatctagctcggtttttaaagatacttataaagataaaatatacatgtgtgcatttatagaagtttaggatcaccgtgcacgctcacttttactgattccagattcatatctgaatcgtcgaaagtttgtgcaagtcaaaatcttcgccgggcttgtccaagttgatttagaaatcatcacaatcaaaggcatgctaacatcgattacaatttacaaaacgccatttaggtgatctctcagcctgatgtttcctcagtcatgtacaacttttaaggggcggaggcaaggaggcaagcctagggcagcttgggcataagccctaggcttgccaccataaacttgcctaaatccttttaaatcaccatgtattttttttagaaagccaatatcctattagatgagccctacttaagccctaggcgtagaaaatttctggctccgccacttaatacaagtacaacagctctgcaaaccgcagtcaattccattgctcttcatcgattctttggcttttaaatcactcctggaacaaccatcagcgctatcagttagatgctggatcatgatcaccaattttacaggcgaatgcggcaggagacatgtcagatgttacatgggaacttttttcctgacgctttccaagtgcttcaggtgtgaaattaacccccgatctcctccgatttctgtggagaaagattaaccgaacaagaaccaacaactagctagcatgatgcgtcgatatagcttgagagaggagccaactgccggctatctcattttcagaagcccatttcaccagttcagtctggacaatgcctttgacactccggatatcagtcacgttacgtagctgcatcatattagttcctctgctgcaacgcacaaagacaccgttggttgtcctggacctggtacaacatcaattacaagttaattagcatttagcatcaacaatctccttcaaacgaaataaaaggcacctacaaatcttgaaggccaaatgttacttgatcatgtgtttaagataagctaagaattcatccaaagaaacgcattagattactagcatattgcccatgagttgcaaggatattttaattaaagaaaattattattaacccattattaacatatatcatcttttaatttacatatatatatatatatatatatatatatatatatatatttgttaccgacatatgtattctctaggctccacactatctttttttcctttccataaaaaataaggagttggtggtggtggtggttgacatatggaccatacatttccttttttttttccaaatagtagggagttggtgttgagagtggtggcagattcaccactcaccactactctctcttttacaggagtatcgatactgttcaccaacactagcacccattttacctgctctctgttttgttatttttgaacaagttgtgtgatataactacaacagcagaaagcactaaggttaatatcagctcacttgacacgcgacaagcacaatccaaattccagaatctacacaaatacaagcctataatgtgaattgtcattggtatatcgctggataatttgattgtcattggaatacacacacacacacacacacacacacacacacagagagatgtaaacaaatcatcaaactctaccccaaactaaaaatttatcaaattatcaaagcaacatatcattggatcattggatgtattccatgtttcttctggaaaatgaaaaatcaggctaaagttggttcattgtcaatgccttataatatacatccaagtcaaactccattgatgcaattatttggggattttttttcaaatttatttgatgaccacgtaattaggattggcatgataaatggtacagcatgtatgaatagtttgctttgatttaccgcagtaataagagggacaacaacagaagtagtcagtgacaaattgaataagactgaatcaagcagtactacagtagcatgagcaaattaaaggaagttaaaaagaaagaaaacgtactagaaaaaatggtcaaacacttctacacaagaatacctttacacagatttcggaaagctgcacgctgaagtttcacagataaaaattctgtataatatctccattcacacggatataaggaatatgagcaatctttggccagtcttcgcccctactcttgagccacacatcttcattattttccagttcatctgaattattcttcagccagtcctcttcttcattctctaaccactctcccttatcgttcagatgatctgtagcactctccacccactcttcctcatactttaaccacccttcccagaactcacatgttttcttctgtcggtactcgtttatcgtctctttatgccattcccctctcttcttcttcacccatgtctctccatcttccttctggcatcgtgcctctagtataggtgagcatcctaatatttgtaactctcttaggttacctggtaggcctttcaatggtagcgagtgaatttggaaacatgactgcatatttaacttcttcagggatgacagagtgaccaagtttgatgggagctgccttagcaggtagcaacaagagaactcaagctcttgtagggatgtaatctgctcaagccacttctcttggtgaagagagatcacatcgatcttgtggagacacagagttcgaagtgctgaaagcttgcaaagaaaattatcaagatctgaagactgggaaaggttatccattgtaaggtcagtgagatattgtaaagtatgcataaattcttctttttgcggagaaccgggaagggggagttctctcctttttgtacccagctctttggctatattgaggagtccacttttgagaacaagtgactggtctttgcccaaccttatttcccagttagaaaacagtcggttaatctcttcctcaactgtcgatatgattttgcggcagccagaaatatgtagatttttaaggttgttaagacgaagaattccaccctcaaagtatagctccttacaatttgaaagatgcagattctccaatgatatcaggttttgacatggaaggattaacttctgggagcaatcatttatgctcaagtgtgtgaggctagttagtttttgcaaatacctgaagactgtttcagcatatgatccacaacccgtaagagagagttttctgatagctaagcccaaggacatcaaaggtagttccctcaagttatcacatctattaatctgcagattttgcaggtttgaaaagctttcttcgttctgtgaatctgcccaattttccaacttccccatagactcaaaacacaggatttccaaagatttaaaggccacatttgaggttccatagacatcagaactaacatccttcatggagggcagctcatgcaaaattagtttcctaagatgctcaagctgtccaaaaggaggaagcacctggagttctgtacaatggcttatctcaataacttttatataccggagttgtacgacccaatctggaaaagccaaacctgtgtagccaaaaaattttatcgtctgcagatttcttggtggggacaaacactctaatatctccatgtcttgatcaggtttaattacctctggtggattcatcagatatcctgatatatctgaagtataattcttctcaactaagctagcttgaagtggctgcttttgacctctgtcgaattgactcaactcctttccatatagattatatttacctctagaagactgatttctatcccacttcagagctaaacaggtaacatactccttccttcctaagttagcctgaattgcctcttctcgattagccaccctctgtagatctgatatacaaagggacccttggatatacctcatgtcctttaactcaattaacgtgtgaccatcctctgctttaacacggtattcatataagtcttggagcctggtaagctgtccaatgccatgaattaaagcaaccgtatctgcatctgcatgcaagtgccgtaggccaactagtgagttcattcttcttggtaattgtgtgaatctacaacctctcaaaccaagaacttggagattgcacaagctacataatgaatcagggagtttggttatcccactgtgtgaaaaatccaagtatctgaggtgagtcaaatagggcagcatctgatgtgttgtggtgaactccacaaattgtgcaatgccatcttcttcaagtggataatcaccaatgcatgctgttgctgaatttgctctcaagttagataagctcaacaagcgcaagcttgttgacctatttagaatgctaccaataatgtcacaataccttttcaaaatgatagcaacgatatcaacttccccatcatcaaaactgaaagaggaccactcagaaatgttatcagcagtgtccttgtcagtagtgttataagacctctcagaaatgctatcagcagcatcataactgccctccaaaatgttgtaaatgttgttgaaacctttgctagagttgttatgacggaagccaccgaataatattaatgatcgcaactgtttaatgctatactcggtccatggtatattcatagcatccatatctacggacaagtgacgtacacttcgtgggagatttcccattgtacaatcaacaccctgatattcattagaagataaggcgattgcaaagtctctaacccaactatgcataatataccaagctttccaaactgtcggttgtaagaagcacttattgactagttcatcaaaccattcaccagctacatcctccagttttcttgcaacagtagtgttgtccagttcaacaaaaccattagctatccacatttggatcaactcatatttttcaaataaataatttctaggaaagattgaacaaaataccaggcattgcctcaaatatgcaggtaattcactgtgacaaattccgaaagatgatattatgtgaatgtcgaagctgcagcttgaaacattccaccaccaactttctaagactctcttccaatacgcttcatccaaacaatttcttaatgatgccccaatgaatttcgctgccaaaggagatccatgtactttatctacaatttttctaccaattggttctagagcttctgtactttgataactggcaaatgcatgatgcttaaaaagcttccacaggtcatcataatgtagataatccaaaaatactggagttgtagttcccacaaagctggccacactatacagattggttgttactaagacaacacttccaggtgctcccttcttcagtgcactccttaaatcgccccacattgcacgtatctcatcagatacatcatcaagcacaagcaagaacctcttgccttctatgacgctctgaagttggacacggaggctgtttagactgaaagcatggtccagcatattatgctcaggttgcatcgatacaaagatctgcgccatcggttcttctttcctgatgttgtcagtgaaatacacccatgcggaattaccgcggaagtgctcccgcaccctttcgtcgtcgaagatgaactgagcaagagctgttttccccactccacccactccaacaattggaatgacagttggattgcacattgaactgacagtgctgctctgcaccctggtgtatttcactctgctgcccatttctttctggtatgctgctgctgattctgcaggttggtttctctggtcagatagatctatgctccggagggcatcgatgatccatcctttccgagaaatctgtgatccatcagcacttgccctctcctcaaccgattcatccgccacgaaacgggcatcatccagtatcatctccaatatgacacctatttcctcatctcgcccaacaacaaagggttggtcagggccagggggcaaagcggcgacgtcatcccccggggtttccagtccatcctcgtccaggcccggcacgggaagaagcgattcgacctcggagcacgcgctgacgagcttgccgacggtgtacttcaccccgaggaggaggctgctactatcggaagctgcggccgccgcggaagcctccatggcgttgaccagctcctccgcctcgtcggcggcctccttcacctgccgcagccacgcggccgcctcttcctccctgtcggcgtcgacgccctgcaggctctcgccgcggaggatgctgagcttgtcctccagcagatcgagcatcttcatggtgcccctgtacttgtgggcgtcgctgctgcctcccaggtggagacgcagcttgccgaccaccctggcgatcgccgccggcagcggccatccgttatcttctactagctcctccattctcgcgattcgcgagttgcaggggaatggggaatttgggcggggtgacagtgataacgacagagtgaggctgcgtcaccgggagagagagagagagcaaggctgtgtttagtaggggaaaagaaaatttttgggtgtcacatcagacgtttgaccggatgttggaaggggttttcggacacgaatgaaaaaactaatttcagaactcgcctggaaaccgcgagacgaatcttttgagcctacttaagccgtcattagcacatgtgggttactgtagcatttatggctaatcatggcctaattaggctcaaaagattcgtctcgcgatttatagctaaactgtgcaattggtttttctttttgtccacatttaatgctccatgcatgtgtccaaagattcgatgtaataggtgaaggggaaaacttttgggaactaaactggccccaaaggtaagggcccctttgaatcgcaggattgagaaaacgtaggaataggaaaaacgtaggattttgataggaatgtaagtgtaaaacaaaggattgcaaaacacaggaaaaatacaagaatgactgtttgattgaaccacaggaaaaacacaggaattggatgagagagatagactcaaaggaaagttagcaagaggttgaagctcttgctaaatttcctccaaaatctctataggattgtccattccataggaatttcaaaggattggataggattcaatcctttgtttcaaagggcttcataggaaatttttctataggattgaaaacctctaaaattcctatgtttttccttcaaatcaaaggggccctaaaaatgttggattgcggtatgaccggcgttgacagcgagactttattttttttaaagggtgaatagctaagagcacccgcaatggtaaagtaaggtgctctctataaaacatgtacatctcagcaataaactcgattaatagtaaaccaccttaatagtatgtctacattggtatctatagctctctcatgcattgcctcgtttttctctatagactatctctaagttagtagatagttttgctctctctctcttcatttaataccttccaagtaggaaaatatgctgacatggatctcttatagagagcctatagataaccattgtgggtgccctaatatggttcctaaagtgctttgggttcagttcaatccttgaggtttcaaatcgtccaaagaaagtcctccaaaataatcatttgtgttaatatagtccttggaccacaaaaagtgacacgtgcgtatgccaagtcatcctcatatgcagtgatataaatgaaatggccattctactcttatatactatatagaaaagaaaagaaaaaaagataaatgtctcacacatgtatgatcgttttagaattgtcacttacgattgctgcagctaaccactaatcctatcttactataaagttagtggggtccttaagcttaacatgcaaagatgtcacatcatcatccactaattaacaagatgccacatcatcatccactaacaatcatcatatttaaacatcatgcaaacaagctatatctttatagtttttataatttaagagcttttcaaatagaaacatgttaaattatcatccaacataattcacataatgtttcaatgtatatctttattatgttttatgatatcctatatacttatatagttcatcctcacttaatctgatgttatctagctatcttacacgttatttttttattattatcatactaaatttccgcagcaatgcgcggggtttcacctagttgtataaattcctttgtcggtcaccctccgcaacaatgttgggcctggactagcctgttatttttttttctatttgtgtctttttttttattgtggtatataagggtagaatggtcatttcattcatattgctacatgcgaggatgacttggcatgctcacgttgcatttttttgggcccaagggctatattaacccaaataattattttagaggacttgtttggacaatttagaacatccaggactaaattgagcccgaagcgaaacttcagggaccatattggctatttaccctttttttttaagaaattacaaacacactcgtaacgcatacactaccatatatctccaaaatactgaaccgatatattttaaaattgatggagtcatcacgaatgccttactgtcgacggaactaaaaccaataaaaagaactcacctttgaactttttttcgtaacgaaaatatggaaaagtgtcatagactcttagtgtgtcgttaaaagaatgagtccatctcataatataagggattttgcccatataatatgtcctacaattttagggatttggatcccaaaataatatactccctccgttgtagaatataagaaattttaggattggacacgcttattaagaaagtagctagaactgagtggtcgagggttgtgattgaatatatcaactgttatattagtttattttttcaccaatcaactcttgtattaacttattctccatctatcaaatcttatactattttattcttccatctatcataatttatactatgttatatccttttactatatccttaatttatgtttaaaacgacataatccttatattgtgggacagaagaaatattttactaaaacaattaatagtaccaattgaaggagctgttaatacatgtgtattcaatttaatgtttattatcagtacttgtttgagttacgcaagccactaccctcatctttaaaagacttcatttttacttatggatttgaacaatttgctcgtaccattaggaagacaatcccttaaattagccataaataataccccattcgttttaaaatataaatatttttaggatttaaaatttatacctcaataaaaatatttctacggcacttatttcaatacaagaaaagtccacacatttttaattcaaattcaaattcaatcgtaataggtgctaaacaacccttttactcactttgtttcataatatattggatatgtttttcttctgtgcaaaaaattaagaaaatagtataagtaagtcatggtacaaaagttgacaagtgagaaataaataggaaaaaaaactaatataaaagttactaaatgtttaacaaagtttcttatatttcatataaacgaaaaggcacataatctcttatactataagagggatgaagtgttttggagaactagggagggaggtaggcctagtacataactcgaaccctactcctatctccaaaattatggccttgtttagtttcctcttttttaaaaaaaaatcattagacacatgcatggaacattaaatatagataaaataaaaaaactaattgtacagtttgtatggaaaagcatgggacgaatcttttgagattaaatagtccatgattagtcctaagtgctacggtaatccacatgtgctaatgacggattaattaggcttaataaattcgtctcgtggtttctagacgagttatgaaattaggtttttttcatttgtgttcgaaaaacttttccgacatccgatcaaacttctaacgtgacacccaaaaattttctcatcccgaactaaacaagacctatgtttattcataaattctgtagaaatcagtaattttcggcttcgccactatttagatcgtagagagtaaaatcgaaaagaaaaactcggattcgcccatggttttgcacggagccattcggtacgggctcgatcgtgggaaaaatggtattgaaagcgaaaaacccaaaccatggtggtgccgacttgaatccaaccatagcatccactgcgtcgcgggctcgcggctgcctgctttggtcaactgcccacttcgaccaccgccgagagctcgaggaatggtcgggccggagctgacggtcggcgggtggttcgccggcgccgtgatctccaacttggtggcgaaggtgcggtccgccatggagcaccacgccgccctccgggccgccgccggcgacatgctgtacggcgtggaggccgcgctcccccggatcaggatcctcgtcgaggcgaccgagcgcagggccatctccagggccagcttcgccgcgtggctgcagcagttcaaggacgccgtcgccgaggccgaggacctgctcgacgacctcgagacgcggaggatccgggcggcgctcagggccaggggcagcaagctcggctccgccacgtccctcgcgctcaggttcctcaggaacctcgtcctctccgatggggatctccagaggctcaaggacgtcctggccaagctgaacaggatcaccagcgacgcgaccggcttccacgacatactgaaactggccgacgacgacgtgggggcgatgcgatcggtccttccggtgccagccaccccgccggcggtcatcggccgggacgaggagcagcagcagcttgtgaagatgattttacgccccggcgcaccgccgtgtcctcaggatggagctgaatcctgctctggtgtttctgtcatatcagttgtgggagcagctggtgtgggcaaaaccactcttgctcagctgatttacagtgatccaaacgtcaaggaggctttcctgttgaggggatgggtgtttacctctcgtagctgcagtcgaacgggtctcgaacaagatatcatcgagtcttttgcgtctgagcaagaggaaaatctgcaaagaaagtcggtttcatcagaaagcagtttgattgatgtcgtacgaaacaagaagttcttcctagtcctagatgatgtgcagcataatctgcacagccaatgggattccctaaggtcgacactggcaagaggagcaaatggcagtgttgtattgctagtatgtcaatcgaaagaagtcgcaaatagtttgggagcgacagctcaggttccaatgggttacctgccatctccagtgctctggagagtatttgagcaccatgcatttgggaatcagaaaagagcttccctcgagtcaattggtaaaaaggtgctccaaaacttgcatggattgcctttgctggcagaagcaattggaaggcttctgagacaaagattagataaggcgcattggcaaaaaatttcctcgagtccctggtggctcttttctgaagatgaagacgatgttgcgctaccttcagtggcaattatgtgtgagcatctatgtgatcatcttagaaagtgtttgtgctattgttcaatattcccatctggttatttgtttgaaaagaatatgttgattcacatgtggatagctagtttcatgcaacaacatgacgggattgggatgaaagaaatggaaaaggaatggtttgatgagcttttccgccgatcattctttcagcccacaatctggaaaaataggtacatcatgcctgatatgattagaaagccattatgttccattgctggaaaagaatgccatgctgctagtgagttgggagaacagaaaagacggctccaagattaccgccacctagccatcagttttcctgattttaatgtgcacctagacttgagaaaggacaacaagttgcggaccattttgctttttgatggtcgcaaaacaatcaaaccacacgaagcatttgctaatattctgtcacacctaagtggcctgcgagtattagatttctcttacagtgaagctaaattggagaaggctcctgatttcattaacaaattcacacacctaaggtttctggatctctcctttactgggatgacagtacttccagactccctctgtaagctgcacctactacaagttcttggattacgaggatgtcagttcaaggagttacctagagctataaatgagttagtgaacctccggttcttatatgcagaagctcacacggtttccttgatatacaagatagggaagcttactaatctccaagggttagatgaatttcttgttggtagaatggatgggcacaaaataacagaactaaagaacctgaatgaaatcagtggacaactatgtattggaaatctggacaaagtagcaagcacagatgtagtgagtgatgctgaattattcaaaaaaaggcacttaaagaagttggtattcagatgggggttgacagcatgcaaaccattagccgaagctgatggtttcatgagaactcttgctggcttaaaaccaaatacaaatcttgaagaactgaaaattcagtgctacatgggagttggatttccatcatggatggcggaagagcagtacttcatcaatctgcggcgcatccatcttattgaatgcaaacaattattaacacttccacctcttggacagctcccatcccttgtagttttaattcttcaaggcctaacagcaattgagaaaattggatatgaattttgtggaaaaggatacagggtatttccatctcttaaggaggtgacatttcttgatatgccaaattggaggaagtggtcaggcatagaagaactacaagatttgcaaattcctccatttccacagcttagaaaggtccaaatcaagaattgtgaggtcttaattgacatgccagtatgttgtttaaaagcgtcacttgaggagcttgagatctctggttgtaatgaaatatttgcctgtaatccaagctgtttagatagattgacttcccttgtgcgcttgaagatccaccattgtttgggcaaaatttatcttccatgtcgattgttggagtcaattgaagttttgaatctccaaagatgtgaagtttatttccagggaggtaaagaacatttaatgaaattgaggaggactgtaacaaatgatgttcatgaattgaatttggatgaatcgaaagcaatcagtacagagctgttagttcttaaactttctgaaggtatgttcaattatttctttgtccaaaattactttggacaaataatttatgaaatagtatcttttatattcctgtgtctatattattggtttagaccttggaagtatagactaaagcttctttgaattgttttatattttcagggtatcactacttgtcttcatgctttcttaacaaatggaattttgaagcatcttcagtttcctgaaacaagttggtctgatgcaaagttagcaaggatgaaagaaagtttatgctactgcttttagggcatactttagtgggttcactctcattatacaagctaaaatttgtataggtgagcttgttgaacataaggtgcttctgcagggtgatctaggaggaacatgttggattttaagaggctaaagtggaggatttaggttttgttgaatcacttcaagtaggtttttccatgttgatagccaggccggacagaacttatcaaattctagggtacttattaagcattagttcattagggatgctgattaagaattctgcttattaaggttctggctccgatcagcacttgcaacaaatgctgcacattttagtaggtaaaggtgcaaaatgtgcatcgtgttgcctccgatttgtagttatgttcattacaatgaattagagctgagaagtgcaacaaagatgaaaagtatcaagaagttgaatgaagaaggtttgctgtttgcaatccatttttttatgcattgaaaaatagtttaaacaaagtagttgctggctagctgcggactgcggtcttgttatcgtcttatcctcttatataactagtataaatttagtacaaaaaatgcctagatctgtgaatttgcactttttcactctgacaacccaactagtgctaatttggtctagattccttcatctgtgaaagtgtgaatctgcccttctctgacgagcattttttttttttgagcaaagggcagagccctccatttccattaaagaaacgcatgagttcttacaaaaaaaggagtcttggaaaaccagaggggaagaacccccaggtgctcacaaaagaaacaaaaacaaaacgaaagccagctagcacaggccttagagtttaagctatctctccacaactcatctcatttctctccaattcaccattgtgtcctcaactaccagctaatcttctttgcctgatgcgccatccgaactgcgagttgaagacctcatttgccacttgttttagcagttgtgctccccattgcaaccttccttgtctttcccccgaattctgcaaaacagcccaatccgacaaaaaggaacaagcattgtatataatgtcagttgggttatttggtaagatttgatcaaaacaagccttatttcttgctttccaaatgcccaaattatagcagccacaccaactagcattagttgttttgtaatttgtcacaaggttgaatccaggaacttaaagcatgtctcaagtctttaatctgattcataccaaaagcacaaatcacaacattccaagtgaatctaactaagggacggtcaaaaaataaatgttgaattgtttcttctgacgagcatattactgttgatttattgcctagatgcatagattagtgaatttgcccacatctggcttcacatctcttaacaatcagttcgaacatttgcaggaggtggaagataatgtgttccattgttttgagcagggcagtaacatcgtttgaatttttttttattttctctttcctctgcaatttgctaactacaatttaccatgaaaaagatccagttcaccagcatgaacaaggaaaatccggaaattccaacaacattcaaccctgacccacgaagaagggtgcactggcgaaacatgagatgcgcaaatagcgtggcgtacctcagcctttcggcgttcgtcatgtcagggagagccgtggcctcagccgccgccaccgccagcccgcccgtcggagtccaattgaccgtcacgtctgagcattcggaatggtcgatcctcagcccacgcaaaacctgccatccaacaggcaaggttaaatggaaagggaggcgagagcatttcgtcgagcgattggtgggcacggctcacctgccgcgtcggaggccggagaggcaaccgcaaggaagtggagccgtgccactgcccacccccgacgcttgcgccgagtgcacctacccacgcgccgtcggactaccgaagtaagccgcccgccatccaccggacgactcctcgctccatcccgccatcgccgccttttagaagagagtcccggtgttctctgccagtagaaatctaaatttatatctagttttatttaggataccacctattaataatagaaatatgaaagggcataactgttaaataaaatatgaacgcggaaagctaaatttgtactactcttttgaaaactagcaatgcacaagtaaggatcttctaccctaatgttattatcattacagtcattaatatgtgtgtcatatttttttattgtactacatgtcagtttctgtaatgataataccattatattgcaggatgtgaatccacaatgtatgaacaccatccactcccctcgatcggagccgtcgtcaccgccgccgacgccatccattccttcccaatctccaattgcagtcgccgcctcgttgcttcgtttcctccggacaagggccatggaattggccggcgcatcgccacccacctggtctagtggtcttggtcagagttctgaggttttcttgtcacgcatgtgttagctcctagctaacctgcaaattagaattccactggcctcctcatccgccgtcgtcccgcctctgggccgaacgcgaattacgcacaagcatgcgttgtgtgcgtccgtgtacatgcatggtactaggatagatctggtaaaatctcctaccagaagaaatgaccattgtcaggtgcaggagaagcacagccaaccacaggtcatgttcagaactatctcattttgcaagctgaaacatgaaaattgaggttgaacaagcatctcgcttacaaatcataccattgaacttgcacaataacatagactacaaacaaagtactaactgattgcaggtactaaactgctattaactgataatacattatctaaagaaaagtaactgataataatctagaccacaaacgactgaggtggtgtttggatacatagactaaactttagtctctatcacattgaatatttagacattaatttggagtattaaacatagattacttacaaaactaattacataaatgagagctaattcgtgtgataaattttttaagcctaattaatctataattagcacatatttactgtagtattacatatgctaattatggattaattaatctcaatagatttgtctcgtgaattagtccagggttatggaatgagtttttgttaatagtctatgtttaacactctaattagtgtcaaacatccgacgtgacatgactaaaaatccgatccaaacagcccctgaatatcctcgaactagctttgcactagcactgggaagccgacgctgaggcagacgtcaggtgggacgccgagacggggaggtcctcaccgttgccgtggtgacgatgtcgccgcagggcctccgccgcagtcatcttatcgcgatgtccttcgccgcgtccgcgtcctcgccactggcctcctccgcgatcggctgactaccactgtcgtaccaagctagcacagccttaccgcctgctagctacatgcgcgggcctggccgcctcgactggcccaaccagcccaatcccttcggctctccgtcgactacctctccgcgctattgttcaaccccctcgccctcaccatgtggaagtccgtcggcgtgtctccacctggtcgatccctccgtgtcaacccccagcagcatcaacctccaccctatcgaggcaggcgcaccttctgtttgaccacgtgcgggaggacaccgcgacaagatgacggccgtggaggctctacggcagcatcgtggacgggaacctaacatggaggtagcagaaatcgaacaaggatcgaaccggaggatggtgatcgaatgatcgataaggtccggagagggcggcggagcaggggcgaaggcaggccagctgacgaagacagtcccggttaactgggctcggccctggctgctgcacagccaccgcggcagatctggggccggcaagcccgcgcccttgaggccttgagtagttgagtcttcttgagtctctcgactcttccgaggacgccgagctgatgagtcttcaccaaatatcttttttttttcttttggagaaaacaacttatatgtccaatatgatataatcatagaactatcatatagtgtaatgtacggaatttcagctcaactcgttataatgaagataaatttattcatgaactggtatcagttttttaaagataggtgacctatgaatttgtatttttttccccttactccttccgtcccccccccaaaaaaaaaaaaacaaaggccaatatggacagacctctctatttctaggttggctcttttttttttttggacggatgcagtatatgttttcaattgaaactagcatggttgcgcgggccagtattattatattttctctcgtataataatatatatatatatatatatatattctcaatgtattatttaaatatattaaattcacaacataattttaaattttgtactacctttacgaaactactaatgtataatattcatattgtattttatatacgtattagttattaattatttgtaatatcaaattttagttatttgtaaattatattcctatatggattctatactcgtctttcaattttttttaatttcgaattttcgttatctatatagactctaggctcttcttccaatattatttatttttaattctgatttttattacttctaattgtatttctacgtgtactctaaactcatctttaaatattctttaattttaaattttgaaatttagttatttgtaaattgtatttttatatgaattctaaactctacttttaattttattatgtttattctaaattttatacgtgtactctaaactcatctttcaatattctttaattttaaattttaaaatttagttatttgtaaattgtatttttatatgaattctaaactctacttttaattttattatgtttattctaaattttagttagttttaaattcttatatggactctatattaatgctgaatttctattatttcttaattgtatttctatatagattctagtctactcttccaatatttcttattttttaattccgaatttcaactagttctaaattgtatttctatatagactctgttttttctttttctccgattaatatgagaatttgtaggccatgagagcgaacgtggaggctcctttttctattcctttaataagttaataaatacgattacaacatgctatcgatttcaatgattatttaaaataaaaattaatcatcaaattgagctaaataaaattttatcaaagtaaatactttgtgtccaagtatttttagaaattttcttgaaattatttgagcactagaagtatttttcaaactttagaagatcattttgaggattaatttaatcagagaagtaattaaaactccctctcctttcgggtcagaactggaaaagtatgcttttcgtccctcctccaaccgacctagtcgcctcctctccctcccaaaagtccagccggcttccctcagcccctcctctctctggcgtttgggccccacacccacagtgcgtcgtctttaagctcgggatggagtccttatagcacccgaccccatctccaggcaatccgactcgattcggcctctctattgcttatcctctaaaattgatcacggaaaccaaatccccttgatctcctttcctttttccctcaactaatttcgaaaaatcttgaggatttgggagaatgaagaccctgatcggtgaaccaatccatgtgtactactaacaactaatgtactagtaccactgctctatcttttgctccaacaatacatatatatatataagaccaagcagcccaccccctgcgtgggccacgaatacggagaacaattttactaaaatgatgcaaagcctagatattatttcctggaacgtgagggggctcaattcggctgcgcgctgtaacacgatccatgagcttatggcagacacgaagtgcagcttggcatgcttccaagagacaaagctacagaatatagatgacggtctcgcccactttttaggaggctacaagctcgacaaatttgcctttaagccagcaagaggcacgagaggggggatcctcctcttatggaatagcgcagtctttgacgtccaagaggtccgagtcggccgcttcttgatttcggcgcaagtgacggtcatactcacaggggccacatttctgctcaccggagtttatgggcccacaaggcaccacctcaaaagcgccttccttcggcacatcagaagaataaggcccggccccgaggatggatggcttatccttggagattttaacatgatctatcgagcaagggacaaaaacaacagcaacgtcaaccttgcacgcatgagacgctttcgctcaacaatcgatcgatgtgaactgcatgagattcccttgcaaaataggaagttcacctggagcaatgaacgacgaagggctacacttgttaagttagatcgctacttttgcaacgagacttgggacttggccttcccccaccatgtccttcacgccctacccacagggccttctgaccactgccctctagtcctctccgacccccaatgtccatgtaggccgagtgccttcaagtttgagaacttctggacaagaattccaggattcaaagacaaggtcaaggatgcctggtgtcagccttcgtcacacacagagcctatgcaccacctaaatgaaaagcttcatcgcaccgcgacctgtcttagagaatgggcaaaaggaatctgcaccgaggccaaactgcagtttcacatggcggtcgacgtcattaaaagactagatgtggcacaagaacatagagacctctctgcccaggaaacaagactaagagcagccctcaagcgtaagatccttggcctcgcttccattgagcgggcaaggaaaaagcaagcctccagagtaacacatatccgtgagggagatgcgaacacaaagttttttcatctcaaaatgaatgcgcgaagaagaaagaacaccattcatcggctgaaaaaaagacaatggttgggctgtgacacatgaggagaaggaagcaacgatccatgaccattttgcgagcataatggagcggccggcgccaagaccaaatgagctaaattgggatgcccttgacatctcactgattgacctagccaccctaggggagcccttctctgaacaggaagtacatcaagcaatcaaggaaatgccaagtgacaaagctccagggccagacggcttcaccaggattttctttaaagtctgctgggaaatcataaaggaggacgtccttctggtcttcaactccatttacaatctcagatgtgcacacctgaatctgatcaactctgcgaacatcgtcctaattccaaaaaaagagggggccgagggcgtttcagacttcaggccaatcagcctaatccacagtatcgctaagatcttctccaagatgcttgcgttgcgactaaggcctcatatgcacagcttgatttcgatcaaccaaagtgccttcataaaagggagaagcatacatgacaacttcctcttcgtgagaaacatgaccagaagataccatcgattgaggcgggcgatgctgctattcaagttagacataactaaggcctttgattcagttcactgggattacctgctagccttgctgcagcgaaggggtttcccaacaaagtggatagattggctgggggctttgctatcaacttccacctcccaagtacttctcaacggcttgccagggcagcggatcaagcacggaaggggccttaggcagggggaccccctatcgccactccttttcatacttgcgattgacccccttcagcgaatccttttcaaggctatagagctcggcgcaatctcaaaaattcgggggagaacaactaggctaaggatctcaatgtacgcagacgacgccatcatcttcattaatcccacccgaggcgatgttacggccttcacggacatcctgcagcacttcggcactgcaactgggctcgtcaccaattttcagaaatcccaagtggcggccatcagatgcggcggcatcgagttgaatgaggttcttgagggcgtccctgtggtgagggcaaatttccccatcaagtacttgggcctccccctagctctgggaagactgcggaaggtggacttgcaacctgtctttgacaaaatttccagaagggtagcaagctggagaggaaaaaacatggcagcggctggaagaactacgctcatcaaatctgtgctaacggcgcaaccaatctaccttctgaccgctctgaaaatcacaaaggaatccctcgagcagctagacaagcagcggcgccgcttcctctgggcaggcacgggtgatattaccggagggaaatgcaaggtcaattggacaaagacgtgcatgccgaccagccaaggaggattgggggtcctaaatctggacaaattcacgagggccttgaggttgagatggctgtggcatgaatggaaggaccagaccaaaccttgggtggggctggagacgccatgtgatgaaatagataggaacctcttcgccgcctcaacaaacataacaataagggacggaaacacggtgcgattttgggagtctgcgtggattggtgggtgaagacccaaagacctcatgccacttgtctttgcgatctcaaaaaacagaggaaaatcccttcggcaaggaaagaaggaggacgcctgggtgcaagatttgaagcttgattcacaatcatctatcacagtcgacctcgtcgaacagctagtcgcactgtgggaagcggtccgaaatgtgcacttagacgttggagaaccggatcagattacttggaagttcacaaacaacgggcactacacggcctcctcggcttaccatgcgcagtgctgcggggcgccgagtacaaacttcaattccttgatttggaaagcctgggcgccggggaaatgcaaatttcatgcttggctcatcattcagaacagagtctggacttcagaccggcttgcgaccaggggatggcagaacaatggttgttgccctctttgccgccgcgagactgagacggcattgcacctcgttgccacttgtagatacaccaagaggatctggcacctcgtctctgcatgggtgggctatcagcagatggacccaacggaatgggaggaagcccggtcagtcaaacagtggtgggagaacattgcaaacacgcctagtgtcccgaaaaaaggacttcgatcgctcattctgttagtcgtctgggaaatttggaaagagaggaatcggcggatttttgatcacaaagaggtggcaacgaacttcctactaatgaaaatcaaagaggaggcgagcctttgggctttagcaggagctaagcggttgcgtgagttaatcctgcactctgtatagtgtactagtgtacagctatagtggttctccgttttccttttacccttaggggtttgtattttctcctgctctattcaatgaaaaggcactctagtgctgttttccgttcaaaaaaaatgtttttcttataactacttatctgatctacgatccaactacaacattctatttgtttgaatctttataacaccaaatccacgcctagatctagcagggaggcggtcggaggcggggtcggcggcgggcgaggtctgtctccgcatcggctggatctggctggtcgacgacacacggcggcgggagctcctatggatgtgacagccggtgctgtgggcgacggaggaagcggctggcggcgatgatgcgacggcgtggaggcacgtgcgacggcgtggaggccctggagaccgcgccagtggtggggagagggggataggaggccacgtcagcggcggaggtggcgccatgcgcgtgcgctggtggctgcggttggccggagaggtagaggctcggccgacagctcgcgacggcagaggtagcaccggcttgccgaaggagttgcggctggcagccgtgcagcgcgagtaggcatggccggcggcgttgaggacggccggcgcgtgatggatgcacagcgggaggtgatgttggcggaggcggagcccggtgaggtggctgcacgcggagactggctggtggggggcgccggtgcagtgtgcccacacaccggcggagtttttgatggcggtggagcaatggagttttcagtggtagattggcaggtggtgaacggcgggtgaaaacttaggacagcctcggccatactgacaatcaatggcgcttaaatgacattcccctcctgagggcattgtcgtgctgtcacaccctaatctggcaccaccgtacaacggcacctgataggagcgtgtcgtaggaaaaacggcgcgaaccgcttcctacgaaaccgcgatcacagtaccagtctcaggacatagcgctggtacccacagtgacaaatatgaaacattgcaatccttaaatttaatagaggacttatttaccttaacttaggttgcagcgcaggacagcctgagaatataaccgacgatgcggacgaggaaacaccaacagcagcagcagcagcggaaccaacgaactaacacccaacaccacaggcgacggctgggaaccaggacgaaaccctaatcttcaattcacttcatcgtcacttcaaggcagaggaactatatatatttatatagagcaagggtgagtactttcgtactcagcaagtcacgggaatttaggtgtttgatgcaagcttggaagagaggcaaggttgttttgcaaatcctttattttgaaatcattttgaaatcactaagtggtttacttctttctaagtttgggccgaaaagagacttgcgtctcgattcgactttaagagatgtttttcaacaactcattaggtaatgtaccgacctcccaggtcagatcattacttctcggctcccagagccatttcacttgattagtcggctcccagagcctttttcattttctgggactcctagagcccagctgcccagcagcacaacaatccgcttccactcgggaagcctagtctatgatgcccgtaaacatcccgaatcacacagattcgtttcttgaccactcaggttatccatctgccacataagctgattctggtaacgattcccaaaccacaacaacttttcacaaagcacagacaaacaaatctacgctacaggaaacacctcacatccgcccatgaccatgggcacggctgttcgaacagttgcggcatatgcagctgcgcaatatacaggcatatgcatgagatcaatctacatgcatacgaggacaaggactagcatgggagaaaaggaaacactacatgcatgcttcgatgcctgctagtaattaattagcacaactaataaccagaacccacagagttttggtctgtactctgtaattgattggatctgtgacttagcagtgttgtgcatatgcctgaccgattgatccgcacgcttcttgccttttgggggtaaaatttgtgcacaccatcggtgaatatattctacgtgttcaattcaaactgttgagaatctcatcgggttgatgatcagatcaaatggatatatatctgtttctgctttatatgagaatgagatagtgcatttggatagtaaagatgggcaataatgagctcatttttttactcagcgcacttctttttcctcaatataatatcaatactgatggtccattttctgctaaaagtatacctcagtagcatggccattaaaattttctttcctttgcaatggactatggcataaacataactgcatagctgcatatgcatgtcttatgaagtaattaaaaataactgatccagccatgaacaacaatgccttatgcgctgccataatttatgatccagcattagatctgagctaggaggtaatatctgaacatcacttctgctatttgatgaacatcatattttcatcatatatactttctttttccagatttcctggtatatattcacatatataaattgtgtagattttagtagatcttttcagttagagcatgaaaaatatcatggtttttagatggctgttgtaggtccaatgcttctcttacaacaaaagaaacctgctatatattcacatatataattgttatagcttcatgaagaagaaatcaaggctgtaggatgacgacgttgctgtgtaagaatcgtgaagaagaaatcaaggctacaggatgatgttgctgtgtaattaagagtcatgagagaacatgttgatataaagggggagaattttcaacaccttgctgcaaaaataaatttgaaggttcatattaccgtgacttgccttcattgcaatggcttttgtctctctttttttatttttttttactgaagtactcatttttcactcctgtttgcttttgttaagttccgccaccgtatagaactaattaagacacgtggttcaatatctggaactaatttgtaaatattttgtggaatgtcgtaaacatgagccaagcttttaatatttgtggccattaggatttgaactctggtgggtagagtcatgcacccaccactctaccaccacactactagtgctttcccacactactacaaaaaccatttttcgtggcggctattttgggctttcgcttgcggcatttggcgctgccacaaagcaaaggccagtgaaaatgtagcatcttcgctgacggcgataaaccgctaaaggagataacttttcgctggcagctagctaaagacagccgctagagaaaatcatcttcactggcggctgccttatgtgggccgccagcaaaaatagccttcgatggcggctgccttatgtgctcctccagcaaaaaatagtcttcgctggcggcttcattatgtgggccgccagtgaaaattattttccataaaaaaaactaatccccaaaatctctttttgccaaaaaaaaagaaaataaatcagattttcgcagcatgtacggattcaaatccacatccaaattttcgagcatcgattcaaatcctcatccagagttcattagattcaattaacatggaagtgagcacagcatacaagcattttgaacatgaaaataaaaagaaaaacagcatcaatagaaaagaggaaggaggttgtcggcgccgtcgccgaccgagcagcccagccactagcgagaccgtgggggggagggggaggagctcgccacgccccctgtcgccattgtcgtcccgtcatcgcgcccccgcccctcgtcgctgttgccatcccatcgtcgtcgtgcccccacgacagctcctcccgttgccgctgtgcatagtgtgtcttacctagtagtagtaggaatactttaatccctattgcctcctcttctaccacattgtggatgcctcgtgccattgatcccatggatactagtacgagctgtccgtgtaggttgccttcttatatattagtatattcatgtgatagaggttgcgagcgcagtaaaggagctagagcaaattagaggatgtgcaccactattttggtattagagtactcaacggtaataaaataagtacatctattaatttttaacatcgataatttgatataagcaacgcaaataataatgtaagaaataaaattatagcgatgaaagtgattatcaaaatgggaaacccaaatgataatattagttagtatagtttagtgaaaaagacaatagaaatcacaaataaatggttacccaaactgaaaaactatacaatttgacatcattgtcttagaaaaaacatagtttaatgttaaaaaaagggaatatccaataagataaatacgatatatttaatttgtttattatatatatattactgatagctcaattacatgtctatataaatattacatattttaaaccgtgtggctagtaacacaaaatcaatgtagcgagtgaggagacggcaatgctaaatattcgcccccatacttaccgcattaaccacttaggtaggatacataacttcgagtcatgttacaatattatacctcgtcatattatttatccttattagatctcgccatattatctacccttattagatctgacataatcattcgatcttgattcgatcagtagaggtgacacaatcattcgatcaatagaggtgacacagtaaaatagacggtagtggcggcggttgaggagtcggcagaacacctaggcatccatgggctttggccgcggtatgtgccgttcgttaaatgttaaatgttgtgtgtcacctacaccatagctgcgacgacttctattgcagtgaagatcagcgtgcccttttataaccgtttaataagattaaattattacagtctttaataagattatctcaatttgtattaaattattacattaacatatattgtcccaaaatgtagatatttttgaggtgaccatgagtattaagaaaattggtgaaaataattagaggaaagttgtgattggttaagaagaggaagtaggtgaggaaattaaatgaaaattggtgaaaatgattggaggaaggttgtgattggttaagaagagcaagtaggcgaggaaattaaatgaagaatgattacgattagttgagatctaatcacaatcaaattctgttgacgcacgtgaaaactaggcaataaagttataacaccgagcattttgataaattactttgctcaaactgggacctaacatcaccagcagtaaatttttgaaataacattcatctataagcaaaattacttccaaacatcactttggtcgttgatgttaaaaagaagcaaaattattttcaaaagcattgtttcaattgctgttaaaaatataaaaaaaaacttttttttggttcacacctactcacctgaggtacgttttatcaacttatcatttaatgcttttttagtgagcaacaactgtaaacagtaggctgtattgatataaacataaccattattgggttgagatgtcaaattctgtatgttctcttcaaaaaaaatatgtatgttgcattctgtattaaaggagtgtgttcttatctgagatgttaagttcttcaattttttgttcagtatgggagttttcacagcagatggttaatggtttcaaatttttggggtattttacaggtgtttgatggctatggttatacatatgaagtatgaaggtccatggttgatgcttggttgacttccccagcagcatccacaatgtaatcaggagtgcattttggcaggtaagttctatagcaagtatctcaaaatgttattctggtggtactcataagattcagagggtttgacctcagggaccataggatatgtcccttgtgctgccgcatccaccgtgagggggagaagggagggccaagcaggaggagagcgggcatggcctggtttcacgacagacgccaggaagaaggaggttggagggcgaaagggtttatgatggccgcaacttgatgccttagcgacagctcaagcagtgtgatggtggtgtcatggcctccagatctggagcgaggaggttgtggtggcgcctcgggttctgaccttctgtaagctccttctgcccatgtaaagtttatgtaaagttctctcttgtgtgatgtctattcaggtcctcctccccatgattctttgtgactgtgttggatccactcatttttgttaaagattgattctgttggccgtgttaagatttattcgaggcacaggctcttgcttcagtttatgtgatgcagaatgttggagaaacaagaatcagggtcctccctccagggccctggtgtgtcgttggctgtatatttatgcaatcgatttggcctaacaaaataataacgtaatatgatataaaatgtgttcccattgcaacgcatgagtgaaatttcacatggtattcaagaattcaaatttgaaatagtaatatcgatctaaatttgataaaaaaatgtatcaaaatttggtgaaaaatgtcatatagctcagggttggcgtatgacctaaatcgaaaaggtgtacctcggctacaaaggcttagttgtgtctggattatccaaaattaatcatgccatataattcatttaatactttatatcttttaatttgtaaacaaaatatcatttggtaacaaaatactagctcagtagctctcagggctcatatttatctttgatgaatcatgaaagggctatcggcggggtaaatatcgagctttgaacatgatttcttttgattcccgttgcaatgcacgggcacacaactagtaaaaggtaatatcttgaatgttcttatttatcttaatttattgattgtattgtactttttatgtgattaaaatatataaatataatacgtgccgtgtttggttgtacttatcgagcgaacatatccgccccatcttttttataaagctgcgtccgccactgactagggagagaggaagcctatgcacacgtggctgggtgactggagaggaagcggatgtgcgcgtggcagagagaaagaggaagcagatgcagatctattgggttcgatggcggtggtgggtaaatttacataaaatttgtaaaggtagtgggtctttagctacccaataatatataaaaaaagcatgtttagaggagattgccagattatacttttctagtttatatattatgataatctatcataataatctacttgtttgttttagattattgcgaataattcatattataataatcctaagctgaaaaaaaatactcttagaattaaaacgacaagtaatttaaaatggaggaagtgctacttcaatatgaatatatgttctaccctaaaaaaaatgaatatatgttcgatgcccagacctgtgtgctgcaaagattaattttgctaactacgaaatcatcatctattcatcgcgagcactcgttgatgcattgtgggctgtgcgacgacgaggacgacgtgttcgtccgcgtcagcgaagccttggttgtttcgcctgccataccgtctgattgacaagcgccgccatccctgcattgcgatgcagctgttccgtcgccgtcgccggccacgccgtcctcgtcgtcgtcgtcgaagagttctccgccttggacgtacacgccggcgagcctcccgacggcgagctccatcctgaccttgttcctggcgtcggaacgcagccaccctgtcaccacctccgccgccgccctgcaccgccgccgccgccacggccacggcgccgcccagcaccaccgcgccgccttcttctccgcctcgacggccgcctccatctccccgacgaggtcctccagctcgttcgtcgccccgtccagccgcagcttccactccaaccgcgccacccgcacgtcggggtcgtcgtcgtcgccgccctcgccgcgcccgccgccgccgagcgggagcgcgcggagctgcgcctccacgatgtccagcgccagcagcgcggactcgtacctggcgtagtcgtcgccgaggaaggcgcgcagcttcctcgccgccgccgcgatcgcggcggacaccagcgcgccgaggtcgtcgcccggcggagaaggagaaggagaagccatgtcgctccggtcgctcgtccgtcgtcgcggcaaaccacctgccgattccggccttgactttgatttatagcagcggcatatgcaggggtgagtgcacgtgcacctgcgcgcgtgcacgtagtacgtgtccgagctggttgctgatgtgatccacttccaccatgtttcggactcgatgatgggccgcgcgaggggggcggagtagtgggcttgatgggctgcgcgctacagattgggctggcttggtgcgcgttgtgagaggcccagttcggcttaggttctatctatcgaataagatcactttgggtccctctatttgtcgcccagtccgattttcgtcccttgaccacaaaacccgggtatgacccgtcccccaacttacgaaaaccgggtaaacgtggtccctcggcggttttgaaggtggttttggctgacgtggcgtctacgtggcttgtttgacttggttttcgtcccacgtgccattgacgtggcgcttacgtggcaattatatctcggaaaaataataaaaagcgtggccccacatgtcagctgcacaaacaaaaatagtttttaaatggtggggcccacatgggccccacatgtcagcctaattcatctcttcttccctctcccttctctctcttctttcctttccccctctctctctctttttctccttcccaggcaggggacggcgcgggtgggcggcggagcaggcgagctccggcggcagcggcgggcgtggtcggcgccgccccccaaccggagcgccggcggtccgcgtgaaggcaggtccggccgtccggggaggtccggcagccggtgctacggcggcggcggccggcggcgggagcactgggcgggcagatgaacggggcggcagcgggcagagcggcggcacgaagccgaaggagtgccagcctcgtcatcgtcttcttccggcgcatagtcgtggagcggcgggcggagggcggagcagatgggcggttggtggagcgacgacgggcggagggcggagcagatgggcggttggtggagcgacgacgggcggcgggcggcgtggcgagagcgctgcgagggaggaggcgaacttgtcggggcggccggcgggagaagaggccgcgcgcgccggtcgatgggagtgagggggaggagcgggggtcggtagccggcgggagtcggcggtgcgacgggcggcgggcggcgtggcgagagcgctgcgagggaggaggcgaacttgtcggggcggccggcgggagaagaggccgcgcgcgccggtcgatgggagtgagggggaggagcgggggtcggtagccggcgggagtcggcggtgcgcgggggtcaacggttagcggaggtggccggaggaggtcaccggcgagcgcgggctccacgtcgtcggctgctccgcccgagatgcccagcagaacggcgccgcccctcctcgctcggtcgccgagcgccgcctccctcctcgcttgggtgccgcccgccgcctctcctcgcccggccgccgccgccgacgtcctcgatggtcacatccgggttggagccctccctcctcgcccggtcgccgagcgtcgcctccctccttgcccggccgccgtgcgccgcctccctgctcgcccggctgccgcgagcggcccctcctctcgcccggccgccgcgcgccgcctccctcatcgcccggccgtcgtgcaccgctccgcccatcgcccccgctgcgccgccgctcaccactgtaagggagagagagggggatagagagtagagggggctgacatgtgggaccacaggggccccaccttttcttattatttttgtgtagctgacatgtaggtcccacatttttttattattttcttaagatcctattgccacgtaagcgccacgtcaatgccacgtgggacaagaccaagtcaaagggaaccacgtaggcgccacatcatccaaaaccgggcacaatactgtcaagggaccttttttgcatggttttgtaagttgagagacccgtcatacccggttttgcgaccgagggacgaaaatcggactgggcgacaaatagagggacctaatgtgaatttattcctctatctattccccgggaagggttttttttattaattaccaggaaaaaaatacccgtgtgttgtaacgggtgaaggttattttaatcttattattgttatacggtttagttaaggtgaaattcactatgggaattcgcctggatatatactttttttagaaaatcatgatcaatttagcatgcgattaggagtccaatcgtctcaatttagcatgcgaattttttttaagagatttcttatacgactcctatattttcaaaagcgaacggatttaaaaactgactcaaatacgaacatgtatttgcaaaagtgaacgaacttaaaaaccgactcatacacggatgacgtaccaaattacctgtaaaaacatttttaatttttataatagtagagatttcggcgatttttttggtctgtgattcgaattgtaatatgttgttactcctccgttttatatcatattagttttgacttttttcacgtttaatcaagtttatagaaaaatttagcaatatctgcagcaccatatattagtttagataaatgtaatattgaatagtatattttaggcaatatatttgttttatgttaaaaatattgctatatttttatacaaacttaattaatcttaaaaaattctaaaaatattaaaacaatttatataatatgaaacggaggaagtgattatttaattaattaatcccctcttaagtaagcagcggcgaagccatacaaaagtagtaactaaggctgtgttctttgctcagtgttctccaacccctctctctctcgtattcctcgcgcacgctttttaaactgttaaatggtgcgttttttttaagaaaaagttcctatacaaaagttgcataaaaaattatattgatcatttttttttagaaaaaaggctaatacttaattaatcacgcgctaatggatcgttccgtttttcgtgcggatggaatgagttcccaacctacatgaacaaacgcagcctaagttttgtctaaaatggagtgatcgaatagtactactagttattctgaaattttctgaaatgaaattcgaataaagtttcaataatgaaatgggcgttattagcagtactccactaccgcttgccatgcacgaacggtgcttctacgtactactagcctttacactttccacttctcaagttttcaccctcgtccctcagacttgatgaattttttttagaaataatattattttaatagaaaaatataaaagtagaagctgatcggctaaaattacaagtttaatgccttgtcgaacatccacagttcaacaggggtacatacagaggcgggcccagagggtagtccaggtaggcccaggactaccctagaatttggcccagaaaggagcatatattcattttttatggcccataaacaaagtctggcccaacaaaaaaccctaactttcctactagcctcctcccggactcccagtcacacgcgcatgcgccgtcgctccgacgcctgatgccgccgccaccgctcccgtgtcccgtgaggccgcgacggcgcaacggcgctctgcccctcgcgcggcggccagccggcccccttcccgagtcctgacggcgccgcgacggtgcactgcccctcgcgccggcggccggcctgctcgccttcccgagtcccgacagcgccgtgacagtgcagcggagctctgcccctcgcgccggcggccggcctgcccgccttcccgagtcccaactcgcgccatcgcggtcgcaccgcctcctgcctcctcgacgcgcatcggcgcgcgcgccctacctcggccgccggcacccgccgcccggccggcatcccacatccggcggccctccccctccggtgagcactgcgccactgcttctctggcagtccggctctcctctccctcagtccctctactctcccccttccagtagtcagcaggcagtactacctccttctataatcaagttctttatatccatgattagctaattggggatatagtaatttgtatagattaccacgaaattgtgcgccgcaatgaacctcatatggcatttttgcatggtgtgatggttgttaggagattgaggaatgaagaagtcgagcattgtatttctttttcagaagcatgaagcaaaaaaagttgcatcttgtgatctaccaatcccacctatttgttattttctacttgtattgaaccatttagagttatatacccgtatcgtttaccagattttatatcgaatcatgatgtattgcatttagatttttttcgctaggcctaccctgggttcaaatcctgggtccgccactaggtacatatcgaacaaccacaattcgacagagtacttgttgaactgcggttgtttaacagggaataaaaaaatatcttaccgaactgcccctgttcgacaggggataaaaagtgatagaaaaaaaaggagatcaatcagtgcgcactgtacactaccgtgcatgcagatctatgttcgataggcccctgccatgctctttcttgtcctttttctattttttaagtgaacaacaatcctgtcgaacaactgcagttcgacaggtacatgtcgagctgttcgacaggtgttaaatttgtaattttagccgatcaatttctacttttacaatttttctattaaaataatattattttaaaaaattctaaggtgtccatcttcttcttctttttttttcacagttcaaggtgtccgtcttgggaaactattctaatccctcgaggggatgttccctcgtttgctcaaaaaccatctaaacaattatgaaaaattttggaaaaatttgacaacattcatacaacacatatatataactccacaaaatcttaagtccaaactcaactcacacgtcgagatataaaaaagacaaattcagcatatgaatagtagcgtactgtttatatataaatttatcttttttgtttctcaatgtgtagatcgaatttgaacatgaattttggtggactagtaggtatcattatactctacattgtcaatttttttcagaatttttcacaactatttgcatcgaatttagaagaaaaagatatacgagggatgtcccatcgagggattagaatccactcccgtccgtcttggcaagtaattaaaccgtactccacacgtggcaatgtttggaattaccatagcgccatgcatgcaagggcgcccaagtcgtctccactaactctacgtgaaaaccaaataacgcaacgaatgtgatgcgattaaaaacgacagcaatctgctcgtgcaatttaattaattaacgagattgatcaattgatcgttgcttcttctaggcagagtgtatatatattaatggtccatgtggagcaacttgaactgcaattggtaattaagatcaataaaaccatcgccttctgaggacaagtctaataaaagagtaattaagcagccatctattagatgcttacatgttatttttatataattaaagataatataaaaattaaccgagccattattttttttctcgacgtgggccaagccttggttctctctcgtaggctatctaccaatcacagatgatcttttcatgtgggcccaccttaattatctctcacctaatttttttcaccaatcaatttagtcgaccccttctctatctccactccctctttcttctagcaatgcaaaataagttgatatcaacggctaatagtaggcatattttccctattacacttgccctaacagatcaggataattttctaacggagaaaatacgtcaaaaattttattttttgagcgaatagaaaaattaatacgtcaaatttgtgactgataccgacaagtgactactgatattttatgctaaggccagctatagcaggaaacagctagagagagaagaattctcgtcgcatacgacattggaaatgaaatggaataatggaagaagctccgcaggttcatgggattgatgactaccagagaggcacggaaacaccaccggttcttgctgttgaattccaagcacatgctttctagaattccagaaccccatgagagcccagttaagttgagttgatctcgacgacgacgacgacttctgttgatcgagataaaacggttgggagatattccgagattgagtagtattcaaagctattgatatgctgatttttcgtctttgaccaccttgggttacttggaaaagtattggggtttcatctactagctaggttgtttgttttagtaggagtagtactgtagtagctaacttggtggctacgcagggcatatatgcatgttgctagaagatgattagtgtgtacacacgttttaacgaaattaattgtgcaaattaacgaagatcatcacttcattagtactccagtagtttataatcaatagagtaactattggtttctaacgagacaaaatactcaatgttttaaagcaaagagagtactgtattatattttctctcgttgaaaaacagtcacaaagttgtttttgatgcgctcacgtgacacgtgtgcactttgcatcccgttcgttgtatccgaaaccctctgaacacgcatcatgtctggaacaatcattgactaatctttccgattaccttggggatcaccacccgcgtagccgcctagctctgaaccccagcagtagttgaatcgagtcattgctttatgatgcactgccgtcatctatgtatcttttagggtggtcaaagtaaacaagttctgtcgttgaataaatatatactgctgtccagttaactgtaatccttccgtttcagattataagtcgttttaactttggtcaaagttaaactactttaaattcaactacatataataacctagaaccagataagacgtatcccagtacttgcatattcgtagtactagaatacgttctatccgattctagtttgctatattttgggatggagggaatataacctaggtacacagccaatggataattgacaaaaagaatcctataaataagaagaaaatgtatctaccggaaaacatatcatttctaaatagtcactgctaaaaaacgattttccaagaggccaaaagtggttttcgcgtgcggacctccggtccgtctacccgaaaaggtctgcgaaaatccaaattttccgtgcaagtggcacacccgcacgcgaaaattagtttttcgcgtgttgatgcttatgttgcccgcacgcgaaaacaaaaatacgaaaaaaaataaaaatcgcaaaaattgagctgctgtcgtcctcccgctgccaccgacaggctcctctcgccgccgcggccgtgctcctcccgacaccgccgcccactggatctgcatgggggatagccggcagcccgttgcccaccaccgcgcgccccatgctgccttcgtcgctctcctgttggctgccgcgcgcgccagcctctacagccgtcaccccacgccacccttcctgataacaatctggcccaggtggggtcggccgaggcccaacaaattaaggttgcccggaccccaacaattctttggcacacccactcggggaaaggcccaatctccctaaaagactagttcaataggggaagggtggctctcccttttaaggtggcttcctcctcccaagctaagtaaggtgggattattcagttcagaggctcacacggtcgccgcccgactttgtcgtctttgccagtggataatagtggaggatgtcctcatcacttctgccggccactgcgtgcctctgccgccgtcaccccacgccaccttcaccgtccttccgccggccgctgcgcgccagcctcttctgccgtcacccctcgtcgcctgcactgcccttccgccggccgccgccactctcccggctaggagagtttgagagagggagagagagagagagaaagaggagaaagtaagagacaaatgagagtggggataaggatgagtaggtgagagagatggagaggataaggatgaaaattttgaagtgatgggaggaaaaaatctagagaggagggagggtattttcgcgtgcggttctctcaagaggtccgcatgcgaaaattcaattttgtgtgcagccctttaagatatctgcctgtaaaaataggctaatttttgtgtgcatacccttaagagacccgcttgcaaaaatcgaatttcacgtgcggttctcttaagggtccacacgtaaaaatgggaggacgatttttgtagacccgaccagttacggttcgtctgcaatataaagaggtccttgtacaagaaaatcatttctgtagtagtgaaccattgcgacaattagctagcggtttctcaacatgaagatgtggtttgaaatcattgtgaacattcgaaagccacccagtaaacaaaaacgtgagacattggttggggggggggggggaatagattcctcaatctatcatcgtcgttggcgaaaggaggaatagatgggtgtggctcactactgttcgtccgatctaacaagagaaagacccttttttgcagtgacgactggggatcgagatcgaggccttcagctgtgaacgccagccgtcaaagtgagagctgaaataattcaacacttttgatggtgtggccaaacatacagcaaacgtacgttagttagctagccagtattacaaaatacatttcggtcgctttcaagttaattaatttcaacggtgaatatatagcttattccgtggagtctagctagtgtgaagaagtaatagcttttccatacgttgacaagtctccagctattcttcttccttcattgttgctaaattataggagccatttctagaagcagaccctggaaaattggacttagaatagcgtgtattgagaatatatggcatgcctgttagataagttaggttttatctagtcatgtgtccccggcatcttcttaattcttatctttatctaaaaaaaaccttcttaattcttatattaattatattgttgtatgcaaaacagcataggtcttgactgaagaaactaagaaagaaaacctgacctagtttcaacagatttatttttttttgaaaaaaaaatggtcatgcatgactgatcaacggccaagatagaagtgtacgttcagtacgtacatgcaagctagttaagcttaattactcgctatatatgaactctagaaaaaaatagttaatatcaagagtcaaaattttgattacgtcccaagcatccagaatagtagaaacaatctacaagctagctcttgtaattaattaaaagcaccattctagaaggtcaaaattaattaagaacagcggattcccctacacacacgttcttaactactattaactccaagatgcgcgggatggatggtttatctagagcatggattcataaatttttgtgtacgtaatctcgtatattacgacatctttcaaagctagatgtactataagtaagatcgatctctgactcatgaggttttcattatgaatttaacatatgcattaataattaattaatgcactaccacagtttaagcaataacatcacgtatttttataaaattatttggcgagataaatccagcaatatatcattcagtagtccatcacaactaagtactatccccgattttaataattggtgtcgttgacttttaaacgaacctttgatcatatcgtattattcaaaataataaattgtattattatttattttgttgtgagttgagttatcattaaatgtgctttaaacatgatttatatttttcatatttacattgattacattgaacgagacgaatgatcaaattcatgttcaaaagttaactgcgtcaacgatcggcattccttgcatttccaatatcatcaaaacatctttctcatgctactcctagtccttggcactcacctcctgtaaatcattctaattaaccactgaaccttcctacgtcgcctcgagccaattaattataattcaattgatttgatcaattaaataacgacaacgtgcatttatcttcccgttaattagttcgttctccaggaccaggaaccttcccttcaaggcttcaaatctgcagcgtattatataacacatccggaaaattcacacggacaaatgctgacgtcgacgtacgtaaggtcactgtacccagtcatacggtgcggctgattaatccaactccctacatatataaaccccccatctcccgccaagcctagcaaccacacggcgacggtcagaacgaacgcctcgccgccgtcgatcgccggcggccggaactatctcgcaaagtaatcgatcgaaggtatcaaaagcatcatctgagctgagctgagcggcggcgcgatggcgggggagataaccccgtcggggagccggcggagctggctgtcgtcgggggcggcgtcgctggcgcggtcgctgcgcgacggggacgacccgttccggcggtcggcggcggcgagccggcgcgacgccggggacgacgaggagaacctgcggtgggcggcgctggagaagctgccgacgtacgaccgcatgcgccgcggcatcctccgcaaggcggtggacggcggcggcgacggcgagggggccgggtcgctgttcaaggccgacgaggtggacatcgccaacctcgacccgcgcgagggccgcgagctcatggagcgcgtcttcaaggccgtcgaggacgacaacgagcgcttcctccgccgcttccgcgaccgcctcgaccagtaagcataaaaacttttcttcttcttctcagagaccatatttacgtgaggactgtggaggggatacgagcgggtcaactcacgaacccgtttataggcaaaatgagtggataacccgctggctggcttgcgggttacctactaatttgatatataaatgggtttatagttgatccacttgcttctctatgacgcggcaagctgagtcatgacacgaaaacccgtagattactctttatttaacatataagtaaattcgtgagtcggcccgcttgcatccctgtgaattttaactatttgaatcaaaatttattgtgaatttgcttcgttgatttgtagggttgggattgagctgccgaagatcgaggtgaggtaccagcatctggacatcgaggcggacgtgcacgtcggcaagcgcgcgctgcccacgctgctcaacgccaccatcaacacgctagaggtatatacacatgtacatcgctcagctcagctcagctctctagtgtgatcactcaacaagttggatgtgaagatcagtggcgccttaatacttaatttggggcgtacgatggattttactgaaattttaaagggattaattaagaaaactgaagggtatgaaaacatttttgtctcttaaaaaaaaagtcattggatgaagccactagataagtacatcaatcgaaacaagtcaagcatgcgcagtacaaaaatcaagaccattttattgtccgactctggagagagagattagcttaatttggagctagtagattcttgtacgatgtccactagcttagctcacgtatgactgtggggtccaccgtagaatcttgataaatagtaatgcgtaaaacggccggtcgcgggttctcgcggcctgcaaatttggaaggaagctcatgtgttcatgctgatgagtggcgattagtcgccggttagtcaaagcacgtttttggagctgtgttcggtcggtagtgtttggaatttaaagccctcacacatgtagaacagttctagtgactccttagcttataattaattaattattagttatttttttaaaaaataaattaatatgattttttaaaaacaactttcgtatgtaactttttttaaaattgtattgtttaatagtttaaaaatcgtgcgtacagaaaaacgggagaaaagtttgggtggtttcgacctttgaccagctagctgttagtctgttaatgcccacgccctgatcacaatgcgtgatagaatttctgacagacaacgacgcctatagaatacacaatgcgtgatagaatttcgcggctagcaggtcgtcgcacacccgacgaaaagtcccacaaaactgcacacgcatggtacgtacgtagaattagttagtactagtcagtaaggatcaggtttcccagaccgccggcggtaagcacgattatcacgcggtaaccgtaaaaaaccgtgtaaaatttatcaaaaattcaaattatttttcaaatttatttaaatttaagggggttatcgtggttttttattactgtaccccgcggtaagccggtaaccgatggtaatgtaaaccctggtaaggatagatcgagttgtactcggctcgagatcttctagaagttatagtgtactcacgagatctttcagatgtggtaagtttctggtgctgggtttaagttttcgcgtctacgcttacgcaaacgacaccacacgtacacacaccggccggcagaaaagtttatgagatttccatatatatatatatacagtacttgccaatctcggttggtatagtacatgtactaagatcacggaaggaaagggtgtcaaagtcaaacacatgatgatttccccttgaaacttgaaagtgcacgagcaaaaatttcaaaacaaaacaaaacaaaacaaaaacgtgcacgaacacgaagatgtgggcttttaccaaaagccactggttgaggcctttccaccggcctatatagcggcccacttcttcgcgagcccaggcccatcagaagagaagtcggcccacaaatggtggaccttgggcctcgcctgccgctctggactctccctcctcgagcgggcgatgggcgatggcggcggaagcatcccgcttccgtcgccggctcgccgccgctgcggcggaggaacggcgagggcggcgcttgtcggccacgcgcggtcagtggtggtgcggcctctgcagctctgctcccccatgcgtcggtccgcctcgccttcgcctcctccagtaggagccgtcggttcgtgtgtttctccccccattccgctctcgatccgttcccttctccatgcgggaggggggaggggggggggccggttgctgacgccgtagaggcagacggcgccaccaaaaggcctagttagggtttggttgattgatgccatcgaacattcccacacgatgtggctatcggtttggagagggcgtttcgttggtactaatactagtaatctgaactagcaaagttcattggtaatttttttttaatctccagttgttaagttttgacgagcagactcgattttgctgatttgtggttgtagtggcagaagttcgatgagatgctacctaatgcttagcgtcgcttacttgttacttgctctggctcaaacgttgttttttatgcttcatgacagggtctcgttagcctatttatctcgtcgaacaagaggaagcttaagatactcaacgatgttaatggcattatcaagccatcaaggtacttggaaattctttgatactcagctatggaacgttttaatccaatcgttaatcatttctagtcttaaatggaactttatgtttttaagctgcattctaattctaactagtttgataaactatctgtaatttattaagtaatttctattcccaagtgatacagatatagatatgatctctatgatttatgcagacatggttactctgcaatttaacttttttccccttcataatagatttgaagcatggcctgaaaattcagaaagaaaaaacgtatacatgcaaacatcatactgtagtaattacccacaaaaaacagtgtaaaaatatgatcctatgtctactgcaaacattatctgtcttatttgtgcagtgcagatatggtcattaattaattttaaattagtgataactaaatggtttctcttatattggccatcccttttcccatcagtaacaaaatgaactatctcatacattaatacatatcatattgttccaattgctattgctacagacctactatatccttcctaacaacaagttccccctgtcccctctagcattcttgctaaatgattggttgaactatggctgataagccgtagaaatataaaagaagaaaccaaaaatattttgaactttttgtctgtattattcatggtttaaaagccatgctggaaaatagactgcaatgaagaaaaacctcaaaatcacctataaaattatgtttcaaaattcaattttggctatggatgataaaccatcaagcagacaataagagttatttacaattgttgcattaaactacttgtgtcaggatgactcttcttctcgggcctccatcgtctggaaaaagcacacttatgcgagcactaaccggcaagcctgataaaaatctcaaggttttgatatttcttatttagtttaatgtagccacctctaacagtagagtcgtaccacatgactaatcactcgatggctacaggtgtctggcgagatcacatactgtggtcatacgtttaaagagttctatcctgagaggactagtgcttacgtcagtcagcatgatctgcacaatcctgagatgacagtaagagagacactggatttctcgagacgatgccttggaagtggtgccagatatgatatgctgtcagaattaacaagacgggaacgtaatgcaggcattaaacctgaccctgagattgatgctttgatgaaggcaactgtagtagaaggaaaacagaacaatattgtcacagatcttgttctgaaggtaacactgtttgactttttacatgttaaaaaatggttatttaggccttctagcctcaattatccatctgcttcttctttttgttgaaatattaaaaggaagctatgtgagaatctattttctagtacaccttttttacaggaagtaatatacatgtatgtatttactttgactgtgatacacaagtgaaaccttaatacttctgtttatgatgaaaactgagtatgaattctaagtcaatatttgctgtgctgattgagtttataaatcttcacaggcgcttggactggacatttgtgccgatactattgttggtggtgctatgataagaggcatttctggtggtcaaaagaaacgtgtgactactggtatgcatgcatatgacatacattaaatatatcagtaattaatcatgttctccatgaaatttacttcaatcactacatcataatcataataattataacttaaatagggataatggattttctaactggaaaagttatttgtctcaaatcatattgttcagaagtcagtcgtgttccttttctcctgtggagcctggatttagccttagccttgtggggtctacaccttagccttttttatgctaaatcgttagatttatcaatatactataacagaatccaagactgaaagacaactcagccactgttttcctctttaaaccttttacactaaccggtacctaaaattttctagataaaatgttcatgagatcctggcaggaacaaattttgttctttttcgtacatggtcttttttgtactctaagcttgtcgtcttgtgcacatagaccatgtacaaaatggatccccactagcccatggacctgttgggaacatgttcggagtgggcctaacagtaacgagcaagcacatagatctattactgtcgatgcttggtgaatggtgattgatagtagagtcatgttgtagtactgatcataaatattgatggtcttgtaaatcaacgataatattcagcattcaataatttacagctgcatgaggaatcttgatattacattactgacacatttacatcctaagattggagttctgtcattgttttgttgcaggggagatgctcactggaccagcaacagctttgttcatggatgaaatatctactgggcttgatagttctagcacatttcagattgtcaaatacatcagacaggtgacccatgtgatgaatgctacagtgatgatgtctctcctacagcctccacctgagacctatgctttattcgatgacatcgttcttatagcagaaggttacatagtctaccatggaccacgggagaacatacttgaattctttgagagtgctggttttcggtgtcctgaacggaaaggagtggccgactttcttcaagaggtgacttctaggaaagatcaacagcaatactggttccttgagcaggatcattatcgttatgtgtcagtcgaagagtttgctcagaatttcaagaaatttcatgttgggcaaaagctgcagaaagagcttcaagttccctatgacaaatctaagacacatcctgctgcattgactaccaagaagtatgggttatctagtctagagtcccttaaggcagtgatgtcaagagagtggttgctaatgaagcggaattcattcctcttcatattcaaggcctttcaactgtttgtccttggatttataaccatgactctgtttttgagaacaaagatgccccacgagaaattttctgatacctctaaatatgttggtgctttaactgcttctttgattacaatcatgttcaatggttttggtgaacttcaattgactatagataaactcccgatattctacaaacaaagagacttcctgttctttccagcatggacctatggacttgcaaacatcattctgaaggtgcctttatcccttatggaatcatctctttggatagttttgacatattatgttgtgggttttgcacctgctgcaggaaggtaacttttctattttcttttgctttcctaggtatattatttttaatattttctataaacagaattttctactagtgattgacttgatgggtttgtctgtgatctgtctactgatttcaggttcttcaagcagtttcttgcatacttttggacacaccagatggccttggccttgttccggttgctaggtgcaattttaagatcaatggtggtagctaatacatttggcatgtttgtgctgctacttattttcctctttggaggatttctcgtttccagaagtaagtgtattgtcgtttgaagtgtattttaattcttttgtccatatgattagttagaagcattgtgaaaccctggaagattcattataacgttttccctaaggtttatatcttattttctctgaatattcgaaatattccagtctgaactactaacttatgtttcttattttcgtttttgacatttatgttaaaagaggacattaaaccgtggtggatatggggctactggacatctcccatgatgtatagcaataatgccttatcagttaatgaattccttgccagtaggtgggccattgtaagttttctgtcaacacaacccttttctttccagaagcatagtattttctttgcatagaaaaaataattggttcatttgcaagtctagatttttttagtatatattctcaacatcaactaagtttgatcgcctctaattcctagacatttgacaatatcaacttttaactgcagccaaacaatgactcaagtatcagtgcaccaacaatagggaaggcttttcttcaatccaaaggctacttcacaggagaatgggggtattggctttccattggagccatgataggatttatgattgtttttaacattctctacctttgtgctcttacattcctaagacgtaagcacttttcccttacatggtattgtcacttgtctgtaatgcatgcctttagcacttacacaatacttctacagctattggcagtgcaagcactgttgtttctgatgatgacaccaaaagtgagctcgaagcagaatctaatcaggaacaaatgtcagaggttattaatggtaatacagcagtcaatgtgtctcacatttcatcatcggtattgtccattcgtatcaaattgttcttgttgtcggccctgtttggatgaacattcatcaggaagcttacagaaacagaacatctatattgctggatgtttgatttattatgagattttatgagaattcaaatgggtcctgaattgtgttatagatggattctgctacaaatttcatagcagttgattctagcatcatgaagcatgttgtttgtttattattttaatgtgtatttgacatctcataatttatcctgcacccacatcattatcttaggtacgaatggaacagaaaacagaagaagccagagaggaatggtcttgccattccagcctctttccctttctttcaaccatatgaactactacgttgacatgcctgctgtaagttgatatcctaaaaatatatcccaacttacataaccatgtttgcaaagcttacgggacaaaacatacctcaatatcgtaattaatttcactttattcttcttatagattactactagttcttgcagtgatttctttttgcaattcaacataggaagtttgcaaagcttacgggacaaaacatacctcaatattgtaattaatttcactttattcttcttatagattactactagttcttgcagtgatttctttttgcaattcaacatagaaagtttgtaattctacttgctttacttagttctattgttctacagaaatatgtagtagctatacgttgttgaaattaacaatgtcctttatcatataatctagattgtctgactgttttccttattatatcattggattggtatcatactgtacatagtgattgtgatggcacggggttctcttgtgtcccctgttgcacttagatatttaactttgttaaggattaaatatgtgtattttatctagctgataaattactagttgtcattcattaaccatttattgaactaagttagtagtgatttaatcttgaatcaaggggtgcatttcaagtatgaacttgaaaatttaaattctaccttgtaggaaatgaaagcacaaggattcacagaaagccgcctccaactactatctgatattagtggtgcattccgaccaggtgttctaacagcactagttggtgtcagtggagctggaaaaaccactctaatggatgtactggcaggaagaaagactagtggaacgattgagggagatatcaagctttctggttaccctaaaaaacaagaaacctttgctcgcatcagtggctattgtgaacaaactgatatacattcaccaaatcttactgtatatgaatccattgtttattctgcttggctgcgcctttcctcagaagttgataagaacaccaggaaggtatgtgttcctattatttttgtggtggatgccatttagtaaactcaataactcatgatgtttcttggggggaaatcagaaaatcgtgttaattgtagttgattgtgtgtactgtccattaatttaatccacttattggtcactaattatatattatcacctaccaaaagaggccacacgattgtgtaggcttgtatattacccgaatctcgtccacatgcaagacacacttattcgttgagttcctaggaacctgacagcacactaaactgtcatttgccattttttatgagtactaacaaaatgaccatgctttgctatggataaaataaaatatattatcatatgtaatagataaaaatatttattgaatatgttagtattcacttgtttcaaccaaatatgtagactattccaaaatatcagaaaatatcaggggccaatttgtaaaaactgtaaacagcggtggggtgccaccaccaatagagacttttaaggagtatacatatacaaggcatttttgacaatcatgatattgaagaatagatgcaacatttttttatcttgtgaagttgaaaatactaattatttctgatgaaattaattccactgtgtaggtgtttgtggaggaagtgatgtcactagttgagcttgatgtattgcgtgatgctctggttggtctccctggtgttagtgggttgtcaactgaacaaaggaagaggctgacaatcgcagtagaactagtggcaaatccttcaattatcttcatggatgaaccaacttcaggtcttgatgctagagctgcagcaattgttatgcgtactgtgagaaatacagttaacacaggacgaactgtggtttgcacaatccatcaacctagcattgatatctttgagtcttttgatgaggtccttgctactttgctcttgtttgtttgtccgttagttctcctttcagcgctgtaaggttatactgaaaaatggattgtgttttttcagcttctgttgctaaagaggggaggacgggttatatatgctggccagcttggtctcattcacaaatactagtcgaatatttcgaggtgaactgtctttgatactatatttcagtctctatgataaccaatttgcaatatgttaaccatctgtattgctaaaatcagttaatacttctcatctattgtgacccatgaaattccattgggcaaacttggatggaattagtagcccgaagacatgcattttttttaattagtgaatgtatgaatactagttggtaatctatcaactattgaaggtcgtttaggccctttctagtgatgcacaaatgttcaggcataaatttcattgtccatgactgtatcattttagaacatgtgcagttaaaaccttccatcttaaatcaatagcatatgcaaatagacttttcacgagaactactttcatatagttacatctttttaatgatttttatatgattacaaaatgcaactatcaaacatgtgcattggagactctgaatgcagaagtaaaaaataatggagggagtagaacacattattgttggaactcataaatatttttttctatagtactaaggttgattcttcaaaactgcttgtacaattgtgcaacaaactctttttaatgacattgaggcaaagggcaactataccacctcaaaaactaatatctcagataaaagtaatttgtaattgtaaaactaaaagatatacaattctgtagtccctctttttacaaatgctatttcagaatatgtgtaacctgtaatctattgttttgagcaataattaataaaacttgaataccaatataagtgcttggatctatcgcacggaaaacaatattagtgtatttctcatcgacagtatttatataccgttgtgtttttttatttgctaacatataattagaaaagtaacgttcaaatgtttagtggagactatctcaatgcctagaacaaatgtttattaaaagagcatggggaacatgcatggaattaagagaacttgggtaaccgtattcaatccgagactaaataagaaagaaagaaaggctacttgcttctaatgtatatcgttctcctgcaggcaattccaggggtcccaaaaatcacagaaggatataacccagcaacatggatgcttgaagttagctcttctctagctgaggctcg

SEQ ID NO: 79141 - DNA, 3273 bp, Oryza sativa
atatccgatgtgacacgccaaaactttatacccttggatttaaacaccccttgaagcacttcgagacatcgctccagtaagagttggatcaagattaagtttttcatggcacgcttttcaaactgctaaacggtgagtttcgtgtgaaaactttctatataaaagttgttctaaaatatcatattaatctatttttcaagtttgtaataattaaaactaatcaatcatacgttaataccacctcgttttgcgtaaaaaacttaatctttatcttcaggagaaaagaacaccaatgatgattgtaaaattttagcaagatataagtacaataagctgcaccaatacaatataatgtacgtcgatgcatatacactactgcaaatagaacttgaggaagcttccgtccttcatttatgaagaaatagtcttttgggttgtttcagatatggatcagcatggaggacaactaagctaagtttgtaaactgcttaagcgggaaggtagcattcaagataaacaaaacgaaacatcctcgcaaaatatgaaaaaggataaacgaaatgagcatgtgcaagattatctagtgtacgttaccgattgacctggtagctgttctctcgtccatagctttctcgagctgggtcatatgtcagttatgtctaatccagttggatcagttttatagtagttaccattaaccgtggtttagccaggtccaaataaatccaatatttatcgggcaaaactccctgtccctgcaattgtaactgccaactcactttcacctcacgttttctcttggttttgttttagcccacgcgtagatggatgagccctctcctcttctggttatcatgtgaggttaatttttttttctccctgtgataaaatgatagtgtatagattttcaaagaagcatgagaaatgttgaataaatgtatgcttataaaacccatgaattttcagcatacacatttcaatgcacttctttttgcttaattagaattaatttacaaatataatagatttattttttatcgtgatttttactgaaaatggcgttaaaggccatgactaattttagtaggtgtaataagtaagatcacaaaatttttggacaattacttagacaaagtaaaacaaattaactaatagtacccattttaggttaattacaaatgactacacactaaaaattgacatgatttaatttcctatcgattaaagggaagacgcacacggacaccacgcgtgagaaatgataccgggattgatcgtaagttgatgacaaggtttctgactctgaaattaccttcactatgcatgatcctaacaaattatgggtactttcaaaattcttagcattaaatttaaataaatgtagcttaagaaacaaattaaacatcatatataatgtgtaaagctaaacacatatgaggtagagggttcatggaatttaatgcaaggaaaccgtctaggttaaaagaagaagttcattggtatgcattaattagcttactatctaagactaggcttttggacccaaagaagaagtataaaaatcttatccctaaatttatttccctttactttggtcacgtgtcttctgtttataaactgtaaagatgatttccaagtgaacctataaaaaaattaatatatctttagcaacaaattaaccacctcatataatatgtgaaaagccaaacacactatgaggaagaaggtttctggaattcagtgtcaaggaaactgcctaggatagaaaaaagaggtcatttgtagtatgttttaattagcttaaaggatatattgatctctaatacttccatctttggtgaatgaaaacatatagcgaggaaaaatttggtttattcctagaagtttagatgatacaaccgtcaatatttacagacagtataaaaattcactaatttcacctttcatagaaatacagctagcacctgcaaaattcattaactcagatatgcattgtgcaatcttaaggatacaaatgaagggcacctaaaattgcactgcacccaaaataagcacatatatcctatacatttaagcgatatatgatacgctgcatcaccttccgtccaattaactgcgaccaaatctgggtttatttttacttgccaaattcgaaaacattaaattggaaaaatgtgtgcacggttggttacagcccaagattagaggtgaaaatagatcaccagaatagctggcataatgaattagctccaaataaagctggcttggaagcacgtagtataagaaaggcagcaggtaaagaaggaaggaaactgaaacgggaaaagagatcaggtccttttttgcgaaattgcggatacacccttcccgaagagccccagaacggccggtcaacggcaccgttgaccgtatgagggggggggggcagtttcgtaaattccacgaaacactgtcccactcctcgtcttcttcggattgcctatatataaggccacacctcgtcttctccattctccgtctccaagttttttttttctctctctctttggcgccgttagcttgaggcggcgaggagctcgaccacttggaggacatggtggcgaagcgcggcgccggcgcttgtgccctctcctgggatgagaagggcgaggtgtcccccggcgagaaaaggaagagggcggatggggatggctcgtcggacgttggcggcggcggcggcataggggcgttcgacgcgctgcacgacgagctggtcgtgtccatcctcgccgacgtggccgcctccgccggctcgccggctgacctcgccgccgccatgctcacgtaagcgcccggcccccgccgttgggtgttccgtgttcggtttggatccgcgcgccgtctcgtgtcgtgtccgagtttccgttttggttcccgcgtgtgttgcgaggaatcgggccggttattgattgggattgagattttctgatcggagtttgttcggggattacaggtgcaggagattcagggagctggggaagcacgggctggtgctcgcccgggcctcgccgtcggccgtcgccgtgcgcgccgcggcatggtgcgacgacgcgcaccgcttcctcgtccgttgcgcggaagccggaaacgtcgaagcctcctaccttctcggcatggtgcgttgcgccgcgctgcttgcacacattccatttcttgttgcgttcctcgcgtacgtacatgcgacctctcgattgctcgagtgcgtgctttgattttttttttctttttcttgtt

SEQ ID NO: 79142 - DNA, 3113 bp, Oryza sativa
tttctccccctctgcatggtaaagcgcagtcttgagatcgccatgagtgcacctgaaaaaaacacgcagggagagaatttgaaatcgaatatgtcatcttcctcaagagctttctgtcgtgtttttctccttctcaatacattcaggcgaaaaaaataaattattttgaagctttttcacagtacaaactgatcaatgagggttgccggcacttgcaagaaaccagtactctgaataagtacacagtaatcagttatgtttatctgaatcgcttattatcaactaacaaaacttatggttaaacttttatatacgtgtttttagctatttaaaaataaatactgtaaaataaacttcgattggaaagctacaaaatcaactacaaagttaagtcttaaaatttaaatttttgcttataaacataaaaggaacgttaggactgccaatctctcgacattaatcgaacaagtcctaaccagtactccctatgttttatattataagtcgtttcacatttttcttagtcaaacttttaaaagttgaataagtttgtagaaaaatatactaatgttttcgatacaaaacaaatgttttaccaaaatatattaaatgttaaactaaatgaaactaatttagtgttgtagatgttgctattttttttaacttaggtggtgtttgaaactcatgtagataaagatgaagattaagagttttaattattacaaacttgaaaaatatatttatctaatattttagaacaacttccatatagaaagttttcacatgagacacaacgtttagcggtttgaaaagcatgctacgtatatccaaattttcatccaacttttgttagagaaaagaatggggccttagtcaaacttaaaaaactttaactaagaaaaaatcaaacaacttataatataaaatggaaggactagtaatttaaagttagactaggtgtgtgacaaaacggttacacgtaaattttaacatgtagaattcgtacttataaaaaagagtaaaatgcaccaacgaacttgttattaagtttcatttaggttcacgaatttacaaagcaatcgaagtccttaaacttggtttattgtatcatcccggtctaaagacttgtttgaccatggtcttgcctatgtggtacgccatgtgaatgatgacatggcttttttttcctttcccccttctctttttcatcctcttcttttatcttcttcctccgctagagccacctcgagctcctccacgccaactgccaccgacgccaagtgtcactgctgtaagaggaagaggctaaagggcatgatgcctaattggtggtggattggaggggcgaagttgcggccaggacgcagagcgcagcggcaaagccatctatggtggcggcttagcacgatggtagctagggtgtcggcaatgcacggccagagatcggcggtgggcggcggagcctgtgctcgtggtggaggtagggttacggtggtggattgggggagcggagcggcgaccacggtagccctcagagcagtggtgccggcggtgtgagtggagcagcgcggtggcacccagccgaaagatggtggcaagagggagcggcacggaggacgcaatagagggtacgacaggctcggggagttggggaaaatggtggaggggagcacaggggtggaccttatatgcttgggaggttggaatcgtgctcgaggcaagcagatttgaagtaggaggagaaggcggcgacgtcggctcgggcggctcggctcagctgccggtttgcgtacggaagtggggaggtgggcgacgaccgcgtcccccgcacgtgtggatgatgcgggaaggcgcgaggacaatggcgtcgtggggagcgacatgcgcatgaggggtggccatggcggttgccgatcagaggagaaagaaagccctgacaggtgggcctcggccccacctatcggcgcctcggcggcagaagcaagaggagggaggcaaattggagaaaaaaaggagaagaagggaggaaaaaagaaaaaagaagggagaaaaagtaaaaaaaattccatatcgtcatccacgtggtatgccacgttgataaaaccacggtcaaacaagactttggaccgggatgtgttagaataggtgtcgaatatactagtcctatttggttacagttggacttggagttgtaatagatgttgggggtggagttagagtcgaactctgtaacccggcatctctcttaaatagagagagggggcaccacaatgtaactatggcgactacaatgtagcgtagacacgcagggagatgatggcggcgtgccatggactcatagcggctaggtgctatgttggttggggaggagcgcccataattagagccccggggatttaggcttcggctgaaccttgttaacaaatatcgtgtgttcttgtgtcgtcatctggcatgtcttgggtgatcaacgactgaagcgatcgggaaagttagttgtcgttccactatatcgactaacttttataacaagtggtatcagagcagaaggtttcagtattggatcaagaagacatgtggagaaggaaacatgaggtgggatcgcgcatcgacaggagatcgtcagtcgtggcgatgagatcgatggcgacaacgaggacgttgcagaggcgacgacctcactcacgatcagactgacgatggcggagcgtgaccggaagacgaggccgggcgtggccgaaggcgttcggagagatcggaggggtagcgccatggacggcgcgcctgacgcacgcggcgaacacggatccgcggcggcaaggaggccactgacggaagggcaaaaccggctagcgtggcgcggcgcggcgcggcggacgtgcagggccgatgacgatgagatcgtggacggtgaacacgagggttgcgactgcggtgagtgcgagggcacggacagcatgtattgagtacgtgctatacacgcacacatgcacatattgtcatcgggagagcataatcaccacggtacggatgcagagatgtagaagagaaagcagagaggttgggtatgaagttgaacttgactcggagatgggttcacgatgcaaggagga

SEQ ID NO: 79143 - DNA, 14548 bp, Oryza sativa
  unsure (1)..(14548): unsure at all n locations
caaatcgcctcgccgcggacgctccgccctgtgctggtgctcacgccggtcaccgctgacgaggtgcgcgcctacgtcgtctgctgccgcgaccacggcctcaccgtccgcgcgcgcagcggcgggcacgactacgagggcctctcgtactgctcgctccggccgtccggcgacggcgagggggcagcacgtttcgccgtcgtcgacgtcgccgcgctccaggcggtgcgggtggacgcggcgaggggagtggcgcgcaccaaggcgggggccacgcgcgccgtctgccgcatcggcgccgctggactcccgcctcccccaccggtctcctccggaagcagatcttagagggatgtacttcgcttcatcagcgtccattccgaatcctacggcgacggcgcgatttcctttttcgtcgtccttcggcccagtagctgtccagcgttcggcccagttgtcagttgcggaggccgaaggggaaaaacagagcagcgaaaatgaactagaaaatgaaacagagcagggaaaatgaaacgccagcgaccgcctccttcgtcgaccacctctcgccgccgctcgtcgcctcctgtccaccggcgctggcgcgagtggagtaggtaccctcagccgcgacgctctcgcctaccctcagccccgcgtcctccccgtgcgggaactctgctgcccctccatggatgtcgaggtctgccgtctccgtcgacgacgtcggcctcaacgcctcctggttcgaggccaccaccatgggccactgccgcgccaccgtgggagggagggctgctgctgctgccaagcccacaccaccgcaggaggaagggcggccaccaccaccatgggcatctgtaggagtgcgacggcaacacaagccactgtagcagcttgagaagccaagagtgagattgagaaatgatatgaattgatgttgtaaattgatttgaattcataatgtggctcaaactgattgagaaattatatgaattgatattggatgtgtttgtcaatttgtatggcaaaaagagattgattcagtatagcagaagaatcaagaatgtcacttgtgttgctgttgctgcattgaacatatgtgatggctgagtttttatacatatacagatttggttccagaatgtttgcttgcaaaatggcaaaagaaggctaaacctgactgttgtgctgtcaatttgtgagcagatctgaacatgcttataaactaacttctccagggcagacttttttgcttgcttgcaaaatgccaaaaaaaagaagagcacaactgaacatgcatacaaactaacttgtccaggacagacttgttttcttgcttgcaaaatgactaaaaaacataagtacttcaccaggacacaagctcttcagtaaaaccatcatctgtgattggtcactgtaaaaaaaacaaaaataagtaagatttttctaaacattatctcctctagatttgtaaactaacttactgtcaacagttgagtgaagctatcaatggcctcgtaatcttcaggctccttccatttatccataggagcactatcatctgcaagttgttcttctgcatcacctacctcttccctaaccttttgtatcttgcagacaaagaaaatttgagggtttagagaaataatggacagaatgataacactggaaacataattgttcttcagcaacataccactgattttttttgttttgttttttcattttttcctctctttttcctagtcttctggtttttatcgagccaacctcttgttcgttttgaacttcttgttttgacctcctttttctttagacgtgcattactcaacaagtcatttggtggactaacatctgtctaaactgtacatggatcctcagaaatgcttgtacatgcactgattttgtcttcaatttgcttaccaaggatgtcaagtgcactgtctactaacatggtgcactctggaaagttggctgctcgatgtgctaaattgagaaatttgtgggacataaacctgtagcgaagcatagcatccatgtttggattttcgattatatttctccccaaattgtcttgtatagttccactccttgcttctcgtgtccatcgcttcagcacgtagtgtggtggtaatgacttgatattcatcaaatcaagaactttcagagcatgggcacacaatatcccaattctatcgaatcgcctgcagctgcattgaactgtttgcttcaaaggatctccgataactttgtactcctcctcataggtgaaatctcctactagatattcattgttaccatccaattccttgctgcaagctgccaaggatttttcatattcaccttgaaaagcttcaaatataataggtgtatacaacttgctagcttgcaccaacataggtggtggcctccgcatacagattttaggcaactttttccttgattcaaattctgaattcagtttagtattcctttttccttgcaccaccctttcaaaatgcttaaagaaccggatgatatcaaaatcagatttaaaatggtttttcaagtcattatttagactttcactcaattgtgtacttctcattcctaatgtgaagacatctttcatatagcattcggcccatttttctttcaacttgtatatactatccaaccaggtttgcttgctcacttttgccctcatgatgtcaaatttttgttcaaatgctgccatgtcttcgtactcatatatgcatgcactaaaatctgacagaacacttgtgtcttctttgctctcctcattcttcactccacctaaatgtttgattgcataatgtggaaggtgcataatccatgccacgcttctgaaaacacttctgcaactgcctttcccattgccaaatcttggtcggtatagattgttttaggctgctgtccattatgagcttttagaaaggtctcaaacaaccatttgaggactcaaaagtctcatcatacatgagagcagcactaaaaattacagtttctctaaagtgattgaatcccacaaagacaccaaaaggcctactctcattgtttgttccaaaagtagtatcaaaactaacaacatcaccaaaacgtgcgtagtctgcgatcattttagcatcagcccaaaatatgttcgctatttgttcttcacaatccatttgcaatgcatattggaatgatgggttctcagcaattttgtcttgaaaatacttaagcatgctacctgcttggccatatgccatctcccgttgtcgcttggtccgtagatagttcctatgatctcggagtgtgtagctaaggttgagggatccaccaacttggcgactagccaactcatgtgccgctttcggtcctattcctgcatcatcggctgtttcaatttgaaaagcttgcaaatctgaaatttttctttgtgacaccattaaatgtatggtttccggcaagtgtagtgcatggttgtgttccaatatcagatcagacactatataatttcccttctttctattcattttgagattcatgtggacttgacaatcggttctagtttcagctcgaggacacttggttaaatgatcccttttgtcttgcaatcgatgaccttcatttgcacaaacaaatctacatgatgtaacactgccatccgacttgcttctgtttgtatacctttttctaacctcaaaacctttctgcccactgtagctaagccaaaatgcccaagcctcatctgaatttgtaaattccatgccaacccgaggtaccaaaccaggcatcaagttatctctgtattaaaaaaaaactaatgagtatgaaactagtgcatagatatgctgaccaaaaatcgccaaaaccatgctgtaaacattgattacatattagcacacattacatgctgtccatggccttgtataattgtattacacaccaatgtgcttccatcgcaggactgtttgacattgtttgatggcaggtctcggcaagattttcagctagctgcttcttccatgagaaaaggggaaacttgatcgatttcaaagcaacctaatggtggaagtttgattcagtgagccattcatgagaagtagaggcctagagggcataagagagggtttagacttacaagattgaagtgcagaaaagctcctgtccggcgatcacctcctccactcacgccaaaacttaacaaaattgttccatccgggtacggcgatcgctgctcattggccgctcgcgccaaaacgcgcgagtgtgttccttctcgcgcgctttgccgccaatcccttccactgacgcgcctttttacctccctccgcatggtttgcaaatgggccgaagggagcagctgggcaacgctgttgggccgaacaatatagaaccaagcagctgaacgtacgaacaaaaaggaaatcacgctgtcgccgttggattcggaatggacgcggatgaagcgaagtacatccctctaacgtagatgaggatctgcttccgtctcctccccacccagcggctgtgctgcagtgagccagtgagagaaaagaagagagagagagagagagagagagaggtggagagtagggctgtcaaaaaagctcggagctcgcgagcagctcgagctcggctcgtcgcaagctcagctcgagttcgactcggcaaggattcgagccgagctcaagcttgtctcaaagctcgcgagctctaccgagccgagctcgagctattcggcagaagcttgaaattttcactcccgctacccatcccaatttttcccgcactccaattccaaaatcctaccaccaacagcagtccatcacctaaccatttatttcccttatatccccatcccgtatccaaaccatagctcatttgctctcttcctcgaaacatttctcttctagatctacaatcctaggctgctctagtgctccactgaccactgctgtggatctagccaagcaccgtccatccttcgcctctcctgtccaggaagaaccccatggaggacagcagcagcccaccgcctccgccgtgagtgacgaaccgacgactcggatctgagtaagtttcctcttctttctttgttttacatttttatttcttttgcacccacatgtatctagggccctacatgtattaactgtgtagtgtttagttgcttgatgggtgttattgatttacattgaattttatggactaggtggagacatggagtagtacttatcttgctgtgctcctcttctgaagaaagactgaaggttgcagaacaccgtgtgtttgccatttgccaaggtaaattgatggcaatgcttttcttgttgtacttgtttgattccttcccttgtgcagaatatatattgatagcagttggtatttttaatttttgtagatgtctgtaaacctgcaaagacagctatctatagagatcgagtcaccgagcaatagggatggcatagcagcaacagaagcacaaccgaatcagcagctagtaccaggtgaagtaaggggagaagagggccaagagggaaacccaactaaagccaccaggaaaaagaaatctccattgtgggatttctttgaagaatgcactgtgccatcaaagaagaagaaaggagaaatggaaaataaggtcaaatgtaaggcatgtgaaactctgctcaccaagaatagtagtggcactacaacacattggcggaggcatttagagcagtgtgattatcacaagcttcaacaaaaatccataaaacaacataatatcaatttccctagccttgatgaaggtgatgttgatcttgatgctccttgtgtttctgtccctggttattatgatactacaaagatacgtgagcttatttgcaaaatgatcattgtccatgagttgccattttgccttgtggagtatacatggtttaatgttttgctaaagaggctaaacccttcttacaaaaaggtctctagaaataccattagaagtgattgtatgaggctttatgaatctgaaaaagaaaaactgaagaggactttcaaagatgttagaaagataagcctcacatgtgatctttggacctctaaccaaacaatttgctacatgagccttgttacccactacatagatgctgattggtcaatgcattgtcgtgttattaactttcttgagttggagcctccacatactggtgtagttattgctaatgccatttctgattgtcttgcttcatggagaattgaggacaagatagctagcatcacatttgacaatgcctcaagtaatgacagtgctgctaacctgttgcttgccaagtttacaaaacgtggttcactttggttttatggaaaattccttcatatctgctgttgtgctcacattttgaacttaattgtccaagatggtctggctgtgattaagcatataattgacaaagttagggacactatcaagtacatcaagaaatcaaacaatccagcatacaagttcagtgctgatattgattctctcaaccttaaaagtgacatgggtttggctattgattcctgcacaaggtggggctcaaccttcaaaatgctgcaatctgcatttttttataggtctgccttggatgtatatgctgcaggagatgcaaactataggtggctgccaacaccagaggaatggaatctatattgtgaagtcaatgatgccctttctgtcattcatgcagccactgaggagttctcaggttcaacctacccaacatctaaccttttttattctcacattgtcgatattaagagagtactaggtcagttgttgaagtccaaagacccaattcttaaataaatggcaaatgcaatgcttgaaaaatttgagaagtactgcggcccagaatgcaatactttgtttgcagttgctttggttctagacccaaggtttaagatgggtatgattaactacacattccctgctttgtatgaagaaactgtacttcctaagaaacttgcaaatgtcgaatccacattgaaatctttgcatgcatcatatgaaagtgaactccagagcacatcaaaggaaaatgatgccaccactcaatctactagtacatctctaggcactactagtagtcatttctctgctgctagccaatttcatgagtatatgaaatcaaagaatgctgctagtcttcctaagtcagatttaaagaggtacttagatgatcctgttgaggatattcctgcaaaaagtttcaatctacttcagtggtggaggatgaatgaattaaagtatccaattgtggcaaagttggccaaggatattcttactattcccatcacctcagtctcatctgaatcagctttcagcacagggggtcgagtgattagtgattatcgcagctctttactcccatcaacagtacaagctttggtgtgtacatctaattggattagaggaggccaccacaaaagcacagatttagtaagttcttatattttcatgtttctacccaattaatagagatacacaatctaataatctgtgtttacttgtttgttgcatactaggaggatgatactaattctattatccttgtcccaactcaagcttcaactgcaaattcggttgtgggcagcaattagactcgtttgtcaggtatatgtttgaggttatataaattatctattgctaccatatcaattcctcatcactgatgaaacattacctataatctttgcacatggtttcagatttaactttacgaaacattaatgcaggcatatagcatagcatcaacaattagtttgaagaaagtgcttggaggtttcacattggcgtactgccattgccaatagtggagtaaatattttgtgacagttgaaatttgaagtacgctgtgttagtagtataagtaatatttagatattagagcttttagatggaacatatgttgggaacttccggtgggctacttttgatgttaattgatgctctatgttctgtcaagtcattgacacatgatattgtaatgtttcttatggtgttatacacaccggtctattataaagtagtaatcctattatgacttatgcactactatgaatttgtaatctttctagtatatacctgtcgagaagctattatattctataatgaatttgtaatcctactttggcttgttaagaagcttttattgggagataagttcagattgctgaaggaaacagtcttaacgagcttctacgaattgagctcgagtcgagccgagccttgatcgggctcgaaccgagcctaccttcaagctcgaaggtaatgctgggctcggctcgagctcggctcgagcctgtaccgagctcgagcttaggtaggtaagctcgctcgagctcggctcgttgacagccctagtggagagggggaagaagaggctgacacgtgggacccacgctgagccagctgccacgtcagataaaaccggagttaaaaccgccaagggacctactttacactggttctgtaagttgagggatacgttagtatccggttttgcggtttgagaacgattttgtaactcgatgacaagttgagggaccttcggtgtactttttccttgttttccactggcgaaacttgtgtaataaaaccgcgacatctgggacgttgatcgccgatctgacggctctgcgcgtgtctgcagccactctacaagactacaactactgccaatcccggcccacgggccaattcagccgcgcctctccgtgggccagaagatgctgcgccgcctaccgntccgcctcgcgccgacgctcgcgnncgncggcgncnggcgccatcccccaccgcgtccttcgcggcgcgtgcaccacngcgcaagcctcaaggccnccgccctacccgctctccccgtcngacctagacgccgtctccgcgctcctcccgcgcctggtctccgcggggaacgtccccgccgccggccgcctcctcaccgccgcgctcctcttcccgggctccacggagcgcctcccgttctcnccgctcgccgcgcacctcgcctccatgcccacccttcaccccggccttcgcgctccttcaccgccaatccngccaccacccgctccgcccctcgccgctgcccctcgccacgccgctcatcgggccacctcctctcgcgccgccgcgcccgcgaggccgcctccgtcgtccgctggctctgccgcccggactccccgcagcggcccgacagcgccaccttcgctgtcgccgtcgcggggctctgccggctcgaggaccccaggaacgcgctcgccgcgctccgggagatggccgtggacgggatacggacctcggcgaagctgcgggagtcggtgcgggacgcgatgctgcaggacgcgaggatcgaggaggcgtgggcgctggaggcggcgatgaagcagccggactccggcaagctggctgagctggtccagaagcttctcgaagagtgggaggactgagacattgccgaggtcgaaggatattggttctcccttgcttctcgatcaaggtagaatttcccaatgcatttttcttcgatttgttcaatgtctagtgcaactgagcatgtgatgttatcactgagaaattaattagtgaaatactgatatactccatgtggtgatatgatctttgatagcatctgtaaattgttcgctgagcagtcgataatcgtgtcaatgcgattctctaaattttcgcaaacctgaaagcttcacctgatagagtttgcaaatgggttgggaatagcatatctatgaaattgtgtcgacattagttcagattgttgcagcatgagagcccagaaattcatatggtggagctttcgcaacaattttgcagagtttcttgaatccaaatacgagaagctgattttgctacaggttgatgtaaaaaatggatgtgcagtttggtgtaaaactggatgtggtgttcaaattttgcaaccataccaaagcatacttttcattatgaaagatggacaccggtgtcttatctatgcacaattcttaaaaaggaatagtaagaaaaagaggcaaatggtcagacctactagtagttatatgagggtatcgtttgttgatgggaactctctgttcatggtctgaaaattaacacaggcaaactttgcattcttgcaggcacaacgtgttgaaaaatggacttttttcagaacaaagaacagacagttctccctaaacagagagtacaaagcttcgggtttataagaacttgcaagattaggattacaaagcttctagtttataaaaacttgcaagattaggattagcgattgatttatctatcaaagagatgtttataagaacttgcaagattaggattagcgattggtttatctatcaaagagatggtttataagagatgataagtcacctgtacaatgtcgtgattctattcttttagggtgtgtttggataatgaaaaatgggggatgggattagaattgggaaatgaatgaagggttaagattaaatgaaagagggagaatgaacagttacgatttaaagatgtctttttgtaggtgggaaatcatttccctttcccattagccgaacactgccttagctgaagtcatttgggttccacataatttatctacatcacagtggctagttttataactgactggaacttttcgcttagactctatttagtttccaaaaaacatcacattgaatctttgaatatatgcatgaagcattaaaatatagataaatgcaaaaaaaaactaattgcacagttagggaaaaaatcgcgagacgaatgttttaaacctaattagtctatgattagccataagtgatacagtaacccacatgtgctaatgatggactaattaggttcaaaagtttcgtcttacggtttccaagcgagttataaaattatttttttcattcgtgtccaaaaaacccttccgacatccggtcaaacatctgatgtgacacctaaaattttttttttcacgaatgaattgaatcgcaaaagctaaattgcatgggccggagtcttgtcttctgaattattttttcaactcctggttaccttctggctgacaaggctttctttgaagcaaatcacaaaagctagggtattgatttacagatgcctcaaaatctgaggtttaacagatgaaattaccagagagtggcctgcgccgagagtgggtagtaccagaacttttggcctgtttcgtgaagaattttgaggtaaattgggtgtagagttgtaatatgaacatcatttcaaccgcgctaagcctctcaataagaagagagcaaaagccaggacaattgagcacagtttcagaatatcccagtattattgagaataatcacgcaaaattggcagacaatctggtacagtaatgcaaaaaacgtttaacttgtttgcaaaagcacaaaactgccaaagtacaaactgcctaacatcaatatcctctgttccagcgcagcatttatcaagcaaaaagaacaaaaacatccagcatttcttttctttccagatatacagcatgagaactcttcttacccacttctgccccccttggcttacagaaaagggtagggacgaacacgcaaaccacaatctcacaccttcaatgagattcagcccggttccttcaaaaacccaccgaacgagcaccatccttcgcacagtccgcatcgagcacaagaacattttttcttcctcgagcgaccaaagattaacgaggccagccacgacaaaactgatgcaattcaatagaaacagcaaaaagggaatgtgtaaatccttaggccacctactgaagaactaggcatgcacgccatttccattgggataatatgttccattggaaagaccattggcaagcttctttgcgtgcccattttggtgtactgtagatgtgtaagcaccattgctcagagaatgtttagtagaaaccacgtggccattgcagctgccttgcagcaatctatccagttgcccagatgaggcagcaattagtcctgcaaaagtgtagtgatgattaacatgtagtttcgaaagcttgtgtttacactttacaacacaaagtacaattaaaaaggttcgtgaacaagcatactgaaccaaactacaagcagaatattatttggcatcttaccgacaaagagtggagacggttttgaaggtcttgacttgaattcaggatggaattgtgcaccaacaaaatatcggtgattggggatttcaattatctagaaatagcaaatctgtcaagaggtaacagtggcaaaaaaggaaaaatatttaagcaagtctcagttttagtcgaacctccattctccttccagtctcatctttcccaacaaactgaagtccagcattttcaaactctggcaccatatctggattcacctgtgaagttgtagatgtttcagtccatgttacaagaagcaaataaatcgaaacttataagagcttaaagaccatacaatacatggaacatttcatagcatttagatgtacatctatgaaccgacacaatgtgatcaacagacctcatatctgtgccgatgcctctcatctacataactgacattgccatacctacagcagaacacaattatttcaggggatgcaacaaatcgcaaggactcttaagcactggggccataatggttatgcagaaaggcctatatgtgcactcacaatttagcagacttgcaatcagcaacctcgaaaaatgtcctccttgatcctaggcgcatcgtgccacccatatgtgttttagaaccctgagttaacatacataaagatttaattcaagggaaggcagtgggaagttgactttaaattcaaagaggttcccaaaataattacctcaggcataaaaataacacatggggtcttggcattgggatcaaattctgtgctgtttgcttcagggagattcatgacacttcgagcaaattcaaccacagcaagttgcattccaaggcatatgccaagatatggtacattgttttcacgggcatacttggcagccaaaatcttcccttgaatacctctatctccaaagccaccaggtactaaaacaccattggcaccctgagatgacaaccgttcataaaaccatgacaggcaataatttatccattataactcatatatgcaacagcattacaagtttttcaaaacgccaaaataatttaaaaaaaaccttaccttcagtaaatcccatgctgctttataagcatcaggcgcctagaaatttagcaaggaatgattaagaaaagaaaacagctcaaattggtttgaattatgctgctactgcctaacctcaatggcagtggagtcttcgagatcagtagaagcaacccaatcaacaagaagcttcctgcggcaatcaacagaagcatgcaagagtgcctacacatattacgcagcacactcagatattagaaaacaactgtcaaatttataaaatacaagcatattatcaccatggtaatctagctcaccttcaacacagagaggtatgaatcagatagaccagtatacttcccaaccatagcaatcctcacctgaaatgagagcattagtcaatgggaactaagaataaaaagaccaaatgggaaaattgaagtaagaaaaaactaacagtatcctgaagtgcatcaaataacgtagctcttgcgacccattcatccaactttggcccccgagcaaagctgcaagtttataaataaatatccaatcgcatcaactgcctcaatacacaataatataggttggggaaaatttaaatgactagatatatcgacaaacctatcaaggttcagcactttaagaatggcttcatgtgccttttggtcctaaatggcagaaatgagatatgcactgttaaaacaggatgtgggatacgccaaaaaagaatttttttgtaagggggaaaagagagatgtgacgtacccgtagcaacaaaggaatacgccaaatgttggaaacatcatacagagtgacaatgttagctgcctgcagaatgccaataaataatgagctaacaggagcagttttagctgccaaagcttattgatcaatcctgacaacataagtttacagtacattaccggtacatggcagaactgagagagtttctccttcacattttcttccagttcctgataaataatattgcagttcaagaaatttagtcttaagaaaagattcagggactaccaagatacagaataaaggtaaatgaaaattttcagctaaccttagtactgcgacaggctaaaatatttggtgtgagcccaagaccccttaatccacggacactatgttgagtcggcttagttttctacaagagtaaatagcatagatgtagaggaaattgtcaaatgtattgcgactgcaccaacttaccaaaataagaccataaaagccataagatggattaataaacagtacaacataataaatgaatcaacagtgtggtacctgttcaccaacaacattcagaactggaacaagactaacatgcaccaaacaaaa

SEQ ID NO: 79144 - DNA, 8457 bp, Oryza sativa
gacttctcgatcgctcatgcttgtccacgcgcgcgcgttaatccccggccatgcccgctgactatgaaaatttggaaagcatcaactaaaattagtgccatgcatgtcagtttgatcagagatttggaagggcgccatcaacagccgagatccatctacgcctattgccgcatgtcgacggcgtcgtcacagagcacttgggcacggctgagctctacttatacttgccgccacatgcggacggcgtggacacagagagagcacgcgcggtcgaactccatctatgcctactgccgcatacatatagtgcttgcgaccatcgactcgccaacctgccgcctcgcatggtttcgcatctggaactcctcccgtgcagtatgctctgtcaacaccatcgtcggccaccatggtaagagcaagctttattattgagaagaaaggctcgcgggtagtgctgggagagagaagcttttttaactaaccaaactcatcagcatatgttgcatgtgctgtaaacgggagttgagaaggtaagtcttgaatgcttgcatgcatatgtattggaacgaacaaaacttcaatgcttgcatgcgtttaaacggctgccgaggaggtgccgccttatattgtgggatttgagaaaaaatacaggtgccccctatattttgggatggagggagtactatagtactagtgtctatctagttagatgatattctcaaatactggtacataaaaaattttgatcttgtgctctgagcgatggctaatcgatggcaagaagtggcgacatcataagggttggaggtaagaagatgagctcgactcctcatcaccagtttattgtataaagatagtgacaatgggctgagaatggtgtgaagctaagccaagttggtactccaaaatctccaattttatgttgtttcatatctttcgcattctcgttaagtatgtgggtttagtggatgaaaataaagacaattctatccttgttcaaatgagctatgttcacaagttgagttttattttgctaaattatcgaggcttgtacgactaataataagactgtaaaatgttattttaataattatgacatgctaaataaatgtaagacttttcatgcaaattttgcgtagcatcttatttgcataattgttgcaatgtggtttttgaattgtgccatgtgttattggtcacactctggctatgacacatttacaattttatcttggatccaccactcaatcaatatatggcatattttttcttaaaaattactatgatctaaaaaaactacaaggactatagattcatttttctacaccaatttaaaatagaaacatagcgtgacacaacataacaaaccaatgcaaagtttgatgtagccactttccaatttctagctaaacgttgagatatataaccattcgtatcctagtggctcaaatttttagcgaggaagcttgattaagaaacttaattccacaaaatatatgtaaaattggccgattaaatatgaaattactatactacgctaagagtgtgttatagctaaaacgtgactcaaagtagtaaatttttaactatgagggcaaccatcgtcaaatacccctattgagcctgttagtttttgaggacgatataactagaccgtaaaagttttgctatgaatgcgcatagttaatgcacactcaagatactttttagtgcatccgctattaaataaacacatattttaataacattgattttgtacataatgcaaggacaaaaaagaatatttgttccattttatatattataacgttttgatttttctttaaaagtgaaactttttaaaatctgtccaagtttacaacatttacaaccctaaattattttaagtaaatctaatactgaatatatttttgctaacatgtttgttttatataataaaaatattaacatatttattcgtaaaattaattgtaaattgtaatatgataacaaggcccaacaaaccgttttccaggcccatgatagcacagcctactcgccctgccgccgcccgctgatcccccgactccccccaaaacccacgccgccgccgccgtctcttccctcccttctccgccgcagccgccgtatcccccctctctctccgggagctgaaagcgcccgaggaggagatcaggtagcctgtttattctcacccctagtatcccgacgcatcttgttttcttcttcttttttcgttacattttgtggtgggtgtggacgttgtcgcaggttctttggccatggtgggctggcgggcggcgggcggcgctcgtgccgttcttcgccggctcagcgcggcggcggaggcggcggcgaagcaggacggccgtgtgttcgctgccagctatagcggcagcagtggcggcgtgaatgctccgtttggcttgggtgcgttcccgtttgtctctaggtcttagcttttatttagttttgaacttatacatgatccgaatgctcatcagaagtacagactttaggtgatttatagttgatgttgataagaatgctgaattttttaggataaatcgcgttgtttctgttaaactctagtattaattttggattcagttgttattacacccttcagtatgtgttttttatcagtcgcactccgcattggtacttgtagctttggtactatcagttctttttataagctctgatataatttgaaatgatatggtgtgctgtcaagactatgtatttggggggaatggctgaatacataatttcattttgcttaaagctcttctctttatttcagtaattagtatagcgagaacattttggtcttgatattctcgttacgtgctaacaatgactgccaccatgtaggccaatatgcaaaccttttgagggcacaagcttttgcatccaggggagtcgcgctgaacttccatcagctgatccgcaatgctgtaatgcactcttccccatgtggccatgctacttcatcttcttttgcttttacatttcttatctctacaagttgatctcctgttagaactaaatcaatccttttacaattgcctatgtatgacactgattgaattttgaagagcacctcgataagtagctgattttgtgtctgttccatattggagccacatgtatatatgatcacattgcgttgctttgtaatggaatatattttgcttgttccgtgtttgacagaaaattaaattaactgaacttcggtcacactcttatttacatgggtatttggctcttttttttttctgtagggaatatctaccacaaggaacctgcttgctgcagatgatgctatggttcctgtttcttctcctttgacacctccacttggtgatggagaacaaactgacaaaaagggagcaattgttaagcggctgaaggtccaagccatcaagaaggatatcaagcaggtgaagaacaatgaaatactaactatatttccccctaaagtgattacatatgctgtcaccagcagtgaaagtttgaacgtgcagtgtgtcatgcctttgctgcattaactcttttatgtatcctctaacatgtttaaatgagactttcaatggttagtggcaaagcacatttaaaagtaacataatgaaagcagcaacatttcaatgtctgatgccccttttttagaagctgcaggtattgtttagtatatgtttttagcttctcattcataacttaatgttatatagttggtacaatcgtagtgttcactgagctgtttcctagttatgatcctgcttgattagagtaagcatatgttcatgtaggttatcaatatatcgagatagtagtgtagcacagactttctttatcttgtttagtgcacatattcttttactactatcatcaatagatgctcatctctctattttccctttttggctgttttagagccccaagaaggtgaatctggtagcaaagctggttcgaggaatgcgtgtggaagatgccctgttgcagttgcaagtgacagttaaaagggctgcaaaaactgtatatcaggttctgtagttaacaaaattttgtcctgcaactgctccttgtggtagatagggtcaggtgtgaccaatatttttcatgatcattcctttctatcaatcactgcaggtgattcattctgctcgtgccaatgcagctcacaatcacggactggatcctgataaacttattgtgggtaagaccttaagacaacatccatctcccccttagtccctccaatagtcattcgtaatggtttcaatctcattcctttctttccacttacctatcataccacagaagaggcttttgttgggaaaggactttacctgaagaggttgtcctaccatgccaaagggcggtgtggcgtcatggtgagaccgaggtgcagactgacagtagtggttcgagaggctaccgctgaggaagaggcaaagatcgcgaaactcagagtcagcaactataagaagctgaccagaaaggagaagcagctaatgccgcaccgtcttatcgaggttagccccgaggtgggctcgcaagaggaaagaggaggctggtgctgctgcgtagcatggcttcccatttgcaggatgtctgccttcattggccttgaagcggtgagtagccgcatatgctgaaatttacccaagaacaattgtagctctctcaagaatgaattcaaaggtctcatttgtcaggcctgtctttgttctgtttgtttcatctgtatgaaatttgtctcatgaagcataggaaactgtggcattgcccacgattctactcagaatgaataatgtcacctctgatattttgttcggcctgcctatttttatagttgtcttcgctgaagatccgtattcaaagttaaactattgttataatcacaagtcagatttgttaattccgttgatctcggttcatggaatatggtgtgccagtttcgggctcctttggaaaagaggaattttcgcgggaaattttgatgaaacaactaattcctataaaattccttcgttccaagaaagccgttgaccaatttacatgacatcaaactacaacagttaccggaaaagattcagttgaatttcagtccatcgaatcaatttcactagtacgatgactgactttgttcaagcaaacggtcacttttgatccactgaattgtatacaaaatttcctacacaaatatataagagaaaacccaagaaatgtcattgacaaacgtccaagtcctacaaatgtcatcgaatgagtgcgagtttcatgaaatgacatcgtataaacgaccttgtcccagaactatcatcgccgttagggtcatttccatcttgcgtcgttaaatgcattgtttctcctataacacttaatgaatggatgctaacggaaccctaacggtgatggtatttttggaacaaattcacttatacaatgacatttcatgaaacttgtacttaaatttcttagaattgtgcgcttgtcaatagcatttcttgaattttctcaatctgtaaacgcaaggctacaatatttgggccgcaaaatagactccaggccttcaacacgggcccgcctcctcccaggcctcaaaattcgctcaactcgcaataaaatttgccaaaatttggcaaaacccggaagagtcgcggtgcctaaaccctagtaccaaaccagaggtcgatccggttcccagccatggccaccgccgccgtcttctccgcctcggcccgccgcctcctctccaccgtcgccggcggcgccggggccggatccgccgccgagctccccgtcttgattggccacctccgcagcctcgcccgcgcgggccgcctcgccgacatcgacgccgccctcgcgccgcacctggcgtcccactccgtcgcggcggtctccgccctctcctcggtgggcctccccgaccgcgcctccgcgctcctcgccaccatccggaacccaaccgccgcgcacctcaacgcgctcctggccccgctcctccgccgccaccgcctcgtgggcctcatccccaccctcctcgcggcgcacccctccgtcccgcgcgacgacgccacggagggcatccacgccaaggccctctgcatcgccaccggcgccgactccgcgctccacctcctccagcgggagtcgccgccgccgtccctccagctcttcaccagcgtcatcgactcctactataagcagcgcaagccccaccgcgccgagcagctgtggcgcgagatggtcgaggaccacggcatcgtccccgacgccgccgcccacaacgtcaggatcacctacaaggccgccaccggcacggtggaggaggtcaaggagctgatccgcgccatgcgcgaggatgccggcctccagccggacatcgtctcccacaacgggctgatgcgcgcgatggcgcggcacgggagggtggacgagatgatggaggtgtacaagaggctggagaagggtagcgcctccgccgcggcggagggcaagtcggcgccggactgcgcgacgtacacctgcgtggtggccgcgctgtgcaaggcggggcggtggtcggaggcggacgacgtgttctacgaggcggtgaagcggaggaagctggccgacctcgggacggcgcgcgttctggtgcgaggcctcaaggaggccggcaaggggcgggcggcgaggcgggtggtgatcgggctgcgcaagaagttccccgaccgcttcgacggcccgtggaaggatctcgaggagttggccgggatcgccggcgaggatgaggagagcgatgtcgaaggggaggacgacgagcagccgccggcgacgacgacgaccactgccgcgtgagctctcgcagtaatttggtcgtgttcgtggttttagcaaatttgcattcgtggtaatacgaagaccatataatggtttaggattttagggctggatcaataagaagcaaattctgaggatgcgagaatcactcaaattttgtcaaactagcttcttgaatcacaccataaaacttctttaatgtgatgtctcgttgtaatgattgatcttgtttctacatctgatggctttgttttgtttccactaatttcactcacaaatacttttggatgctgctggctatttggtaattgccaatttgatcaaatcatgcagaaaaagctactccatccgcactaaaatatacatgaccggattagataggctccctgtccacgctctaaaatgtacaatcgatttacgaccggattagataggctcgttgtccagactattgttactgtcaaattcgatagtactaggattctagattactgccaaattcgatactagattgtcatttacggctgggttggagtattagttcgttcttaggttaaacacatctcccatcctcgaacttggcacggtaagtttagttttgtgcctacattagagaggaagatggcaaaagcttacgcaatcgacgcttaattacaagttgttgacgatgtgagtgataatgagttttctgttagaggaaatgcgccatgtttctcacctttaagcgcatgttaggatatcttgctttttagcataagctgcacattgttttctggaaaaagtacaccgaagctccctcaacttgtcatcgagttacaaaatcgtcctcgaaccacaaaactggataagtagatccctcggtggttttgactccgattttatccgacgtagcagctgactcagcgtggatcccacgtgccagcctcctcttcactcctctccacctctccctctctcctcttcttttctcaccagcagaacagcgacagccggcgggtggggaggtccgggaggaggccggtgggggaggcgggagtccggcggcggcgggcccgcgcggatggatttgggcggctgcatcggcttcgcggggggcagccttcatcgccctcttggcgcgggcggggcgaggggggaactgcgcgccttcttctcccacttggcagacgccgccgccgccgacgacgcggcttcttagcggcggcggaggggcgcggggtcctcttcctcttggcgccgacgacgcccttggcggccgggctgcgggcagcgaagcagagacaggcgagcgcggcggacgagttcgccgttcagtgagggaggctgccgaggagaagaaggcgacggcggccaggtccaaggccaagacggccgccaaggccaaagctgagcaaagctccggccgcgaccgcgagcaagatgaccatggagccaagccgctcgcgcctccctctcctccaccacttctcgctgctcgcctcgctgtgttccgcgcggtggcgagacgacagccgcggcttcctctggtaccccgccccgcgcccccctcggcgtggcccgcttgctatcgtagtctacgctcatgacgagacggccatgtcgctggagcaggaggtagagctt

SEQ ID NO: 79145 - DNA, 9005 bp, Oryza sativa
atatatatatatatatgtgtgtgtgtgtgtgtgtgatgaattcaaggatggtactttatgagatatagtactaacaaaagtacacgtataatcttttttcaaaatttttggtaaaatttgttagctggtgtgtacggtatgtatacaagaaagcttgtgtatataggataagttcccgcttacagtttgctaacaacatctttaaacaccaacattgtggcatgttcatcagggtggtcactagtcaggccctaggtctactatatatatatttttaaaaccatttaaacactttgttatataattaagacatagttcagggaaaaatcaccagtacatcgtcaggatgatatatagggtccgtttggcacagctccagctccacctcgacctctcctggagctagagctcagccaaacagtttcagttccacctaaaatagcagcggagctggatggagctctctcacaaaatgaacagagatgtggagctagatttaggtagctccacaactccactctagatccaactcctgtaactaaatttagaagttagaactctaccaaataggctcatatatagaacaaaagcatagagccactctttgtttctaaacttccatatagcataaaacacatgagttcttttttttttaaaaaaaaagagagcatacagccatccttttcaaaaggaatgtgaactgaacaaaacaaaccaaaggcaactatagattagggatgcaatatagtgtaaagcacgtgaacaaatagcatagccactagtaaacctatatagcaagctaaagacaactatagggagatctttctcgccaagactaagaaaaaacaaatcatataaaaaatagtctttttcaagataaaatgaagcacaacacactacgactttacaacacccgtgaacttttatagggaaagatggacaaacatttaatatttttttaaaaaatgctaagttcaatctctatggtgataacacgaaaattttgtaagtcgtccactagcaagcccgagaggttgctacatggtggatacacagattatggttattgtacagaattcttagcggagaaacttaataccatgataacgatggacgcgtgaatttctaaagcccgagtgaataacatgtgtaaatcacatcaaaggcccacgctagcattgtggctatttacaactaatacctccttccaaaataagaccatcattgtttttccttatttgtcttatttgtttcaaaatagctacattttcatcttctgctttattaaatcataatacacctgttttccactctatctagtttcgatctatggctcatcatcggtgagccttggatcgatcgtacgcgcatccatggctcaaaaggtcactgtccaaaaacgctcgatccatccatgaccgtttccatcgtcatcatcttcgccatcgctcgtccataaagcgagaacagaaaggacgccctctttaataactgccacacagtgccggtgacgtcacatccagttcagtagccagcacagcacagggggtgatcgccagatgcagccgccgaccgggccggccacgcggcgcaaccaacgggcaggcagccaggcaaacgaacggcgtcgccgccgccggctgcccggcgaggcgaccaggcgattgcaaggctgccacgcgttataggctctcggcccgacgccgtgggatgtaaaggcgccacttggggtgcaaggcgaagccggtgcccgtacgcgtgtaccggctgcgcctgcaccgcacgccgtgtgcccgcaccgagaaaatggccgcagccttagccttcgaaggtgactcgagctcggacaatggccgtcgacggtaaagaaagctttagagagagtaaagtatgtctaggagttatcgcatcagatttgtgtcgagtttgagaatagagaaaaaaaagggagatgcgtattagaccctgtgtatagatgggagttaaacttatcagtccctatcacatcagatgtttggatattaattataaatattaaatatagattattaataaaactcattctataaccctggactaattcgtgagatgaatttaatgagcctaattaatccataattagcctatgtgatgctacattagacatgcgctaattatagattaattaagcttaaaaaatttgtcacgcgaattagttctcatttatgtaattagttttataagtagtctatgtttaatactccaaattcatccgatatgataggggttaaagtttagtcctagatccaaacaccaccttagtcttacatatttataaccagctaaagtaaaaactctaacaagctttatgagaaaaaaaatattaaatctatagataactattatataggtgagcgaccagatttttcttttaacctataagctactagattatggttgtagatgatgtgctaaattttataactagaaatcgactatcctattaaatttgctcttgggagcagtgaaagaatgaagacgtccacatgaacgcatagtaggtctaatttggaacgaacaattaaaaaagaaaccacatagattcattctattttcataggaataaaaaaattgttgttcaatgatactagtgcatttaccaataatctactgccaacttccttttcttctttgttctacatattctccacggtctccaacgtcaccttgaaaattactatacctctaaaagaataacgttttgacaatgcacgtgttttaccattactttctcaataatatatatttatagaaatataatatgaaagagttgttcataacaaatctactaattaaatactcacattttaaatccttttttcccgactattaatgatttaagattcaaggtttggttgcacacattcaaagagtatatattttagtatcctttttgacaacagaggtagtatatattttagttagatatgctcaacaaagtcaataaaaaaatactatagcatatgatgtcacctgcacatgaacgcccaaaccgaaaggtgcatatactcaaaatgcatcagctaaaaccactaaataacagggaatacatcagatgccacagagatctacaaagacgacatacctacccaagtagtgcggtttcatgtttaattcatatgcgaggaatgaataaggcatggatttaattcggccttgcgtcaatatatttgtctctcttctcagctccctgaattcgacaccttggcgatagcctcctgagggggtgggtggtcgaacttgcactgcataccaaacttgcacacgccagtcttcatgtagaaggcacataccacggcatcctgcatatcagcatatgcattagtttaggcatcaaaacaaatgctatccaggaggatattcatacatgactacattccgagaatgcatctatgtagctagatgaaagggtgaacaagtgataacacctcttcttatatgatgatgaaaaaagcaatccagggaacatcatcaagatcgttacaatatgcagggtgacggttacgatatgcagcttactatatcatcaagatcaatgctaacgggagaacatatgtaaaaattgaaaggactgcagcccaaaaatagtaagatcattggaacgagcggagtagccaaggtattaccgacaagctttgaaatgttacctctcttcttggtaggccagcaagagtaagctgcacagactcctcagcaggctcccagtttgcagagggatcgggagcagaacgatcaattgggtggtgaaacttgcatcggtcagcaaacttgcaaaatcctgtcttcatgtagaactgcattaagaaaagagcataacgctgtagaggcacacccagactatatgcgtaaagtagttgatatcaatcagctagttaataattcatagcgaagagactgtcatacatcacaaacagttgctccaggcctctggggataggtgactggcccaggtccaacctgcattttacaaaagagcatatcaacttgtgtatctcacagcacctatttccaactttaatttcctttgtttactcttacaggcatgtgtgccgcatgaaaatcaaagccttgcatgaagtttgcagatgaatttagcagcatggattccggagtagggagaatggtttgacccagtggaagtggaaaatttaaaactgcattgagcaccaaattaccataagaatacatgtcgagtcataagattcaattcatgtaagaatcatgaacactatcagacttgtttaatttagatgcaataacagatatggcagaagagtgcggctatcagattgaaggtgttaagttcaaggcatggacagttttgaacgttgaatacaatacaagcttgtttggttcatatggcaagttctctgcttgttttggctttaaaggtacagtagaaaggacacggtcttaaaaataatgtgtccaaaaagaagaaaagaaaaagttagtaaaacctggttagtatttgtctaatgtcttcagtattccagtcaaccgtgctgcaactcataacaagatctgatcatttattcatttcataatatttacatcagatataagtagctttacattgccccatacttgaattaatgaattttaagaaccttgaaggtacctagagaatgaattcattccttctcttattctttaatgcattgtattccttctgcctcgcagtataagaaaccatgcagcggcataagaaaaggttaatggcaacagataccaatttctattgtactgccacatggacttgggatgaataagctgaggtttggtggataataacagattagaaggaagacaggagtctggatggatcagataaaacagggagaaatagaagtagaggtaaataaacttgtttattccttgctgccaactaagggttgtagagatcctttttcatagccacataaacagataagttcagccaatgcatcagctcacaaactatatctccaacagataagcctaacaacgtatctgagaactaacaaactaattgttgagaaacagataaaaatacacaaccaccaccactcaagctcttttacagcagagaagtagggggtgcaaccgagtggaaactatgccacaagtacacccttgatttctgcaaaatattatgaaaaaaatgatcctaaagaaaatgcactaatattatgaaaaagaggagtacaaggctattacgtaagtgctctatccaaccagggcaaattgcaagttaaattatgctattaaatagacgagcagctagatgatggttgccacgctccttctgagaagtggaagaaggccaaaaggatcttaactacctcaaattcatgtcatgataaatttaactttgtgaatatggttagttgtgaccatgagtgacaaacctagacgatcaggatggttgaatcgacaagtagaaccgaacttgcaactgtagagggacaaaaggaaatgtgagattccaagtatctccaaactcatgcagaagtgccaaagccaacagaaaatagtgttattctgcttaaggggatacctgcccatcttcatgtaaaaaggacaatcaacttcaccctgccatgaaggagaagagaaggtattaaacaaaacaagcaaaaggtatttcacctagaatcatgtaaatagacaaaaagatttcactatatacaccagtatattgataaaaaattcagtcttatcaataccccaaaaaacagaacttgttgagagaggaattatgtaccaaaaccatgtaccaggaattgagtacaaaatacagatgtgcggaatctaagcatagagcatcctcaacatcgttatcttgcattacataattcacaggtcttctcaaaatggtttacgaatgaaacaaagttatcaggcacttgataaggacatactggtctcataggcagccctttagagttaaactcttgcgcagcagcaactggagtttgcatcttcgctgaaactgaatcagctgctgaaccaatatccgtttctccttcaacagtcactgcactttcgggttcattttgacttgaaggtatttcaatatccttgggatgattgaacttacacattgcacgaaatttgcatttgcctgtttttgcataaaactgaggtacaaaagcacaactgaaaatcggtttttaagcttgatgccatacaaaaaggaaaagaaggtgcagtagcttcttacagaacaaagtggctcagaaggcctcactggtaagatagaactatcagcaattagatgcttctgcaatttcataaaagagcatacaggttgagacctgagcggttgagatgatgacatgttagtagtctagtaagtaaatggaaacaacttacatcattggtatttccagacgctaatgcattaaccttttcctttggatgattgaacttgcatttcgatccaaacttgcatttaccagtcttcataaaaaactgcatcatcaagaacaacattatgagcatatttgtcatattgattcaaaaatagggctatgaactgcttacaggacaatctggttccccttcttgttctggataggattcttcaacatttgcagcctgctaagaagttttaagaaagcaaaccagaagggatgaatttggaggataaaaagacacaattacaaccacaaacatcacaataaatatttcggaaaccttaaaaacaccaaattgcataaggtaattaaccagagccagagcattttattaaaagtggtctagaaaaaatatatctactgaaaactgtagtcgtgtcttttttataactatatacccaaccccccaaaacactcaattccgatgtttattggcagttgaagacttgatgtacagatgggcattcatcaaaagattaaaagccaactactattaaacctatgactgtgaagagaaatgtttaaaggcaagtgtgcaaatgtttgctgattggtctacaagaaaacaagttcctctaagacactgcaatgccagtacaccctgagtcccacaccagcaatacatttgtcagatgagtcacagcatgcttcattgcttcagccagatcaaactatatattctccataaaaggaaaactaagcagatgtatgcagttgcaactgcaaagaaattatatgtcatagagtaaccaaacagtgcttaacactgacatatgcatgaacaagagccacccctaagctcaaatatataagccacatgatcaacaaagaatatcaattccatgtctttattgtgaaattcacacttgggatagtcctactcacaaatcttggctggactcctagtgctgtaaggtaccaaaaaacatggtgttgacacgaattgccaatatagcccttatacaagatcagcgtgttatccaatgcttcaaacagcagatgctaaagcaatgcagcaacaggagcagacaaatatatgccacaaatgtttagttcacacaataattttttttgtccaaaatatccggtttcctgtcacaactgtttttcacttaaatactgtcaatcaataaatgaaagctttgattcctaaattctttcttctaaggttcaaagaaacacacataattaaccccacctgcactcttagattctttctttcctttttgctactagcgatgctaacagtaatacacttttggttttcaaagtaacatatacaccttaaaaatagtattataatatacattactataaaatatagacctctataaataataacattgacaggtgatcacctctttccaatttggaatcccaccctctggaacccattgtggatggtcaaatttgcaggaacctccgaatttacaggttcgggtcatcatatagaaggcacagtccttttcccccggtcgctgtggatatataggaaggctgctttcaagcctagggcgcttggtcatagtatttgaagaatacaaagcctcaatctgttcaacagtactatggcttcccataattggctgatgatagagaactatagtagatatacaaaagaactttataagctacatgtattagacaagaacaaaagcaaggataatagtaatagtgaataggtagtaataatagtaatagtagtatagagaaaaggatcaaggatgacaactgattactgcactagtgcactacataagaaaacaagacaagtccagttaaccaaggattgagaaactatcatgatggtaaaatgacaaactgcacaaagctctcactgctagaagcacaccaagtccaaaggactaccaagtaacttccttcaagttggacgagcaacagaagcatgtcaatgaaaacaactaagctcaacctactcaaagaagatctatcagaagcttctccgactgagaagctagtgaagaagatcagtggtggagccaaagctctaactttgtggtgtcagatgcatgaaatgtgggaccaattcccatagatttaataatgttctgtaggcatatccactaatccatacatgcttttgctgtatgttgcaaaaaactgtaggggcatttcatttcagtcgaccacacaactttaacatggctcccgcaatggagaggataggttagtgatcctgaaacgcttccatcacacaggaacaaaacagttcaaccttacttgcctcagcctcagccatttttaataatttaaaaccgaccgaccacgagacaggcatggggattggttagtgctaaattatgctatgatttccacgtagccattctccgctacattccaattgaaattaaatatccaaatggagcgcatcttgcggtaaaacgaagtaaatcgtacgtgttgggatataatacaaggtaacagaacccagccacaattctctctaccaacaaaatgaaatgatctgcactaaatgctgcaaagaatcccccctcctcctctttcttgtcagcctaacaccgacaacaagccgccatagcaaac

SEQ ID NO: 79146 - DNA, 15381 bp, Oryza sativa
accctgcagagcatgaatacttatattaaggtctgttttcctgagttaaaactccatatgtacagactgcagaagctgacgctttcagccatcaattgtccactaagaagactgtatagttgcatactatttatgttttgtctgtctcataaaacttaaatactttccatgaacatgttggcattgttatgaacatgacttgtattcaccagagggcaatagcccaaatatatacacagatacagggaaaaccaaaagacaggaacatggaaagccaaaagacataaaaccataaatacaacctatctaatacacatctaacacccccccccccctcaaactcagggtggatcaacaacactgagtttggagagatagaacctgtgttgagctctagtttgtgcctttgtaaagaaatcagccaactgcaactcggaaggcacgtactgaagagcaaccacctgatcttgtacctgtgtgcgggtatacgaggcatccacaccaatatgcttagtaagctcatgttttataggatcacgagcaatactaatagcacttgtattgtctgacaataaagaagtcggtgaagtcacaaaaacaccaaaatcctcaagtaaccatcgtagccaagtaacctctgctgtcaaaagggccatagttcttaactcagcctctgcactagaacgagaaactgttgtttgtttcttagtcttccaagcaatgagggaaccaccaagaaaaacacaaaaagcaaaaagagatcgacgatcggaggaatcactggcccaagtagcatcagaataaccctgaagttgtaaagatgtggagcgtggaaagaaaagacaacacgagatagttccacgaagatatcggaggacacgaagatgactatagtgattttgtgtgggggcagaaacaaattggttcaaaatgtgcacagagtatgtaatatcaggacgagtgacaccaagataacaagactcccgacaatatgacgatagcgagtgggatcagctaacggttcaccatcagtggcagaaagatgaagattaagctccatgggagtttcaactgtgcgttgatcagtgagagaagccctatccagaagatcctgaatatacttggcttgagagatgaaatccctcaggagtaggggaaatctcaatgccaagaaaataacgaagaggaccaagatcagtcataagaaactgctcactgagacgtgctttaacaaaagtaataaactccgcatcttcacccgtgattagcatatcatccacatagagaagtagaattgtgcgactgtggggtgaagtgtgaacaaagagagcaggatcatgagcactagctgagaaaccagcttccaggacaacagaggaaaaccgttgaaaccaagcacgaggagcctgcttgaggccataaagagagcgtcgaagacgacaaaccataccctctggaactgaatagccttgaggtggccgcatgtaaacctcttcatgcaattccccattgagaaaagcattcttgacatcaagttgcgatatattccaatgatgagcagaagctattgcaagaagtgttcaaacagtagtcatgtgagccacaggagcaaaagtttcatcatagtcacgaccatgttcttgttggaaaccacgcgccacaaggcgagccttatagcgttcaagagttccatcaaagcgagtcttgaccttatagatccacttacaagtgatgggacaagcatgagaaggtaagggaacaagatcccaagtaccagtacgctcaagtgcagcaagctcctctgccatcgcatgttgccattcctgatggacaacagcatcacgataagaacgaggttcagcaagaactgtagcaacataaccatagcgatcctctgaacgaatcgtaactaaattacgatcacgaaaattgtatcgaggaggagcaaccggagaagcatccagagaaagctactggacacgaggtttacgactataaacctgggtaagaggaggcacataagaggatgcagaattctcataagaaggtgccagctgagaggaagagacaggagaaggaatgcaagcacgaacaggagtatcaggaaaagtgagaaatagaagagtcatcgggagatgatgtggagctaggacgcgaaaagaaaggacgagactcatcaaaagtaacatcccgagaaatccgcatccgccgtcctacaggatcccaacaacaataacccttatgttcagcactataccccagaaaaacgcactcaacagactgagccgtcaactttgtacgctcacgtggtgcaagaagcacatagcaagcacaaccgaaaagacgcagattagaataatcaggaggctgaccacaaagatgctcaataggaatcccaccctgtagagcagaagaagggtggatgttggtcaagtaattagcagtggaaacagcctcagcccaaaaatgaggaggaacagaagaagcaatcataagagcacgagcagtctcaagaagatgacgatgtttacgttccgctacaccattctgagcatgagcacccggacaagaaaactgagaaagagtaccctgctcggaaagaaaaacgcgcaactctatagaaaggtactcaccagcggaatcagcacgaaacacgcggatgggagaatcaaagtgagtgcgaattatgcgagcaaaagatttataaatagccaaaacttcggagcgatgagtcatgaagtaaatccaagtatgacgagaaaagtcatctataaatatgatataatagcgatgacctcctttggaaacaaaaggagctgggccccacacatcagaatgaacaagatcaaaaggacgcttagatacagactcactagaatgatagggaagttgtatttgctttccaagcttacaaccttgacattgatctaaagagacatcacctaacacagaccctaaaagaccacgacgaactaaagccgacagacgagaaccacaaagatgtcccaacctatgatgccactgagcaaaagacaccatagaggaagcagcggaagcaagaagactagcaggcgcagcgaaaggaagacgaagccagtcaaggtcccaaagacgctgagaatcacggcggcgagggccagtaccaaccaggagacccgtgtgacgatcctggacacaacaagagtcagaatcaagaattacacgacagccatgatccgtaagttggccggctgacatgagttgcatggccaatttgggaacgtaagaaacagcagggacactgaaggaagaagtagaaagagtcccgcgaccaacaacagcaagaggagtaccatcgacagtatgaacagtagtaggaactaaaggagaacatatagatgaaagactagatctatcatgagtcatatggaaggaagcaccagaatctagaatccatggaatagtacctggagcagaagatggtccctcagtagaagatgaagaaccaagaacagcagaaccaaactgtgcagaaggtagagccacagaaccaacagaacctgtcgcagcagaagcagtaaggcgacgaagtaacataagaatttcctgtgaatctgaacctccagcactcttctgagaagaaccactagtacccttcgaagaattgccacgacgtaaatccttcttcctgaagcaaaatgactccacatgtccatctttatcataataggtgaagtgaaggtgacccctaccagatggcacaactgtggcaggaggacgcgccgatgattaagaggaagaaactgtagaactaacagccggtgtggaagaagccaaagaagccacagtacgaatagctaacaccgaagaaggaagtggtagaatacccgcctctcgaagacgaatgtcctcagaacgaatctccgtaagagcttccatgatagtaacacgcggatgtcgagcaagtaactgtgcacgagtggactcatactcggatcggaggcgtgtgaaaaaatcgtagatccgacgaagatccatgtgagaacgctgacgctgacagcactgacaggtatgacaaatagccggtcccaaagaatcaagctgacgccaaatagaggataactgtgtatagaactcatccaccgtactatccccctgttgcaaggactgctcctgacgcaccatagcaaggtaaagagcatcactagtaggagcataacgatcacgtaggtgtgtccacatgagatgagctgaagtaagagtaaccacctcaccagtaagatgaatctccatactagctacaagaatagcagaagctcgagcatcctcatccaaccaagccttgtataaagcaaactgactctgataattttccatggcatcatcaaactgctctttagcctttgctctatcgtcatcagtagcttgacttgcaagtgaaggcatagttggagcaatagggcaaggaggaaaaggtagctcaccagataaaacatcccaaagacgctgaccacgcatatgaagacgcatgtgctgagcccaatgactatagttgacaccatcaaaaagaactgggcaacgaggaacagacacagtgccggataaagacgacatcatcaagaaggaagaagcgacggcgagagagcaaacagaacaagcggcagcaagttttttttttttaatgcctcagcccaaaatatagagccaccacgtgcgatcagagcacaacagtagcagagccagagaagcctttttcttttcttctttttttttcgtttttttatacctcccgatccagatccggatcggggaaacagacaccgagcgacccaggcgacggcgccctacaacccaggcggaggcgcccgcgaccagggtcgacgacgtccggaggcctacaacgaggggcgacggcggccggaggcccgtgacgagcggcgccagccggaggccagcgacgagcagcgacgggttccggaggcccgcgactagcagcgacgggttccgacggcggccggaggccacgacgaggggcgacggcggtcggcgacaagaagcgatgacagccggtgatgaggacaaccaccagccctctacactgttctgaagaaattgacgacgttggggagcagagatgaacgattctcagcgacaccatactagatcaagaggaacatcatggcttcaagatgaagaggccgataatcctcaaagaaaatcatggagaagtcgagagagaaaattataagaagacgagaagtctaaacctgctctgataccatgttatgaacacgacttgtattcaccagagggcaatagcccaaatatataaacagatacaaggaaaaccaaaagacaggaacatggaaagccaaaagacataaaaccataaatacaacctatctaatacacatctaacaggcatgtgacaaaatttgactttggtgcagaaatgacaattcaagaagccaaacaaaccatcatcggtcttgcccatttaatcaggtattagtgagagaaccgagaacctgacaacattgtctaaccataccatatgtttgtaagactgaaaggggtaattctggaagctctgaaaggggtaattctgaaagctcctactgccaagtgcaggtgagaataaatgtgacaactaatggtaaaactaatactaaaatgtttgtcaattaagtattatgacttacgaaataactcgattgaaccactctttcacggcaggtttagaggcctagtgtgtgtccttcagaaggtagggtcacatataagtctgtccaaaactaacactgagcatatgcaatcttccttcagaaggtaggttaagctaatatggctgtcccaaagcaatattgagcaggagctgtgcttacaacgatggcgatggagtaatcacggatgcgctcgtagttgtccacgatccccatacgctgcagcgccatgagcctgctgtagggattgctgtccaccacctccgagctcatatcctgcatcgcatcagttgacacatagactgtaagcttttcacacccaatttccaattcggccattccccccccccccaaccaaggggaggagggaaccaaaaccctagtatttgcgccagatcttcgtaccttgatcttggaccgtgcagcggcggccggggtcaccattcccgccacgcgctctcgcatctaagcaaacaaccacagatccgatccacaggtcaaaaccaccaccagatccacacaggtcagaagaagccaatcgcggcgcgaagtgggcgggcttacccgatcgatggcggcggggtcggggcgctgcttgagcgcgttcaggtcgcggagcagcgcgcgcagctgctcctcgtccatgatggcttggcccggcggcgcgggctcctcctcctcctcctcctcgcgtcaccgccgccggagacggagagagccgcgcttttcctcttgtcactatcgaatcgagtatcgagagaggctgatcgagttgagacttgggattttgagagtccggcggagccgacacggcggcgacgcctgacgtggcggacaaagtggagccttgacgtccccgaatgacgtggcggctgtacacgtcggagcgggtggccacgtcagaataggattagagcaagtttaatagtgtagcccactactagctccaattcatctatagacaatttaatagctcgttcatacaatagttacatactacactattaataactggtcccacctgtcatacacacactacgtcttagagttcgtgctacagctggctataaatctgtaggcccatactcttctctctccttatttatcttcttaaaatatatttacatctgacttatagcctactattgtacctgctcttagagtaagtatagtactagcagattatataaattaggtagaagtatataagcaatactcactccgtgaaaaaaaaatcaaatcctggctatactcgtccaagttcatagcgcaggatttgagttttctttttcttttttcggggtgcttgagctggcgccagcttaggggagtaataacaggattgtgggtgaggatgggccaaaaacagagcagagcaagagcaaggatggggattttaattagttttttattttatttaattgattgaatgaaatttgttttactaaaattattttttgagctctaaaagttcacggaaaatttcagaaaatgctttagggcatggagaatattagaaaaatatttccagccatgatttttaaaggaaattttattacccacgttaattcacttgtttaactcatttaaaatttaatataaattttagaattacattatttaatgatttttaatctccgaaggaaaatcaggacgtgacacttactagtaacacgtgttggacaaaaggaaaacatagataggcactatatgcattttggttttgctcctttataagagaatatattatatgccattgagtttactctaatgctttattggatgcagcataaaaattgagcttttcagtgccatggaaatcggagcaagcaattaacacatgatcaattaattattataaacttgaaaaatgggttcgtttgaatttttaaagaaacttttatacaaaatttttttgaaaaaatacaccgtttagcagtttgggaagcgtgctaacggaaaacgaagaaattgaagtttagatttggagtttaaaacggggcctaattcaacgatttgctatggactttatctccctctataatatgccactatcgagggggcgattcttcggacaacggggagtggagacccctccccgaggttgaagattcaaccaggggttagtggtgaaatacgatggaaaaggctaaacaaagagaaggtttgtggggcccgacttccccgctgagcaagagaaaaaagagtttatacaggtccagaccacccggagatgtaataccctattcctgtgttggttttgttgtttttctcatatcagctaagaacaagagacgcctttccagtctacaaagaagaaggtctgatccaaaaaatccaaccctcaatccgtagcttgtcccattccttttatagaccaaggagtggctcgcaatgttacaaatccactttcttgtgttgtcttatcaaccgtctttgtcgatgttggctggtctcctttcatagtctttgagtaacccactaagatttgaaacctatattgccccgggcacccgggcttctgttcgagacagttgggtcacgctagctaaccctccatgtggggagtggtgggcttggtgagaccgagcctgcttaaaacagtgccacggttccgtttccgcccgtttggctacttcaggtagcgcacggcatgtgcgacacacgtccaggatgccaccgatcctaatgagtcagcgttggcgtcttgtccacgtcttttcggctccggactggacgcgtgttgacggccgttagtgatcagtttcaaccgtcaatattaccaaaatagagaagaactagttatacttgcaatgcatatttaagttagaataataatattccactagtattaggtttactaaccttttgctgaaaataaccataaagtggaggagaatcgacatcaaatcagatgatcaattaatcggacgatgtcgaggatcagacttatacatgaatgggccaagaactcagaattgacacgatgaactgggccaaaattcacaagtctacggagaggagcaacaaagggagccacctgccgaagttaggccaggatggcctagcccatggttcgaccgaacccccctcgcagccgtttgatccagggctttgcctggacggcttggattagctcccaatgacggttggagggtatttccaaccattccaactgtcacaactgtcattgggaggctatataaggagctcactctttccatttcaacacacacttcaaacaagagctctctcatattctctcaagaccattccaactgtcacaaaccgtcattgggaggctatataaggagctcactctctccatttcaacacacacttcaagcaagagctctctcatattctctcaagtttagtttagtagtctcaagctagtggagtaggaatagaatagaaatcagagtccgaaagccttcggaagagttcgggtatggctctagtagctatcctcttctcttttgtaagctttgtactttatttagaatactattctttatgcatttctagtattgaaatactttccgagtatatgaatgacaactttactatatgttcatgttatactgattatactgctagcttatctgggagatgcataggtacgagtataatgtttgctattgcaattactctatgtcatgacgatgatattagagtagtatctggtagtttaggtatggtgtctagattattgggtatcattatttggggttatatgctgcggatgaaaggtgggccgctgatggtgacagctcggtacgagtattcctccacgcgtgtatatagtcctaagttaatttcctgggggatactcctccgtatttagccccggttgtattgtcatgacgggctatggtaaggaactcggcagccagaggtggcttctcgaagtactaggagggcatcggaaagagggtattagctagttaatcttataactagaatgtatgtatactatgtatactagaagtataggaatatattcttttatatttttttccacttagcttagataatttagtatgagaatgagtagttctatgcttgtgtgtcactctaccctatagattatattaacccctgcttagacatgattattacaagtaacatataaactattagtacaattctctctactatgatcttcccacgggattaaataaatatagtacccttggaatactctcggggtgaaatgctacaatggtatatccgtgcgcttgcggatgaactctgtaaccataatataccaggagtatttctgcgccattgctgtgaattatatttctagtaatgtcgttaagaaataccaacaacgcgtaaacctgtttcatttatggctgaggggactgcttcacagcatcccgctgagcacacccctcacccaagctggtcctgaggtcacacccctgcgcattttatggcaattgttcttagacgagcttcttgaagatgtctttgataaagcgatattttatatatctagtatgtttcgacgctcttctttgcaaaagaatgtaaaattataaggactaagatgagcctggatcccaagtcgtggtcggggctaaggcagactttattttatatcttctaatcatccgcacggtgcggagtgggttccggcggcgaaatccgacgggggaggggtggacgaggtggcccgctcgacggcgaacgcgacggcgtcgacggcgcggcttggcgcggcagctagtggcggccagagcaacggcggaggcggcggagaggtgggcgacgacactagggcttaagagagcacgggagcgggtgattgcaaaacgaaaatgagagaggaggaaacgggggtgctttatataggctcacaagggtcgatcgtggccgggatggccgcgatttcgccggcggagtggggagaggtggggaggagagagaggcgggattcgaaattcgaatcccggccgtctcgagcgtgggcgcgggcgggagagagagggagtgggcgcggggaacgcgggggaaggcggcgacgtgggcgatgtggcccgggaggtgagagagcgagtggggcggcggttgcgggatgcggcggcgccagctggaggttggggatgggcccgacaggtggcccccacctgtcggcgaccccgggagagagaggagggggcgcgggcttagctgggcttagcgggcattcggccggcccagcaagggcgcgggagagagatggaaatgggccggcggcccattaggggaaaaaggagggaaaaaggaaaaagaaaaagggaaaagaatttccatggatttaaatatttgcttgtgctcctttttaattggttaaaattatttctagagctctgaaaattccactaaaaatcttgttagcatatttcgacatgtagaactcaagaaaaattccacatgccaattccaattattatttacattaattaattagggtttcactcttgcttttacaccggtattttcttgagaccatttataaatttaatttagtcttgggagaagaacttcagggtgtgacacaatctaaccgcctttaccccactggtctgaccggtccgatgccgtcggtctgaccgtggaacccgagcaaacacaaatcgaagatctctcaaagtaaattgcaactttattacttctcactgtgtatacaaagtgcaacaacagcactcctcacgaaaatctcgactaaactcgaaaccctaactattctctcaactcaactctctctaaaaacgatacagggaggccacaccctccctctctatttatacctgaggtaggcagtctaaagccacgaaccaaacttgtataagaagtcctaatccccctaggaaattaaccttcccgtacaagaaacaaactttacaaactccaattctaccaaatttgggctctctctaaattcgactccacatcccatacacacacaatatctccatcgtatgccatatggaatcttcaccaaccatgtgcatttgatctttagcctaagcatccgcatgatatcctgatcgtccggacgtcatcttctcccaagttgactcccgatccatcaccggcaacaatctctcgaggcatcaaaatcatctatacatgcatcaaccaagaaaccatatccaagtacaagttcttaccaacttgactcattgttagcacatagcagtattacatacgcatagtatctatcttgaagtcataaacatgaattatccacggatatccaacaaaccaacccgaaaccgaaaccgacacagaatcagccggtcagaccataggctagccggtctgactgctcgatacacgctggtctgaccggtagcttttgccctgtcagaccggaccaaacattcagcagtagtctatgttcacctgcaaatccaattatctccaaaaccactttgccgatctgaccgctcgatacacgccggtttgaccggcagctcttgtccggtcagacccgaccaaacattcagcagcagtccctgatcacctgcaaatccaattatcttcaaaaccactttgctgataatctttaaatatcaaaactaatcatcttatatgccaattgttcatcgtagaataagaatcaaagtcactttaattttacatttgcaaccctcgtcattggagcgttggatagggcagggagtctgcgagagagcagcatcgatgattggtgcgccactgtgctgggcgagcccctgcaggtacgggatcatgtgcaggcaggggaggagacacaggcaacagcgtcaagcaacaaacccctctcgttaattctgttgcacttcacttcccgctaatccctatgcagtaattaaaccaaacacacacacccagtggcagcggcaagctgaagtccgattaattaattaattaactatttaagcaaagcatcggttttgaggattagttgagtagggaagacacatacatgcacaaggatatgagatgatccagaggaacaagctaagctatagtactagctaactactctcttggaatgtggcgtgtgcacatacttgcttatcccgagcagcatacgtgcgtgggatcagagtagttaattaacaagggaatttcggctaattccctggctgctctctgatcagggttagttatgatattgatcccaagagaatgaattcagtacatggaacacattttaaaaacagatattctgatcccactttgctgaatttgcttgccttcactggcactctgtctgtcagacttcatgctagtgctactacaaccgtttgtttggtgagagcaggtattagccagctataaacatattttaatgggatagacgatgagaaagaagagcagcgggctacagatttgtagctagctatagcacggactccaagacgcaatgtgtatatgacaggtgggaccatatattaatagtatagtaagctactattatatgaattagctattagatcggctatagatgaattggagctagtagtgggctatactattgaacttgctatgatatctttgcactgaatcactgaatgcggaggtggtgtctctttgccctcaaattcatgaaacatttttttatcgaacaccagtagctgtggagtgtattggtaatttgttttcagcattgggaaaagcagcttaggaatgtactttgatttttttttgttccttaacgaagaaattataatattttggatgaaaacaaatcataaatgaacaggtacaactaggatatatatgtagcttcaacaaatgggtcatgatttggacatgtaataattaatcgtgtatatactacaatttagactattagtttttatatatataaacaagcaccgtgcccattttctcttgtttaagttacattacatgacagtaaatagatatattccttgcaaaataatacaacaaatacattacataattctccttcagtttcatattataagtcattgacttttttctaagtcattttttttatgtttcactagaaaaatatagtaaagtttttaataccaaacaaattacaacatatttgggttagatttgatggaactaatttggtgttacaaaagtcactattttttctataaactcggttaaacttataacttaggaaaaagttataatataaagtggagggagtagattacaaacatcaaaagcacacatcagcttcgatgttcaatgagcttaaatccgttgcaactcagtaaaggaaatttgcacatgcaaaaacatctccatggtccatgcatgtgcattgctcataccggtgaatatatattcgccttccagtaccgtctgatagcgtgaaatgagacgacgaccgtcgtcaagaacaaaccctattttttattctagtaccaatcaatcaactgatcacgagagttacctaccttagcaaccaagccaagtgaaagtagttagttattaattaaacacaatgggcacagcgcgagaggccaagatatagcctaattgctttctgccttctatcgatcgcttcgaatgatgttctttcgtgaacgttcaaatccaatgctagaggcacacactttttccaaccattttttttaaaaaaaacaaatgtcaagtcgtaacattggacacgaatgaagagtttaattgaagggtaaaattttcactatgttactgttttaaaataactgggagattttatatgaaaaattttgaaatagtgatgtaaaactatcgaagctgcagcagttgtgccgctagaactaatagcatcaccaaaagtactccaacagatcccctactcccttgcatgatttttggaatttcctttctcgaaatattcgcttgttgatatgcgggagaaagcggtgccctcgcttattcattcccaatctcgctgctcccaccttcctcatctccttcacacgtgtgggagatcggcacggctttcatgggagcgccaggaggtagtgcgcactgacggaggaaaacaaaaattttgttagtttaatagaaggtccacttttttgtttttttataaaatttaggttttctcttggagagatgagttattgtgtttcctattttcagtttaggaaaacaaaaatattttttttgagggggattatacgtaatctcttagtgatgctctaaagcctaataacaagcacagtgaaaatagtgatatatatgcagacagttgctaaattcaattccctctttaataaaaaaaacatgacactatttttaagggaatatataacgctgttaatttatgaacatgatatttcattttccatcttattatacaaattagtacaaatatataaaaagcttaaattaccattaccgataaaataatttgtaacaaaataaattatagtcccttcagtttttaataattaactgttgttttagatttatgtttgaccatccatttattgaaaaatatttaattatcatttatttttgttataacttgatttatcattagaggtattttaaatatggtttacattttttttacatatttgtattaatttttaataagatgatcggttaaatgtattttcaaaagttaatggttttatatgaaaccggagagaggacttacatatatagtctttttagtaacacgaattggtaaagtgatatgtccaaagttcaatag

SEQ ID NO: 79147 - DNA, 788 bp, Oryza sativa
ttttttgttaatccaaattcgctgcttgccgatctaagagtaaacctaaagcacgaattaagaatgtttttaacaaacgattttcaagcgtatcaaagctcatcttacgcgtagcagctaaaatatgcggattagctgctaatttttcacgcagattattgccaggtttacgacttaaccactgcaaagaacggctatcgaggcgttgtgctaagtaaactggggtcatctcatgaactctattaatcgtttgtcgaggcataatcagaatattgttaatagcatcaacagcatgatcaattagataagtaaaacgatcctgtaattcagtattttcgagtgcatggccatcgtgacttaaccaatgactcattcgttgtggtaatgcttcacctgtgagcggatcaaaggtaagattaaccaagtagaaatgctgtccctgtaataattgctgtgcaataaattcctgtgctgtatagcgaccgtatagttgcccaaagtcgttcaacttttcatttgcaaagttgatcatttagactccttgtaccgactcttgctgaacattagttttttgatctgatgacaccgtaggggttgctagcttaaatagttcttgatagcgttcattgctctgttcattattcaaataatctgcacttacccaattaaattgcccatgtcctatacgcatcgccttatcaaaatcatcaagaatatctaacttttctttaactaaaatttcgcgaattggatctaagcaatgctgtttggcatatccacgtatctct

SEQ ID NO: 79148 - DNA, 6486 bp, Oryza sativa
gggacttacccgatcagatatgagagaaaaatatttgctcctggttagtaacttcaccgggactaaaaattaaatctttagtccttaatctttagtcccggtttatagtaccaaccgtgactaatgatctaaatgatcttactccagatcaaaatttttataaccgggattaaaaataatttttagtcccggtttttactagatctgtgactattgtggaaatcagtcgaccgagtaaagatcatttctccagtagtggtcctaatgatcactcagctttcatcgagaaaataacgtgtaaaaaattgtcaagataacccaaaggcgtacaatagtgttgccgtggtcaaggtcgaccagcggcaaaactacctactatctctgccctaaaacgattttatttttatatatctcacatataccaacataaaactaaaaggctaaaaatttatttactttttcaaacttaaatgcatttatcccttacatttctaaactctactaatgtatttgtagcttcaatatatatattaactgtcttagaaaataaagttcttaaagtctttgtgagatgaaaggagtaggcactaataactgactctcagcctcacctgacagagaggccgagtggactggtaagctgcagaaaattgatttattaaataagtccacgtgcttgttttaatgacttggatcgatcgatcattttcctgggtcaaaatcaaaattctaataatatactttattcgatgctggccgagtttgactttgctcaattaattaattaatctctagacagctcttctcttcttcgacagttcgacccgttctgttctgtctgatactgacacaaataatttcttcttttttttgagaaaaaataatttcttctctctttctctttctctttctgttctaaaacaacagatttagaaaggagaggcatgatgaggacacaactagctcggatctaaccatgacgacattatgtattaatcaactaaaggtgcatatgttctataatagatttacttgttatatatttgaacaaacgttgctacacaatgagtttcgtgtgtttttgtttgcagaggtactttcttgggcgaaagaaaagagaccgagcgtaaggaatacatggatgattgaagaagttgattggggactaaaccaagaccttctccaagtcttcttttatctcaccacgccacttttggtccatagatgacaagagataaagttctacacgttttggattcagatttgggcctcctgacagcatcaacttcaaacagacctagccgctgatctagaaggaattttgtagccaccaggtaactaaaacaataacatgcaaaggagaagatactattatgttataaagaaaccccttattcctacttagccaaatagatcaacaaatagttgttgtatctatcaaaaacagattttctcatctctttggaaacacataaaaaccaattcttaaacatatgagtaacattacaaggaggttgtaaattagaaaccatatgaatgatatgtagaattatgtgatgatttaatcgtggtgatgaacaattatcacatgtaaatgtttatgaaaacacggtgatgtgtttttggacggtaaacaatgcggtggtcgtcactattgccggttagaccgggtggtgcatgtcggtcagaccggaggtgtctgggcagtctgaccaggttgcttgatggtcaggccgacaggctctaggtgggagtcggtttcgggttgttttcgtgggatttctagattgcttcatgtttataatttctaaatggtttctatttgcatgtgatattattgtgtactgatgtgagttaagttggtgcgaacttgtactcaaatatagagtttctttgttgttcatatgcaggtgttgcttgaggccatggaaatatagccagtgatagatcgggactaggcttgggggaatttgaagtccagatggtaaaggatatcacatgggatgctcaggttagagaacaatgcatgtcgatgtgaaagtttccatatggcatacacgtgggtgttgtctgcatatggaaagcagagttaaatttggattaaaatacatgtttggaaagattagagtttgtaaagtttgtttcttatatgggaaggtttcctaggggattaggacttcttgtatgagttggattcatggctaggggcagccacattatgggtataaatagataaggggttgaggctagaagatatcgactttttgggagagaaaagttagggtttgcttcgaggtttcaatcctagctcgtgagttgagaagggggtgctttagatgcactttgtaaacacattgatgcaataaagttgatttattttcaagagttttattggtacgtgtttttctagatcccgacagtttgaccagtgtactactggtggtctaaccggcgaaacggcggtggtctaaccgacagcaagcaagcgctcagaccggcgacggcgagcagcagaaggcgaggaagcggtggtccgaccggtcggacaataccgatcagaccgggggcgtagaggcggtcagaccgatgtgtacacggtggtcaaaccgactacgtcaagatctccatcaactacgagggttacttttattttcgctacaagtttttggttttttgtgttcctactattcaccccatggtagatttgtttggtcttgttcgatcctacatgatggaccacaccagacaagataaatgatattggaagaacaaatgttcgatgatttcatctctgtgacaaaagcagcatatcttactatcttttcattttaatttgatgtagagacttcatttgtgtcctaaggccctggatggatcaaggactaaattttagcccgtgtcacatcagatatttggacactaattagaagtactaaacatagactaatgacaaaactcattccataactctaggctgattcgcgagaccaacgttgattccttcgacgtgtcaattggacaaatacgcattggaaatgtttgatgcttcttggggcttctttggcgaccgtgaagtcactggatgaattgccgagtagatagatcagatccggaggagagtggaaattgctcaaacagtggagtgatgtggaaagagctaggtgtcggtcacaaaaaccttaataagaagtgaggagctgattgaatcataaaaagtgattgatcgcaatcttagggcaaagccaaaataatcatgagtggccacaatattataagtctcttcctcttgaccaaatctgagaatctattaagcctaattaatctatgattagcctatatgatgctacaataaacgtgcgctaattatggattaattacgtttaaaaattttgtctcgcgaattagctctcacttatacaattaattttattattagtctatatttaatacttctaattaatgtttaaacatccgatgtgacagggactaaattgatcaaacaccagcttagctaggttatcttgtaagaactacattccaatgatatcaaaggaaaattttgattttgaacggtctttttttttataccgttaccatcaaaggtaaggtaaattagagtacccgctcatcaaagtgtcaaattacatcggtgtccctcccatcctggcctctttgcaaacaagcatgtgctaagaaaaatacgaaccggcctcatttttagctatcaaaaaaagaaaaagagacctcatttttggctcaacctatgaaacgaccttatttttggctatttcagccgccgtctcccatgccatctctctggcttaacgggtaagctaactaggaacgaaattgacatggtcagggagactcatttcgcacatgctctaaatcctgtacgttgttgtcctgcatcgcgaggtcattttcgttgagttttaacttcagggagatgagcaattggggactgaaccgctgaatcagacctataaagttgaatcctttgtttgcggtttttatacgggcacatggacatttcctgcagctgtgaagtgactgatttgcttgcgatactttttggttgtcacatcgtagcatgttaatactactatattgtgtttaatctaacattatttattaatccctccatcgtagaatacctatagtttcagagttgaacacggttattaagaaagcatatataattaaatagtaagatattgtaattggttgagaagtgaaggtacgtggaaaaagtaaatggtgaagggttgtgattggttaggaaggaaatattggtggaaaaattgttatattttagaacaaattctaagtgctaaaagttattatattttgcgacggagggagtcaggatttctcttaccgtttttggcacggttacgcaaccccgtggtaagggttacgatggtaaccgcgcggttaccgtgagatatactgtggtttcaaaaactgaaaaatttaccgtgcatgtaacagtgataatcgtgcagtttcgtaaaccctgaagggagtatattttagcacggtctccctatcattatgttgctctggctgagagattgattgagtttggaacacgtgtacacttagcatcagattatgtagacaaaaattgttggcaagaaaattagacaaaaaattgcagctcagattttgcgaagggaaatgaaaacgaccacatcgaagaaattagtggatgattaagttttggaataagtatttacttgaataagcaaaagtttagattttataatagaaaaactgacaggatacgcaagatattttgccgagacacacaagtacacaactagctaagcttattgaggtttacggacagcactggcaaaagcctattacagcatgacatcacagttctggacgaatgccttctacttttctttttgaactattatcggtaattagcagagcgtccacattagttaacagtgaattttccagcctcataaaatctacattaactcaaggcaaaattgtacacaaaagctcaaaacagtacaggtaagtaacttaaaacccttcaacctctttggtatgaacagaagctatatccactgaaatgggtaactctgtcggagtaaacacaagcatcagtacccaggttggttttctaacccagtgttgagctttggtagaaaccaagttaatgatgacggtccagcttttacaaaacattaagacgagtttagggcatcaagctggcgctgaagctcctcaaggtcgtcatcaatagccccggatgtaactggagcaactggttcttggtaggaatctgcagttgggagttcgcggacaaggccttctgggaggctatctgtataatttcgaaaagtgggacgaaatggttaaatacaaccaaagagcggtaaataaagggacaacttttctaatagcaaaaatgaattaccagctccagtgcttagaatgcttggtgtcactgtgtcactgtcatcgacaacactggataagaacaaatattgaagttagcaattctacaaaagccacatttttattcatcaagcatgtcaagatgcagtacaacagaaaaagagaatgaagttacaattagcaccaaagtgcaaccctagcctagtagtttctgaatcctacaataatgagtagctaaaatttagcatgaaacattttcaaacacatgcaatcctgcaagcagggtgcttaagaaatgatgtgggcttgagcatggggtacaaagttctatccaagtcaactatcttgtcagctccattagtatggcaactgaatctgtaatgagcattagcataattgatcacagacatcctaattattaattctcagtaattgccaaatttagacataagttgttagttcctacttcctacacatttgcctgtcaaggaattcaataaagtacatgaggaatgacttacctaatattccaatcattatctagatggaccggacattcatctgctgctgatgcttcagcttccatcttagcttttgctgctgcatctctagcaggttttgactgcatatattctttctacaaaatgatcaaaagaagggtaacattcccgatctttcacaatgtcaacaatgtaaacatagggagggcacatgggagaagacaacacctgtctctgaacacatgctggatttgaacactgtggatttggtttcatttccattgttgggaaataatccttaagtgaattatatccctgcgcaatcagagggcattacaagattttagaaactaaccagtacagtgctcgaatgttgagttgaatatgatgaatcagaatcaacgtgagccacagtggagtccccttttcatatgaacagtatatcatgttgttccccagaaaaagtatctaatcttgtgcagttacataggaatagagaaaatagcaaaaatgctaacaaaattacaaaaaagtttttttctcagccaaaaaatttcaaaga

SEQ ID NO: 79149 - DNA, 59101 bp, Oryza sativa
accaaatgaaaatattttgtgttagaatcaccctctaaaatatccttagatttcgccctctgataccatttaacttcctcttctctcagaattgtagataatctatttctacaaaaccatctaaaatccaattcctcctgactcaaaagcatagtttctgcctttttatctagcaaatccaacttatctaaaatctccttttttttttcttttttgtacaagccactagtatgtttagaccaacccctaagatgctgtcttaaacgacgaattttcgcctgccaccgctccatggcagaattgccttcatcaacactagaccatatctcctttaccatatcaacaaagtcatcacgtaaaagccaaccaagttcaaacttgaaactatgttgagcattactcaaagaagaagtgtttgtatttaaaagtaaaggagtatgatcagaaatatctctattaagagccaccacagaagataaaggaaatttatgttcccactccgtggacattaaaaccctatcaagtttctcatatgttggattcactaaattgtttgcccaagtaaatttcctaccagacatctgtaactcccagagacataacccatcaataatagcattaaaaaggaagggccatatatcatcataattatcattattcttttcatcagagctacgtagaatattaaaatcaccgccaataagaattggtaaggtttcatgactgcacatattaactaattcagcaaggaattgatccttaaattcactttgtgctggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctaggaggtttgcaatgccacaaaaattctttgccagcacatagatttttaagaacagccggactaaaatctttcttaatagtctctgacaaggcaataaaatcaaggtgatgttcctttgttaaatcagaaataaacttatgttttttcgggtccttaaacccatcacaattccagaacaaccctttcatttaaaaatattcttttttttctttccccttttagtctttttcttactattaggagaggtatctaaagaatttaaagtggtctgagaataattatcatccacagcactaaaatccatcacctcctccattaattcaccacacaaatgttgaagtagagaattatcatccacctgatcatctaatatctcactatcaacatttgaagtatgtacctgattaacagaagaactaacatatttacttaacctcttttcctctatactctttaaatcatttttaacatcatctaagataaaattcgtacccaaagtgatcacaccaagattatcaagagcagcagaaatttgttcatttgtaaattgtaaaaaagaaacattatcatgaaagttaccttttgcctgcaagttgtccaaattcttatcagccttcaatttctcagctctttggagaacaagttgatcactgtcacttgcccttctcttgctcttcctggagggagaaattactgcttcaggaatagcagcgagcttttcccctagactttgctgggtattaaccttcttaaccattacagaatcctcatctaagccatcaaattcctcatcagatacagtcaagccatcagattcaggtatcagactcaaatgagcagccggtatagaaggaccacccctctcactaacctgaccaccagaacctattaaggaatcgttaccaggatcacctccagatcccttccccaaatcctggttcagattcccctcctccttctccaaagtcccatcatccagattctccatatccattggtacaggctcgtcagacccattgtcaggctccactataaaagataactcgtacaagtggtccccaataaccacatcaaccacatctgggatcaaagatggatctaggaccaaaacttgtaaacgagcaacatcataccttctagtaaagttcataaacggtatatcgatctccttctctatctctggtgagttatggtatgtagttccataaacggctgtgttgctaaggtaaagaccttgttgtggcaattaacaggtcgtgagagatcgattaaacccgtacaatcctgtttttttttctatttgttagctaagcagttacataaatcttaaagcaaatctagctaaatagcacgatctaatctagttaaatattagcacaaatcctggagcaactcatgagaccaaaaaatcgtgtgatttcttaacgaaaatcacccctgtgatttatagcaaaaaaaccgttcacattatgtttagttcccaacatagatcattctctcggcttatggggaattattctactctcgcgaggaaacatcctttatcgtttccatgttactcaaacggatatatttttaaaaaaaaatcaataagattaatataaataaaatcatcactccataaacatgcgatgtcaaatttaacatgttgtaataaaaaaacaaattttaatgtgaatatacgttaagtatttatttatttttaatttgtagaagttgaatattaacatgtatgtttatgaggtgatataacacatattaatatatcctctaatttttgttaagatatgatatgcaaataattagaaagtttaaaatccaggctaatagtctcgagttatttagttgtgaccatcatttcgccaacttatacttttcgtctgtccacgtcgaatatggatcagaatctatccactctctgtaggctcacacgccgcgccacgtctatatagagagagagcaaaattaacgtgactccataccaacgaatgctgttttagaatcaagtagtccccacgcacctgatcattgtctaagtacgtagttagggtgcaaatggccggagcaccgacgagcttagggttctccgtcaggcgccgcgagcgcgagctggtggcgccggcgagaccgacgccgtacgagttcaagatgctgtcggacatcgacgaccaggacatcctccgcttcaaccgctccggcatcagcttctaccgccacaaccccaatcaggacggcgtcgatcctgtcacggtgatcagggcggcgctctctgaggcgctcgtacacttctacccgctcgccggccggctccgcgagctgcggcccaccaggaagctcgtggtggagtgcaccggcgagggcgtcgtgttcgtcgaggccgacgccagcttccgcatggatgacctcggggacggcacgtcgacgtcgtcgccgctgcttgcgccgccggtgccgtgctacgacatgctgctgtgcgaggcggagagcccgacggcagatgtcgtcgaccgccccctgctgtttgttcagatgactcggctggcgtgcggcggcttcgtgttcgggatgcacatatgccactgcatggcggacggctccgggatggtgcagttcctgacggcggtgaccgagttcgcccgtggcgtgccgggcgccccgacggtgccgccggtgtgggagcgcgaggcgctcaccacccgatcgtggccgccgaccgtcacgcgcgaccacgtggagtacgcgcccctgcccgtcgacgacgacgacgacgacgtgctgctctccctctccccgtcgaccaacgcgtacgcgcaccacgtcttcttcttcggagatcgggagatcgcggcgctccggtcgcaggtagtggcggcctgctcgcggttcgacctggtgggcgcgttcatgtggcggtgccgcaccgccgcgctgcggcacggccggggcgacgtcgtccgcctgaacatgttcgtgaacgcccgcgtgaggaaccggcccgtgccaaggggctactacggcaacgcgatcgtgttcgccagcgcgtcggcgccggcgggggagctgtgcgggaggccactcggccacgcgctgcggctgctcgtggaggcgaaggcgcgggcgtgggaggacgggtacgtgcagtcggtggccagcttcaacgctgctcgccggaggccggcgttccccaagggcgccaggacctacttcatctcggacatgacgcgggcagggatgacggacatcgacttcggctggggaaagccggtgtacggagggccggcgacgacgatgctggccacgtttcacctccaggggaggaacgaggctggcgaggcaggcatcgtggtgcccataagtttgcccagtccggtgatggagaggctgatccaggaggtggacaaggggctcaatgccggagctgctgccgtgctagacgacgcaaaagcaagggtggtgcctgatgaaggctacgttctagcaaaattgtaggtctcatctcgacggagtacgaaccacggactgcatgtacgccacgaccacagcagctctcaataataataataataataataataataataataataataataataataataataataataattgtattgttgataattgggggcaactatgactagatgcccgatatttgttaaatagcggccggtgttgcatcccatggttataaccgtttcagatgtttcattacttagtacaaaatgtttcagcacttggtaaaatgtatttactttaacaaggagagaatctactccatgccactgaacttgtcagttgtcacagttcaatgatttgtcgctaacattgtctctttctctaatataccagtgattttatcaattgttttacaatatacattgggttggactttttttaaaaaaaatacccaaaatacccttagagacatacaagattaacaattattttttctcattagaagtttcataaaaaatatgaaatttttaatgtagcttccttacaaaacatggaaacttgtatataagtttcaagtttttctaacatatttattttctagaaaaattatttttgtgtggtatatgagagagagtttgcttacacaaatgatgatttatattaaaaacaccaaaaaaatattttatatagcatattacagataagttatatttttgaaaaatgtagaaatacaaacttcatattgtgtaaggaggccatatgaaaattttcatagtttttcgaaacttctaatgagataaatcaattgttaatcttgtatctataagggtatttttgaattttttaaaagaatgtccgatccaatggtgcattgtaaaacaattgataaagtcgtcggtatattataaaaagagataacgtcaatggcaaattattgaactcgaataaactcaatggtatagaatagattctctctttaaaaagttggttgcaacaccgttatatatgttgttgtgcatacatatatagtttcttaattaaaatataatctagtaagatcttgttctaaaatttaattataacaaatatataaccacatcatgtaatagaatctaaaatttctcaaattgatcatcatataaccatatggatacggatttcgtcagaatacaattaatggagtatgggagaatgtgtgtatgctagggtataattggcatgaggttttaatccatgcatgcattgtgggagaatatatgcatggtgtcttgattgatgtaatttaaattgtccttagtcttggtgtataaacttatatgatgatcaatttgggaaggagagagtaatttagaagaaaacaaatcatttcaagccattcaatatttaaaactacactctattggatgctcgcatgtgcatcccttcatatgtgagactgatggctgtttcatacacattgggtaggcaccgtctgattttatttttcggcgtcgtaggggatcgattttcgcaggcgggcatgtaattcggagccaaaaccccgccggcaaaaaaagtacccggggtggagtgggcggtccgcctgcgaagatcgatcttcgcaggcgtcgcttatatggcccgcctgcaaagatgcccctatatagtcttctttctccccgagccctgttcattctccccgacgtttctctctcctaaagtgacttaaatatagggggaggttttgaacttcaaatcttcgggggatttttctacagtacttagatctactcatttccacactaggtatgcaattttttaagcttttagatcttaatttgtgatggatttatgcatccaaaattgtgaaggaagagctccatgttttttaattttatttcttttgatatgttgatgttagatgtatgtgtaatacttgatgcctcttgttgtagtggtttaatgtggtaacataaattctcgattttttttatttttgctatcacatccaccacctagttctagatctagatctagatcttgtcatatatagagagagaataaaattttaaatgtctatttattcggtgcaatcaaaaaatagttatagtattttgtaatatgccgatgatatgattttgttagattttcctaatgtactgatttggcatgtctatgtaaaaaaaattgaaataaactttgatttttttattaatttacacttaaccttaacctttagttaattagttttgaatagcgataatttttttcaataaaccctacaaatttggtattaattgtgcaaatattttacgtgtatttttttagagatatggaaagtcaggaatggatgtatcattggccgaggtttttgtctccatatagaatcgaagtggctaaatttattggtattgccaaggcacacgctgagaagaataatatgaggaagataatttgtccatgtgctgactgtaagaatgaaatagcctgggactttgacgatgcttttaaagtaaaggagcacttagtaactcgtggatttatggacaattacgaaatatagacacgtcatggcgaagaacaagtggacgggccagaaaatgtagttccgacacaagttgaagacatggtgcatgacgatggttctgttgaggacaaaatcgacctagagtaaatgttacgtcatgcagaacccgaggtgctgatggggtcggctagagggttaaataactttgaagctttacagaaggcagcaaaggaagttttgtacgatgagtcgaagggctgtgatagtgagttcacaacactccggtcagttcttgaacttttgaggttaaaggcgagacatggatggtctgataccagtttcgacagtctgttagaacttctgcagaaaatgctcccgaggcctaactcactaccatccagcacatatcaagcaaagaaactcatatgccccctttcacttggtgtggaaaagattcatgcgtgcgtaaatcactgcatactgtacaggaaagagtacgcttctttagatgaatgtccaacatgcggtgcaagccggtacaagtcgaatagcaatactggcctagaaccctctaaagcaactgagggacgatagagaaaaatcccgcagcttgtgatgtggtaccttcttgtcaaagaccgcattaaacggatatactcaaacccgcgagatgcggaactaatgcgctggcatgaagaagggcgcaagaaggatgggatgattcgacacccgacagatgctcgtcagtggataaactttgatactcagtatagagagtttgctaaagacccacagaacattagatttgccctgagtactgatggagttaatccttttggagacatgagcagctcacatagtacttggccagtgcttctcaccatgtataatcttcctacctggctttgtcaaaagcgaaaatacgtactactctgtatcctcatacagggaccccgtcagcctggtattgatattgacgtatttcttgaaccattgttggaagatatggttgatttatggaaagagggattgaaagtgtgggatgagtacttaagggaatacttcacagtaaaggccatcatcttcgtgaccattaacgattatccagcaatgttttcagtttcaggtcaaattaaaggtaaaataggatgtgtgatctgcttgaatggaacgtactataggtatctcctgggttccaacaagcttgtgtacatgcggcaccggcggttcctacgcacaaatcacaagtaccgcaagatgaaggcggagttcgatggtactgaaaagactgatcctgcaccaaaaactacatcgggagaaaaggtgtgtgcaatgacagagaaaattgtttgcgagtttggaaaaatgactaagaaaccatcaaaggggacagcgcaagaaacccgagaagaatacgaagggaggggatagtaagaagcaagatgacagttcgaagccagatgataaactccctaccccattcaagaagcattccatattttttaagtacctctcgtactggaaagatctagaggttcggcatgccatagacgtcatgcatctagagaagaatgtgtttgacaacatagttggaacattgttggacatgccgaagaagactaaagatggtctgcaatcaagaatggacctagtcgagatgggaatcagggaagagttacaccctcaagaaggagaaaagaatggcaaagtatatcttccaccagcctgtttcacactgacacctgaggagaagaagtcattttgcaactcactccgtgatgtcagagtgcccataggtttctcatcaaacatcagtcgactagtttcaatgaaagatttgtcggtatctggttataattcacacgactgccatgtcttgctcaccgtgtttcttgcaattgcaataagggccataaaaccggagcatttaaaggttgctatcacaaggttgtgctactttttcaacgcagtgtcatagaaggtcattagtctcgaagagttaggaaatctccgtatattcgcacatgagacacagtgccaacttgagatgtgtttccctccgtcatttttttgatatgatggagcacctcattgttcacatagtgccacagatggttgcacttggcccattgtacctccatcaaatgtggtcatacgagcgttacatggcggttctgaagtgttacgtctgaaatagtgcacatccagagggatcaatggttgagggttatagtactgaagaggttgtcgagtgttgtatcgattacctcaaatatggatatgcaattggagtacctgtgccccgacacgagggcagattgagtggcaggggaacgataggaaagaagagattcttcacccatgatcacaaatcattccaagaagctcacttcagcgtgcttcatcagtttgctatcgtcgagccgtacatcgatcaacatatcgaactaatacgagctaacaataagggtcgcaccaccaagtggataatgaaataacacaagcgtctcttcatagattggttgcgagacctagacttacctgagggacaaactaccgatgaaataactatgaagcggttggcttgtggtccatcacctacagtaaattcttggcagggatatgacattaatggatactcgtttagcacaagagcccgagataataagacctgtacgcaaaacagcagtgtctgtgtgaaggcaattaatgaagccagggaaaaacaattatacttcgggtttattgaagaaatatgggaaatcgactatgggcacacaatgcaattccccatatttaagtgccagtgggtaaaatacccgaacggggtcaatgttgataagttcggtcttactattgttgacctggcgagtgtgggtcacaaggatgacccttgggtactcgccaatcatgtggcacaagtgttttatgtgaaagacccttcaaatttgaagaaagatatagtgctaccagggaaacaaaagatattgggagtggatggggttgaagatgtcgaagattacaaccaatacgatagtatgccactttatagtcagtttgtacagaagattaagaatgtcgagacatctactcagaagaccatgaagccttacatacgcacggacggtgtgggcaaaaatgttaaagggtaatgattgttgagtggcatgtaagcatctaagaagttagtagttatgtaatggtggtatgtaaggtgatgtgtgatcatatcgcaaattgacgaacaattgtactcaacattttgcatattaattagtttgtactaatttttatgtgcaattaccatttgtagtgtaaaaattttgttaaaaaaattaaaattagtaatatttgaaaagtgtaattatttttatgtgcaattaccatttatacatttgaaaagtaataatactaaggtttgtacattttgtaataatattaagatttgtatattttggaataaatatattcaactctgtacaaattttttcagtcggacggcccgcttgcgaagataggaaaaaagatcttcgcaggcagacggcccgcttgcgaagatagtaaaaaagatcttcgcatcttcccaggcggaccgcccgcctgcgaagatcgttgcccaatataagggcaagcccgcggcgccaaaatttctaagtccaggcgggaaccctagaaattttggcaccgtcaggctgccgaaatttttcgccgccgcacgccttcgccgtcctccgccgccgcccgcctgcgaccttcactctccgaccgtcgtcctccgccgccaccgaccgtcattgtccacgcgctgtcaccgagaccgccgccccttgccgccgctccaccgcgcgcgacctccaccactctgccgccgccgccgccgacccctccaccgcgcgcccgctccaccgccgccagctcctccaccgccaccggcccctccaccgccgtcggccacccctccaccgccgccggccgccacctctccctctatctcgctcgcggccgaacggcttaatcggccgatcgttgtccacgagcgaagtcgtcctcggccgaacgacgtcttcgaccggtcgtcgtccacggccgaacctcgtcttcggccgttcgtcgtccacgaccgaagccggtcgtcgtccacggccgaacctcgtcgccggcccttccttcgtcgtccacgaccgaagctcgtcgtcggccgttcgtcgaacacggacgtgtgtgcatgtgggtgtttctttttatatgtgtgtgcatgtgggtgtgaatgggcatgaggggtggctgatatgtgaatgagggcttatgttgattgtgaatgtgaatttgggaatgtgggtgatatgtgaatgaaattgggagggtacgttcaattttgcaagatatgtgaatttgtcaaattttttaaataacatgttggagggtatgttaacatttttttaaaaaaatgtggaggatatgtttgccttttccattttttttaatcaacatgttgatgaaataaggaagtcaattagtgcactacttgataataacatatcaaattttgtacaaatttgtttgtagtaattaatttagcataatagtaagtagtcattagtttcgcaatttaaatttgtttgtattaattaatttagcataatagtaagtactaattaataatatttcgcaatttaaattagtttgtactaattaatttagtataatagttaaatttggaaatctcagagaatttaaatttgttcatacgacatattgttaatatacagtttatttttgtacaaagttgtttatactaatttgagtaatttaaaatgtggacgataactctttttttttatattagaggtttgaaacgatggccgatagtactaaagggactgaagagaagggtttaggggagcaggagctgtcccttgctgttgtggttgctccggaaccaacggtcccaccgaaaggtagttccaactgcgacgttggtgatgaagacgaggattactcgtcgccaagcgatccttgtccaagcccaagcccgaagagaaggaaaaagggcaacagtgaagaagacgacaaggactacattccccctaaagaaggggtaagtaaacttaatatgtaaaatgttcaccgtgataactattagcccgagctaattcgaaacttccatgtataccttctcgtaggaaacggcgccacggcgatcaaaacggcagccgaagaaaaaagttccgtccaaagacgacgacgtaccagctaacacaaccggcacaaagaaaatcgaacggttagcaatcacgaagaaaaggaagggcgagagaagcgtgaatagaaaggatgaagggttccatgttgttacccatgtttcgcctaaaggagagccgctcgcccctaagacggcacgtgcgaaattcagttcacagtgtggcataatagtaagggaaaagatccccatcacggtcaagtactgggattatgtatcgaatggggataaggaagtcctatggaaagagttgaagaaaatcttccagttcccggatggatcaaaggcagcagtaagaaattgtgcactgcaaacaatggccaagtcttggcgtggttggaaaaccaccttgaacaagaaatttgtgaagactggacgcacaccattttcgacgtatgccaacataacccccaatcagtgggacgactttctgaccttgaagaactccccagaagaaattcaaaggagccaaaagtatgcagagttggccaagaagaacaaatttcctcatcgcttaggctccgcgggatacgcgtggtgagtggaatggtttagaagctttgattcttcaagaatgtccttacggatataatgttcattgtttagcccaccaaaactaggtacgaaatgaaatccactcctaaacttagttgtattggtattggcctgccactggtggagcagtggacaaaagaggaggaggaaatgaggaagaaggggcaaccggtaccaatggaggagtagacacagagatcaaggaactgggtaagagctagaactccaaagatcacggatgaaggaaaagtatcgtttgaaaatccggagctgcagagcgttgccgataaaatagaaaatttatccagttcacaaaagaaaggatatttcaagcttgaaagggagaaagatgtgctaagtacggcgctgggtactcctgagcatgggggaagggttcaaggtgcgtcgagtaagatgagttggaaggaagggttcaaaaatgacccctacaagaagcgtgaagcgtacaaggataaacttagagacgaagggactgcggagtttgaaaggcaaatgatggatttctgcgtcaagcacatgattttgcctcgccccgaaaccaaagaacctgagccagattaccccttcgataacctcaaggagaatacaccctgcagattgcacgttcccattggacgctccgggaaaactcttgaggccgctacagccattgctatccctgggagaacatacaatgaagagttcatacccgctgtgtatgccaaggtgcagccgcaagtggtccacgaagggtttgagtcctacgacattgacttcccgactgcagatggtgtatccgtacttggggatgcagtcgatcttgtaattctctggcacaagaatgacatatcctttggattgggcaccgacgccacgcaaaaacctgtggtgcctaaaccggggttgggaaaacctccgaggcctcctaagaggaaggtgactgataaggcggaggaaccagagatgtaaaaggaaaatccagtgccgaaagtgccaccggagattgcattgccggaggcagccatggagattgcaccgccggaggcagccatggagattgcaccaccggatgtgcccatggagattacagtggcagaaccagaggtgcaatttgtggcatcagtcgggtcagacaaagaagaagtaccaggattggaatgggacggtacagagccagaaatatttgaagacccttctcctgcgaaagaccccgaggtgccacgagtgcttaggagccacgactccaagtccaaagatgagaacaaggagaagttcatggtaaccgtcttcagagggggtaaagaacgtgccaagctcagagatgacgacccccagaaagctgctgaactagccgggccaacatacttcgcaaccgatgattgcccggaaaagtacgaacatgggaaagcactcttgccggaatgggcactgaaagaagcaccatgggagatgagaaggttacataacttctacatggaggccagcaagaaaggcttaggcaatataacagctcgatcaccggcagattgtttcagcgaagaaggttacgtatggctagatttctcatatctccactccatatatcgtcgggataagatggacgtcaactgcgtcggtgtttggtgcatgtgagtatgagttttaattaattagatgaaaaatatgtacaatacaaatccatctgattgttactaacaaacttcttctgtaggatgcaatacatggatgctaagaagaaaaaagaacccatcggcttcttggatccaactcggatctgccaaacacagcatgccgtgacgctagcaccagggtcaaaccagctgaagggcaagaatccaaaagagatagcagaatacaagaagggcttgcataaggagaaattgattactgtcgcacagtacattggacgagccttcttgcactttcaaaataagagagtcgtcatggccacttataattttaagtaagtccaatacatttatcttgtacacatatatcttattttagctagtactaactaactataatgttgttaatatgtagcgatcattatatctgtttactcatccaccctaaagacggaaccgtggtagtcttggaccctctcgattacagtcacaagcaatacaaagaatttctaacaatcttacagtagtaagttattatgactcttgcatttgtatatgaatgtattataaataaatatcctccttactgtgaaacggtacgacatccatacagtgcataccaatactacaagttcaagggtggagaacagacccgaacacgggagaagctgctagtacgtacctattggccggtaatactccactcacttaatgtattccaattgtttcactaattgcaaattttaactacttttttctataatatgtcctgaagtgtcacaagcaaccgcgaggaacggtcctttgcgggtattatgcgtgcgaattccttagggttaatggacggtacaggactaacgcggaggatgtaagtctctatactatgtactagacagctccacatatttatgatactaatatattgattaatttcaatgcatgcagttgccaagattagaatgtcgaacaagctttgacgatacaggtatcacaaatgtccagcgtgatctgtgccacttcatccaccatgagtgctgtcatgtgaaaggagacttcttcgacccagagggtgccctagcggcaagtgacgaatttaaggatcttcgagagtagaacactgctatgccataatgtaactagatgacgttatttgaagtgacaatgtaaaaaaatattgtaatatatatattttggcaacacttttgagttatgcaatatatgtagatttcttagtaccaaatgcttgataatcttccaatatatgtacataaaaatctacctgcaagaatttctattaaataatttaaaagtaatttacgggcaaattattattaaatttcaatattttctacctatcttcgcaggcgaaagtttttttgttttcaagcggacgattcctattttcgcaggcagaccggactagccaacgtccgcctgcgaaaattatctttgcaggtggacggccgccccgcctgcgaagattggagatcttcacagacgttggcttacaggcggacggtcgccccgcctgcgaagaccctttttggccgcttgcgataatgctttttttaagtagtatttcagtcaattcctaattaaaaaattttcactttgactgccttaaaatagaccaaatctaattcgtacccctcacccacataaccggatatgacaactcctcaaactattaaaaccagtgcaatttgactcccttgacggttttgctgatgtggcagtgttgacctggtgtttgtctcacgtggcgcttatgtgacattagaattaaaaaatatatgtgggactcatctgtcattcacataaaaaaatatattgtaggacccactgactgtgggtccacgtgtcatcctctctcccccttgtcccagcgtgtgggaaggagctcgccggccgaccaacgttcgtgctgggaaggatctcgctgggaggccgtgcgctaggaagcgtcgtcagctgggcaagcgggagaggagctcgctggccggacgtgcacggagtaggagtccgcgacaccattgtgagcggggttcatcagccactgcctttttgtgcttgttcagggacagcatgtccacgccgcgcctgctttgcggttccgcgttttcgatccacgggttaggtatatttttgctaaatccccctctatctatacacacacacacacaaattattaaggaaaagaatatatcaaagatctatccggtcgtggttgaacctctgcaagcagttcatctcccaacatttaggatacatacaaactgcatttcgcaccgatgatgaactggcagccttatgatttctgaccagtgagcatatgtattttgcgagatcccgcgaactgcattttcaagttgtttttgggctgtttaaatgtatgcaactcgtctgcatttctggatctctttcgtccatgcaaaggctttagttctttcacaaggataggaaatcagggggctcctaaaggcttgctcgcgcagccgcgcgcggggccctcatgcctagcgctaatagcgttgattagggctaatgacgctaattagtgttaatggtaattttaggagtttttcttaaaaaatacataagtaattcagttaaaagtttttaaaaaatagttcagttcagttttcaaaactttcacgtctaaattttttgaaaactttcaacccgaatttaaaatttttcaacccaaggtttgaaactttcaacttaaatttgaaaactttcatcttaaaattaaaaacgttcaacttaaattttaaaaactttcaaacttaactttgactcaaaattcacgcatattaaaaatatcaacaaaataatcacgcgaaaaatttttaaaaatcgggtaaaaaagctatatacacatatgattaaaaaaatcacccggagaatagcctgtcacacaaggaagccacacgcgcgtgtactgattttcactagcaacgtgggttcacatcctctaccataatggtactatcatggtatctacgtgtgggacaagaaggttgagatccacgtaccggtgatgataatgacattatggtagaagatcctcaccctagttacatgtgggacaagaaggttgagatccacgtaccggtgatgataataacattatggtagaggatcctcaccctaatggcacatacgcgcgaattatcttttccgaagaaatcaaccgtgccaaaaaaactgcattgcaatgtagtgtaccaccctggatctctttcggccgtgcaaagcaagagattgtcttctgggcgcagcacagggctgcaacttactcaggtgaatttttttttaggagtgcgactaaaaatactaaaaataatgatagcattataagggagaaaataaagcatttactgtagttgtaactactataataaaaacggcaataagaatcagtgtcatacaaaatgaatgtcaaacaaaatgctgacgcttaccatttaaacggcaaaactgactaatattgtaccaggaagcagcaaatggttgagttgctgcaaaatttaatcactccataaaacgatgggacccaattccgcttttttttccggaagaaaaagtgacagaccatctcattccattgcttaaatgaaacataaaacctgagttatttctcaaatgaagcgttataaaactgtacaataacatacaagacatgttaacattgcggtctggtactatttactgtttagtaaaaagtacattttatatatggtttcaacattttgacgtatcaaagctttacaggttacaattttaccactgccttccctcgtcttgctaagaagcaaaacttgttcactccagttgcgccggggtacatatacttttgcaaaaattccaaatttttacattatgcaagccaatagcgtggcggggatcacacacaccagggctttgcactaggattgatcattcctccagaaaccgaccaggcccataaagatttgctgcaaatctatgctaacgtcgcaactgaccacagaccagttctctaaactatttctcgaacatatagatgaatcagacatattgcgctcacataatctctgcgaatcttctcactttgacatcagtgcaggggaagacggcatgacatgataaagaaaaaaaggattcacttggattttcataagcaattgcttgtccattgttatatgttagcagtttcccatttggtgtctaaaacaactggaagaaaagacttgtagaaccatcaccaaatgaccgaatatcagcaggctttaccaatgctctacacagggggcaagtccgttctcgctcaaacctaaaacagaaccaggaaaaagctgtcatttcttgatacttgctcaaattaaggggaaaaaaaggaaaagctaagcattgaggcacttcatctgataaggaatttatgttcatgcaactgaattctcattagtcattttaggaatatatcttctgcagcatcaccaaaagcagtagtcatataaaaggcaagactgtgacaagatgccacagaaatatcactccacatcctcttctcatactataaaatctaattgccattcttagattgcttcacgccaatgttaagaataaacatgaatatgttgccatatccaacaagataccttgctcaattcaaaacaaaggcccaaagaaccaaataaagcatgtaaaaaagtataaaataagaaaagaatttaccattcagagacacagtcctcacagaaaatatgtttacagcggaggaggacaggaacatgcatcttttcctggcagatggcacacatatcaccagcagcaattacctgcaccaggttccagcaaaaaacaagttctttaaacaagatagagtgagagttcaagggggtatcctgctaccaagtaccaactagcgaatacgtgttaaatggacagttggctccacaaataagcctgatggctgaaagctgtatggtttatcgataaaatgatagtatcttattgtactattacaaaatcctacaaatgcttacgatttatcaatagttatggcatattgcatttttaagttgagcaacttgccagtagatgaacgtttacctgttctgctgtcgcataagacccataatgcacatctttacgtgacaatgctttcactgcagccaagaatgactgaacctggaacatacagtcaacaatgagaaaataagcatgcatggaatggaaaaaatatatattttataggttcacagcactaattttgtatgtgagctacagtaactagtaaaagtagtaccttttcaactactgaagttaacttgaaggtcaggtacagtccagtggttaaagatgagaaaagactcccatattccttgttcagaaagaaacggtaccaaacaggagttggcaacaaggcacgatataggagcagaaggtattccacaagggttagcatttgaccctagcaaaacagaaagtttgagcctcagaagtcagaaccaactactaagcttgcaactataaaaggatctaaaataagaaataagctagaattcaagataatgagacatgcacctttagaaccaaaataaaataacaaagataaagaaagtaacaatggaaaaactagtcacttcatgcaaaagaccctcataagttttttttccaaaataagttatatcctagtgttacttgcgaacacatggcacatgaagccaacagaactataggaatacatgatgtatacttgactatttggtagtgcatctactaaactatttttcaaactgtttcagaattatggagaaaaaactaccattcttagctaagtatttgggatatagaacccctttctagtggacacatttgaagatgtctaagcattgagctgctacacagactaattcagtagatcaaaacttaaggggataaaaataattgtatagtcatagacatgcagttattaaataaagatagcccagcatagaaatacaatatcattcagcattcagttattatgattagtttctagtcaatatatactcagtattggatatgtggaaataaagataattcagtgtgggagaaagggtgctgtcacaaaagcacccacatatactaagtgttggtacttttgaattttgatggctgcgatcacttcactagtttggctagatctctacaatctctaaccagcatagtaatcactgcattgattatcattagaagttaggtagaaccaacaactaaaggcaagatgctataaacatgatgataaaatcacaaaataaatttatgacaattagaaaaaaatgtcacctgcttacggtagttacgacctctgctattcttatagtacataagtagcatgcacttaatggccattgctgcctggcgaaccattgtatctgcaagtggcatttggttagaaatgccaactgcaacatgaaataaattgtgctaacagataacttaaaatgtttttccctgcaatcctagaaaacatacttctttaagtaaatgaagatagtgccatacagctaatatgaaccttttttggctaaaacaaatctatgttgcctgtgtaattttagcagtttgaaactatgaattgaacaccataaattttgtgccattcaggcattcaaaaatttctagcacatttaatgatctaagtgtacaaataaatttattaaatgattagttttcatcacacatttaactgaagagcatctttaaatttgctgggaattcgaaaggctaatacaaaccgagaaactaatgagttcaacacaaagccttgaattaaaaagcagcagaaagtgaagtaaaaaaaggtcattttgaatgatttttcatgatatgaaaaacgagacaaaattgctcattgtacatacatttacaaagggcaataaattttaatctagcaggtcaataaaggtacttctatgtatatggtcagagttcactatcagataatggagaaatgcatgcgagcaaattcaagaaaccctttaaggaagcatcagtaccattgaccatgatgataaaaatcgcatgccaaaatggcggtatttcttttggcggaagcatgaacagaggtctgagaagatcatcattcctgtaccaccaatagacaccaaacacatgaatcatgaagattactgtaatcccgacaagcacagcaatttttctctcgccctgcaaaaagagttggaaatatgaaaaatttgctattgacaagtattttagcaatttaacaagtagcttcaactagtttcacaacaaatatggtacataggttgacctaactgttactagagataggatgactaacctgctactagattaattaatggtaaatgtgatccaggaaaagctaagagtagataaaaatgttattctctttactactttccaaactgggtaataaagtgctgtgtagttcaggaaattcatcatttcacaatgatgtgatgttcactgcattagtacaatgcatgattatattgttatgtagtcattggcattcaaatttatgacaccagaaggaaaggtctggccagtagtcttctgattctgttatactaaaataatttcattgcaaaattggaaagtgatgcatcaagaaataagaccttcaaagcagtttgcttccgcaatatatcatttgacttgaacattacagcagcaatccaaattgtgacaaagaaacctgcacaacaacccttcctttagtgtgtattgaaatgcttacatggcaatcattgcacaagcaaaaatagatatgcaattgaaagatggatttatatgttaactcaatccattgacctttcttgacaggaaaaaaacaatttggttgtagtggcagaaatgatagagggcatgcactttgaaaagtaaaggatagtatgaatggataaggcaagatgaatataacatccaagattgtgaactgcaagtaattgaagcggtgcataattggatacaactagctgctggaatattaatgtatcatcattaggccttgccaaaaaaatggttggcacataaacacataaattatgagttgattggtgcggcctccaaaggaataaatgttaaaagctaagaacctgatatgatatatgcgtcttaatcatcatttcaagaccactaggagataatcatgtagcagaaaattcatgtcatggtaaacaactaaacgcagatatgtcatctgatccataacttaggagttaggactggtacccaaccacaatatcctccagataatgtagcacaaagagaagttccaacctaatataagaagccgggcttgagcaagtcctgtttaaagttagggcagctaactagcaataccaagctataaatatctccccattaggttcatctaataaagcaggctaaaacccactatatgagataagtcgactataatcaagtgatcatattatcctctaaaccataatgataaaaaaaataacaaacaaaatagtatcccaggaactcaaatggttaacatagatgttaagttaacacataataataatatagaccagcctaatcacaaacattaactcgcctaagtcaaggtgttttactcacaaaatcactttccttttttggttaaacatttgtaataaacaatatatggacatcaacatgaaggaaaatcgattttgttttggacaagtcacaccgcttataatcacacaatggcacgagcacaagagaatgagtattagaccttggagatgctgccgtatgaagacgacgagcagcagcagcgagaatggcagtatctgctcgatccacctcgcgacatggtgcacgtcataccgctggtaggcgcggtccccacccccgttcccggacgcgccgtccgcgcccccaccactcgcctccgcgtcggcgccgccacccctccccgcggcagccgaggccgggtcaacgtccccggcggcggtcgcctcgatcgagtcctcccccgacgaggccgcccccgcgacgcccgccgcgtcggcctccccggggccgccctggatccggatcgagacctccccgtccccagccgcggccgcggagagcagcccatcggcctccgacgacgacgacgaagaagacggcgaggacgacagcgccgagggcggccccgcctgcggggcgccggggccggaggggacgacgccggagtactcgagcagcgcagcgagcggggcctgcaggaggctggaggcggagaatctgaagccgtagcggcggaggcccgacggcgaggcggccccaccggcgcccgcgccggtcccggcaccccggcgatgatcggaggagcctcccgccggtggctccatcgccggcggcagcggcggcggcgaaaccctacaaggcggaggcggaggaggaggagacgaggcccctggaatggggagattcgagagatccccttgcttgggttggtttactttgcctgccttccttttggtttctttggcttttttttttcttgcttctctcgccccggtgccggtggtggcctcggcctgtatttctgttcttaattcttatgctagttttattttgatttagaccctctttgtttaggcttagggttattggtttagttttttaagtcagcttattggcttatatgatttataaggcagtgaatttaatatcctaagtttagtagtagagtcatacatctaactcatataagtcaaaaaagcttctccaacctagcttttggcttaatagtgtaaaagtggcttatggcttcaaaaaggccaaacgaaaacgctgcttatttgtttaggcttagactttttgacttataagttggcttataagcctaaacaaagaggaccttagtgatttagaattagtcttctggttatatacgtaaccgtaacacatatcactactaagacacatcacatgtgcatgtaacatcatgtacatgtaccgtatacggatatttataacctcttaacattttctaaggacgaagatcatcggtaaatcttcggcctcatgtttaacaagtaaaataaagataagtgacataatagctaggatattattaagcaattgcgctatttgcatgctaaatgccattggaaaaaaattcaaacattttcattagacgatatcctcagatcatgactaaagaaattttgaataattatacatttagattgaaatgtgcatttgatctctttttttaactagtatatgataccccctccctcctcatctttcacccttttctaatcatgatttgattattcagagcctatcctttttctcatcacacgtttaacaacaataaataccctactactctctccttccctaaaaaaccaacatagtactggatgtgacacagcctacgtatgtccaaattcgtattattaagatatgtcatattcagttctagattccttttttagagacgaatgaagtatgctagaagagtaaatctcaataaccaactcctaatacctctttagtcttgaatcctaattggtgttgtccccatcccttttttttctcctaaagttatttcacattatgtattattgagaaagtagaatggtattccctatatgcatctaataaagtgtacattaactagcatgaatataaggatattactgttatgaaaatatgacttaggcatccttgtgttttttaaaaaacaataaaaggtgatgatttatattggtatctgcatatgaatgagtatgatataatggagtgaataaatatacgaataaaaactctgtaatttgagtgttatgtttggaaaagaatggacaagaggcaaaattgtatattttttcaccatctatctatgattatattaagagagaatcccttatatgccactcgaaattggccagttcccttatataccacttaaaattggcttcttccttttatgccactggttcaagtttttccacccttttatgccactcccaccactattatgtttgttgactgttagtcaaatgttagttttttcttaaatgaccaatatgccctcccaactaaaaaaagtgtaaacttcaaaaattcataactaatttattttaaatcctttttgagtgaataaaattttgtcagaaccagtgaaaaatgctctttgtattaaaaatattgttgggaagctttatgtttcatgcttatattaaaaattcatttgttatggtgatggctaaaattgcacgtgataaaaaaaataataatcaatttttatatgttgtaccaacttctctatcaaatgaaaaatacctatcattggttgtataccaactctcaaaggcaaatacgtctttttactataaagttaacggtcaactgacggtggagtgacgacaatggcttaaaagggacgacaaacttaaaccggtggcatagaagggaggagccaatttgaagtggcatataaggaaccggttaatttggagtggtatataagggattctctcttatattaatgggtatgcggttgcacattgttttgtctaaacgacctatgatccaaaaataaatccttggtattgattcgcaaataaacaataaagttaaattactaaaacaatatatcacattctatattcatgcaaagtttaaattaacctaaacatttatgaggaaatttagggtataaaggatcaagtccttttgtctagcaataattgtttaattataaaatagttaagtagaagagggttcagggaatgtaatgaaagagtagcatctacttgaccgtgtctgatctctaggttgagatatagagggtagccctagcttggtatgctcaaatgggaaaattttgattaagatgctacagagatgaagataagacataatacattcataattgccttattcttacatgatatcctacttaagttgatggggggctatttgtataaccgtactaattaggaaaagaaaaaaaaacataagttgcatttggagccctaggaagactttgcctcagcttgcctgtcttgatcacctcgtctcgtaaagcgagcttggtgagaaacatacacactcctaataaaacgtctaccatgaatgtgaaatagcatcatagttgctagatgaataaaacgactgctcttttaaagccaatttatccatgcctttaagaaaaattccatgacctctcatcgatacaaattctgagtaggcatattacgccgttgtatggaacatcataaatcacatgaactttataggcataaaaattgtgagcgcttcaagtaggtttttcttgccttacatgcttgacatatctaccacgataaaagcgttcgcttgtatgggttccttgtcaattgtcaacataggtgataacaaagtgcaaacccttttcatataattttctaaaatgctctaggcttaatgaaatattttcctaatgccttcagaaatgaaaagcatcgcctaacattattctctaccattagttgattaagaccttgtcgagcgagcatgccaagatatatcctctcagttaacatgcaagccagagcatgacattactaacatgagagcagagacaatggatgaaaccaaatagagtgggcatgacaatggccaagatcttgaaaggtggtatgatgactagaatattgaaatatggtataatgaccaagagtggaggccgaacgaccttcttgatgaaatattgttatgaaccaaaagactcatttcttggtaaaagccgctctatttgtccgcaattagcaaggttacaaaagtgctcaggaagcaacatggggctaacatgtggctgccatgttttagcagcattagaacccttagatcttaaatcaacatttataatggtaaaaagaaaagttgtgtgtgaaagtccaaataatttcattaaagtctaggtcattgcatcaaaaccaatgcatatggctaaataattatagtatatgtcctaattttcacccagaggttatgggatatcatcctaaacttttatgatatttgtaccttttccttgttaaattctttgtgaaatttcctccattacgctaaacatcaccacattatgttgtgattgtcaaattgtttatttggatcggggtctattaaatactgtgacactgaaataagtctgctatggaaattcaatatactgctgcaacgattcacggtaacactttcatatgcctggtctattttacaattcacattactgtccatcactccatctcatgttctctgtcttcacatcaccataaaaattccaaactttgcttgtcctagtgcagtgtcctgggttctcccttaaaactggaatgaagtatcaagtactatgagttggagaaacttttggaattatgttgcttcagtacatggtccttcatgcaacttttggaggtacgaagaagctgttatttattataaacagtaaaacacgggatatgccataaacacggttgctagatttgagcttgaactagaagaaaagctgatcagttgctacggttaatgagtttaatctcctgcaaactaaatggtttttatccaccagaatgagttcagatgtacagtttgtccattttaccctaaagtagatatccatcaatcaataaagcagatcttacaataactttgccagtaatccagtatagtaccacctggcaccataaaaagttgagtaaaccagaacttgcacaccaccttttttttctttcaaggttggcaacaatccacggtttcaggacgaacaggtgaaaagacaaaaattaaaccggtatatattccatgcctatttccctttgatttgttcatacaagggaattcctcaacctgaacggtaataatttttccattcctgtatcatcattacactgatattacatgttctacaactgtaccagcaaagaaaagaaaggttatgtgactgcttctggagctgagttgcagtagggagtgtgcaagcaaatgaatctggtcgacatcaggcatacagaggcaaaggcgaaacctatcaaaagcccacagatgctcttccgcatgtccaaccttagcgagcgtttgaagactcggccaaagcttggaatcaaagcaccacaggcaatgaccatccagtagtctagtccactgtagtcaatcttcgcgaggattgcactgatggcagcgcttggccctgcaaagccggtcaaagcagcggctgccaaggctgcccgccaactatcagtggcaccatatatgcagctcgcaacagcagcacctcgtggtagaccatgaagggaaactggaagaaccatgtagcgccctagaccataagccttgcgcgcagccacaccaagttgaagaccttcagcatatgcgtgaaggaagacagaaccgcaagcaaggagcgattgcagtgtgaggacactaagtgagaggcctgaggatgatgtaattacattaacagaagatttcttgcggttaactagctgaaggatgtttgatgtggcgacatggtaaatgagagaacctccaattaggaggaataaggtggtaaatagacccatcttcgatgacattagaagttgtaaaggtctccatgctgcgagacggaaggctatgcctgatgctacaccagtcaaaagagggtgtggcatgctgaaagtaagagagaatgcaacaagtacaattcctccaaaaagaggacctagtccaaatacaagtgataccaaaaagcctgctgtatcttctgagctgcagatcagaagaaattaataacatcaatcagaaattcaaagtacccacatagtactccggaattgtatagaggaaacttacttgtggccatcagtaaatccctgaagcactgtacccaatgtttccatgaaagcaacagcaagcgttccggcagaagcaacttgagatggagcagcttcctgcatgaaaaggaaaagatgagcaaaactgcatttacaaatcaatggaacagaagattcagccattaacagatcttctaactaaatgattagagttcaccttaaaagcatcaggaagaacctcagcaattacaatccatatcatgcatccagcagcaaaaccagtacaaaagggaagcaccttttgaaatgcatcggcacaaaggaatgcagggacagcaacaattggctgtattaaccaagaaaaatgaacacatggtcagagtagtgtggaaggcaaaagaatgtcagcaccaaaatgtagcttgaaaccaagttggtatgctgttgcatacaagtagacaaacatttcgctcacaatgaaatactgacaggaagttgcactattggcaagtaaaaggaaaataatagtggcaatccccattaagggcttgttcggttgggccgttctcggccgggatcggagcccaatccccgtggaaaatcccggcgtggaaaggataccggcccacgcaagtataggcgttcggttaagcccaggcgagattttatcccggcccaccccggtgttttcccctcgtcataggccgggaaatattcagcttctctggtggcgaggaaaaaaatcctctcgacgcagcgacacaaagagagggggcgctgcagcggggacagctgcacagcgcagcgcgactccgacgcgacggcgacggcacgctctctcctccggcagttgactcctccggtggccaccttctccccggtgagttccttcacttcctatctcccctagcctcctcttctagtgttagggtttcttgcgcccgtggcctcgtgctactgcggcggcgcacgacggtggcaggcatggcgggggacgccgcagcatcacaccccctcaccatggcgccactgaagctctaagcgctatggcaaggagaagcaggaagacatggatctgttctttgttcctcacaaggtttcttgatttattcttctttctcccttgatttgttctgagtaatattcctaacttagtctgaagctctgatcatgtccttcctggatctgatcctctgtttgtagtgccctagtgagaatatgctgattctcctggtagttgagtagttgaaagaccacgttttctgattcttattgtgagttgttttaaatttgtacataaaggttatgaaaatggtttattctaaaaattagttggcaggtaatagtaatgccacaaaaacatgcagtgcgtaataatattgaggcatcagaagtgaatgctgttcatttttcagaaatactagacaactgttgttcatcagaagtgattccaacaagttgtctgctcttgtaatctcacccatacttgacagtgcccataatacaagtagatcaatgagccattccacatgccatattttctgaacaaagtacaaagttcaaattgaagtagtaagaaaaatgagtcatgtgcagctttagttcaggcctgtaaaaagctcttggcagtcggcagaatacaacttacttaaactgaactattttggtacatggttcaaatggtctaaaaattttcctaggttggtccatttttagtagatcttttttagaaccatctaatgaagaaattctggatgtaaaacatgatttttgcagctattgcttgcttaatctgcagactactgatttttgcttctactgtagctactattgaattcagttttttgcttgctcaatcttatatgtgtcctaatttcattttgatatctgaagcactgctagcagtagtctcatatgcatgtccatgtttctagcactgctagctattaggcaaagcacacaatacagcttacaaacaatcacttgtcaaactgaaaacttggtaaaaatgttgcccaggatcaatagttggctggtttcaggaaatttgagacaattgctcactgcacgaaagcattgcctaaattattgcattttacaactgaaaactgaaggaaacttctttcttctgtacaggctttgggaggaagtctgagaggatggtagttcagatacagagtgaatgagcagacatgtacaagatgatggctttttgcaggagcaacaaatgttgatctctgaaccattgtatattgctgatgtaaccatttggtctaggagtcctggtgtggcagctcacatttatttttatagctcaagtgaatcatgacatagtttcatctttttccttttttattgtcaaatttcacttctatgactgtatttagttgtctctgtattgtcaagtgacctcaagctttgttgggtgatgcctccttgccttaaaccggatacaggccttgatgatactgcaatatttttgttttaatgattaatcaatgtggttttcgcgtaattgatgaggttactgcaatatttttttactgaagtgtaatttcattcatgttgcacttttcacttatacaaaaatatcggtttgcaatatttttttgctattctaaactgccaacctgaaaatcaattttgctattctaaactcaatggacagcgtgcaacgttgaagcaggaaagcaccagtccttctgttgttgctgttgcctattgctgccttgacacgggatttaagcaggcgcaccaagccaaaaccgaacaaacgttttgaagacagggattaggaaaatcaagggaattcatcctacagggattaagtgacatgggagggatccactcaatccctccctggataggttccccttgggggtttaatcccaaggaaccgaacatagcctaagtgattatctatggctttgttattttccacaatatggtcgtgatatttcatttaacacttgagatcctttgtgatgcgccaatattatctctaattttgcttctttgtgatgttactgagctaaatttcctaaaatctacagaagtatgcataacgagctagtgataagtttgatggcttctcacaagtttacaacctcccattttcaattagatgacactttagaatgcgtgcaatcaaatctcaaactcttaattcaatgatatatgcaaaaacattaagatttaatatgttaaaatgacattaatagatttgtcacaaaaaagtactttcatgtagttatttttaaaataattctcatgcatatatgatttgaaaaggcaacaatcagacatgtgtattggagaagtgttgatgccctgaactgcaactgaaaaagaatggaaggagcggtagagaggcattcagcaaaagtttctaagtcttaaatgctgattttactcgaacaaatgttaggaccttggagatggccatgttttcttatttatcaggttagggcgtttaagtcctagcatgtccagcttcacagatggccaccaaacataaatgaggaactaccagatatgcaagcaagataggaaattgtgaagagtatgccaccacaaagaatgctcccttcccttgctaccattattataattgcactaataagtaacgatcatagcaatggaagaattccaatttaaaaaatcagtggacaaagatcatcatatattattcataaaagtaactccatttcacaaatgcgcatgcatgcaccaatgtgctatgctgcacaaaagaaacatgagtaaattacattggtggtacacgaacttgtcaggtgggtgcaaactaatgcataaacttgtacaatgtttgtgttggtgcatgaacttgtctggtgcgtgcaaaccaaggccaaaaggacaccataaggctaatctcatcgatttaagtggtgattaggatgcgatgtaaacatgcaagtgagaagacgcaatatagacatatatatgttcaataaaaggtaaaataaggcatgattgttgttagagaaagacataaaaaacctgagtaatgatgcaagggtgtaaacaaaaagaaggttaatgtaggaaccgagtttataaatatagcatatctcatacccatctcatatgtgcatatcacgtcctaatcaacgtccaacttggtaaaattagccttgctatgttattttggccttggttcacaaccaccaggcaagtccgtacaccaaaacgagcattttacaagtttatgcactagattgcactcacctaacaaattcgtgtaccgccaatgcaatttactgaaagaatagcacatgtacacacagacacaaaagtgaaatagtatagtaactaaatttatagaaaaggaaattcagattgtagcccctttgcaaaaggaaaaaaactgatttcactttttctggctacaaaacatgaaccactataagtctataactaaaaaatagagaactcttcatgttgactcaagaacaaggacatttatcaggtaactcatatttcagttcaaggatagagcaagtgcacctgtggtaaagatgttatgatactccatatcattgccttttgtggggatacacccctggatgatagcaacatgcttacagctaagccttcaggtatgttgtgtacagcaatggctatagtaactaaaagaccttgagagaatccttttgagccagcaaaggaaacacccacaccagagccctccccaaaagaatggagtgtcattattccgacaacaagaataactttacttgcatctgcaccttttatatcgagcatgcttacttctccatattgctcaagaaactgtgtaaaatgaaataatacaaaatatctaagtaagagataaataacaaaaatacatgtaaagaaatatattgacgacaacccaaaacacaaccatcaaaccaaactggtacgatggtgaatgcacttaatatgcaagtacaatagtgaatgcactttcaacatgtaatattgaatattgcacgccctcaatttattagaatctgattcttggattcaggagtcaggaataagtaggttaaatgacaacgaaattatgagtatgccaacatatattaggacagaggaaaacccttttgaatgccagtgttctaacatagaagctaccacgaaccacaacaatatgtgtataagtgaattgcaatcttaattatgttaatgtattgatatgtacattgtacatgccatttaaatgaacatatgaactgaatgggtctttatgacatccatgactagctccgtcaagtttaaatacatttgtacatgatttgatatttgtagattagtgaaaatgctaatgtactaaatagtactccataagtgatatcacagaaaactgaagagaatgaaacaggaagtaccttcttgcaaagccagatgaaaaaccctccgctcaaaatcccaaacacaacccagctcccactgccatacatttgcccttcctgcacaagatcaaagctcgccgctaacatcacccctgccgcgagtccattgcaaagtcccgcccactgggcctctagctccaggaaaaagaatggcagagcacccaaaccggtggcagcggccattgcaagcgtcgaccacgcgaccgtagacaccggcaccttcccgctcttgaacccatcctgcccgcctgcgccctcaagcttcctatcaggcgcttcctgcacgacgcgcacaacgccaacctctgtctcagcgaccgctgagacatcgcggacaaggacaaagagcaggaagaataggaccactccaactcttgagtccatgttcactctaatggaaggcactcattcagattcagagattcccatgccccggtccaatcaatgcaacacggtcagcatcggcaagaatcatgaagcaaagcaatcgtctcggtccagcaaaacagaccagcagttcacgattcctgcatggagagctgctccagcactgcgacagaaaggagcacaaacacacacatttagcacgattctccgcaccaattaggaaggaatacaacagaacacgcaagctaacacaaaaagaacgcatagctacttccgtctttttcccccacctccccgtacgcaacgagctaacgacagcaacaaggaaagatccaacccgacatcccccgccccaatccctctggggtgagacatccgacgacccaaccccaaggaggatccctccgcagaggaaaccccaatgactggagcacgagaagactgacctcgattcgatataccgtcgccggcaggccgacggtgaggggggagagggagaggggcggaggaggggcccgattgggattctctcctgtggagatctaactcgcgctgagaaggaggaggaggaggaaagcaaagcagggtcgtcggtgatataggcggcgacgggggcgaggacggggggcgcgcccgtgcggggcggcgcacacggattttgggtgtgggggtgggggcgggtttcgttttgtcgccgaaaccgtcacgggcggaggggagaattgtatatgtgccactgttaaaagctggtttcgctcgcttacattttccataaaaataactttttctcggaccgttttgcccctgaccaaatctcaactaaaaaaaccaaaaaaaatgataagatttgatcgatgggaacccccagttcaggtctccatatagttcttccacattgccaacttcagaagaacgaaagtataaatttacatcgtcggagacaagatcgatccaacaaaaaagagagaccaaaagaaaagcaaaacacaaataaaacaaaaccaaatctacagcgaaacgatcggagcaaaagaatcgaacttttcgacgggatgagcatagcaggtcgaggagatcgattggaaggatgagagagagagccttccatggcggcggagttcactgggtggtggagaggagaggcggcgcggtgggagaagctgcgccggcgaggtggggaagaagagcggcggccgacgtgggggaagacggcggcgcgctagctagtggatgcggcggcgcgccagccgggcgccggcgtcgtcgccatctgttcttcctctcctcgatctgtgtcttcacgcctggaacagacgagagaacgatactggtagagatgttgatttggtccaggggcaaaacggtccgagaaaaaaatattttgatgaaaaaggcccaagaaaaaaatattttgatgaaaaatgttttgcaattgcaacaaacgggaaaaatggcattctagcgaacgcccacatcttaacagtggcattagagcgaatcccattttagggatggcattcgagcgaagccagtttttaacagtggcatatatgcaaattcctcgggggagggagggtggagtcacgagatcttgtctggcgtggttacgagaagtccatcgtgccatgtcatatggtgtgcgggtgctggtgcgcgtcccggttgcagcaacatatatacgatctgggctcgaagcagtggaactgggaagtgtaggtaggcagcggcaacgcggtcagattgcaaatcttttttttccataagctaaaaataggaaacaaattaaataaataattatgttctaaccatatttaaaagcataagatattctatatccttcgtagtgttaacctattactatattaatgagaatactagccgctaataacgttagagtgcatactcctactaaacaagagtatgcatcgccgccaaagacttttcgcaagacgacttatcgagttcttccccatcgatcgaaaaagaagttattctttagactactgggacaaagaatctgctctaacacaaacggttacgaaacctgatcgattatggggcatgcaaccacgtatttgataagcgctagactttaacaagatatacattaagaagcatttgactctcacgtaaataaaataaaaacatttgactctattactgctaggccacacgtgcagttggggctaacggaggtttttaatagaaatttaaattgtgacgaggtggcactgttccaattccctcaaattatagcggcacatagccgatatcatgaatagtagtgatattttttcaaatcagcaaaattgcatggcatggatccaattaaccctttgtaaaagtagccctcgatatttctaatctatagtccaatgtttgtgtaaaataagtgaataccatatatttaaataagcaaacaagtgattctaacatatttaataaaaaaatgtatttttgtttataacatattataatatagcattttcttttacccatagcaaagcatgagcattttactagtactcaaatatatgtgagtaacaaccaatccattgatgaatggactattgaactctccaccccctcttttgagggttgatgttcatgcaagtgaaacctattgtagccacatcatcaacgtcattccctacccaaaagatagttatctgtcaccgaaagatccaacatatcataaatgatactcatatttaacagtttattaccatatgttaatctaacatacaacatcccatcctatcctatagttcacacccttatgctagttaaaaaaaacatcccaaatatcaccctaagcctcgctcttggtttgctcgattgaaccactggctcaacccggttcaactaaaatgagatatgtactaaaatcactaacacatacatggcctagtggtggaagcatgcctccagagggaggttggggggttcgatacctgacacgtgcctccttggacagctatacgactcttcctcccaataagtggtataatagtccggttttacccggttttctgtggatccgattgcacactgatcttttagttggatcagacctgccggtttaatcagtggtctaatagtccagttttacccagtttctgtggatccgattgcacaccgatcttttagttggatcaaacctgccaatggtcgcctcatagggtttgattgtgtttattttctttggtagattcgaagtgaaaaagatgctcaacacgatcaaggtccattttttttgaaagatgtgtctagagtcgtattcatcaatagaaatcatataacatatgtaaaagagaaaaataacacgtgaataatgataagtgaagagaaatatcaaataaatatgagttaggaggacctatttgtaaccaatcgttttataggggaatctcatactttgggaagcagatcgtctgacgttgggcggccaatgtcagagagacgtcgggcgtcgatccatcgtccgatcgacatctcgcagtgctgctgcttccttcgttccgtatcgcacgagcgcaacgaataaggcggtcaaacaggatcgcagtcagcccacgccagtgaaaatggcccacaagcatcctcattgccgtgtgccgccgccgttcattgctctgtttctggagggaaaaaagggcaccaatatactcggatggagggaaaaaaaagacctttcggctgctgttcttatggcgatgaagatggtgaatgaacaacaagaagcttttctgcacttaatcataaaacttcagggcttttgaagcttttctgggctaggcagcagtggtcaccctttctcctgtttttgtgcggctcttggcatccctccgacgtgggtggtggtgaacagcttggcgccgccgccgccaccgtagaagccgtcgttgtcgaggatgccgatgcctaaaagctctcacgtgggggaggacatggggccgagggctatagaggagggcgacgtcgaaggagtcttcctcggtggtccgctcctcccacacccgtgtcgaggaaggcggcgagcctcaacggagcggcgggcagccatgctgggattggtttttcttttctttttttttgtacgacagtggacgagcagtctcgttcgtttttctccctcttctccctccacggttgcttgtaaataggctgaatgggtcgtcctcgctgcgctcgtgcgatgcggaacgaaggaagcaacaacgccgcgagatgccgatcggacgatggatcgacgcccgacgtccctctgttggccgcccaacgtcagacgatctgcttcccatactttgatatcttgggcggtttttgcaatttttgctttttttttaggaaaaagtgcatcgaaggtccctcaacttgtcgtcggattacaaaatcgtccccgaaccacaaaaccagatataagtcatccctcaacttacaaaaccgactcactgtaggtcctcaggcggttttgaccttggttttatccgatgtggcaactgagtcagcgtgagacccacgtgggccccatatgtcaggttgaccacgtcatcactttctctctcttttttccctcttctctcccttcctcctctctctcactttttcttcttagtccgggcaagccggcgcagcgagggcgccaggcaggagaggaggatgtcgggaggccggcgaccggcggcggccgcgacgacgtgagagcaggagggcctccccccacgccgccctcgccgctgcagccgatagtgcggacgccagatctacgtccatggatgacgacggtggcttcctcgcgctcctagtcggcggcatccgcgtccgcctcgtcctcccgcgcctgccctcccacgccgccagcctccgtcgtctttccacgtgcggccatggatgacgacggcgacgacctccctctccccgttggcgccatccgcctccgcctcgtcctcccgcgcctgccctcccacgccgccggagcaggagggtctcccccacgcgtggaggccaaggactccctgaccatcgtcgcgcggtagtcgccagtcattgatctagtgccccgtccgcggcaaccttgaggagctgtcatcgaccatgattgatgcaccgactgatcctgcagggtgccgtgcgcttgggttcaacatgatcatgtccttcctcatcgctctggtcgtgaacgtgtccatgagctacctgctaccccacgcatcgatgagatcaacgacgacgtaaagctagctaccgcgccgccatcagcgtctgcgcctctctcgacccgcccacgcgtggctactcccaccgccgcccgcgcctacttccacctcctcacccatcgtcgtggcgcctgcctgcgcccagcacgccgccgccgccgcgtcgctacgcggcccacgccaccccgctgcccgtttcctgcctcgccccgccggccgacccgcacgaggggattggggaagccggcgagcttgcgccgccctgagcacacggccaccacccgggagccgccggctgcaccaccctccggccgcgcgcgctgctgtgggtggtagcctgtcacgccctgaagttcccctttccagctttaaaatttgttaaataaattgcctaaagaaattgttgaattaacctagagttgaatccttaactaataaatgcatttaataatcaaattcggcgtggtggaatttttcttgagttccccatgctccaatacattaacaagatttttagtgggattttcagagctctcgaaataattttaaccaattaaaataagcaaactgcaatctttaaatcccagggaaaatcttttcctccttttctttttcttttccctccttttcctcttcttgggccgtcggcccagtccaccccgccaccgcgcgcgccctcctccttgtgggccggcccaagccgcccctccctctctcctcgggacgccgacaggtgggccccacctgtcggggtcatccccttcctccggccgcccgccctacgtcggcaaccgccaccgaaaccgccgcgcccacctccgccgctcctcccgcgcccacgccgcgtcgccccacgcgtcttccccgcgacgccgccctctccccgcgtctcccggcccgcgcgtgcacccgaaaaggggcgggattcgcattttgaatccccacatttcctttctctcctccccacgtcgccggcgaaatcggaggtcctcccggccacgtccgcctccccctccgcctataaaacgttccccgtgccctcctcttcccctttccgctctcgccgctccctcccgtgactcctactgagctcgcgccgctcgccgccgcgccgccgctcgccgccgcctccagctgcgcgccgccgccactggagccgccaccgcgccaagccgccgccgccgttagcttcaccgccgcttggagcacctcggtcaccgcctcacatcgcccgaacccctcgggagctccggtttccttgcacgtcggtgagcccctccattcccttcaactccggccggccatttttctcgccgcgggtttcctccaatcccctaacccctctcctctccctccttaggtgccgccgccgcccgtccgcccctcctcgtcgccaggtcgtcgccgccaccttcatccccgctccggtcgccgccctccggtgaggagcccctctcctccctccttcccacttttccccgctcgcgccgccgctctccgcgcgcttgccatcaccttcagccgccactgtcgacctgtgcaccatccgtcgccgccactcgcgccgccgcttgccgtcgccggtggtcgcgtgcgccgccgccgcaccccatggccggtcggccggctttgtgccgagctgagccgtgccaggccgccgcccgcaccgtccgatcggccccgggccgatctgggccgtcggtcccgtggaccggcggtggaccacccgcgtggtcctagtccacggtggaccggccccttgagccactgccaagtggggcccgcatgtcggcgccccctcccttgctgacgtcagccctggggcaatattgcgcaataaatatattaaggcttttctttaatagtaaaaacacagagaatcttctaaaaatcataactaattcattcgagctccgattaagtccattcaagtatcagtaaattcataaaaatgcacagaatctattaaaaatggttttgtttcctctttcagtagtcttatagcctgttttgcttgtgtgctttgtctgtcgtgtatatttcggccgtttcgtcgatccacggtttctcgaagaagttgctgtggtctcatcagtgcgaaagcaaggctagtcatacattacaattgatcatattgtacccaatttacaaatgtcccgcatttctattaaatattgcattgttttacaatatcatgtgggatgggtcctattactcagctatatgttgtttcccttacgctattgataacttgggtattaaaatgactagatgttggtttaggagatgcttagccatgcttagttcaactagtgcacaaaaggggatcacattaaagcatagactttgattattggcatagctttggtttagtgccaccgtaatggtgttggttaattaaaatacactacatggtgggctgtgggtgcatggttttgttagtcgtgcccatggcgattaaggaccggttcgcgggatgccctggaagaacttaccgtacttaccacaagccagcgtgggcaacggctgggcttgtagtgtagcttttctctagtcgacgtacccaggcgagggtgggcgtgatggagttgggtcggccggggtgtccggttgatcggcttccggattcaccgcggcacgaaaggggggctgcccgttgcctgctggggacgggggtgaaccctaaggtgtggtgctatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcacccctagttagcttatggaactggttagttcaggaggtggtttgggcctgttgcaacgtgggtagcgttggacagtgattggttaatattgataaatcactacagctgttttactgctttcaactactgcttttaaatgctagctttatgcaaatgagcctttagcctcctttggatatatcctgcatcatacctcctctcccggtatgacttgctgagtacagtgggtagtactcagccttgctctttttcccccacaccagagctgaagatcttcctagtgggagctgtcttgtcaaagttggtttcgtcgctgacgtcaatgattgcctgtggagtggagtcgccccgctacagaagtcaagtttccaagtctagctcgttttatcttttccgctgcatttgtaatcttttatattttcgtaagacgtggatctgtatgtcaacaattgtcgtttgtgtaccctggctggtcctggacaggggtttaatacacattcagcttagaaattctggttcgtgaatttctgggcgtgacacagccctagcgccgtccccatgcgagagcagagtgctggcttgtttggtaactcgagggaaggggattgggagtttacacgagggaattgatgatgagattaagatgggaatttgatttttaatcccaatatcttgtttggtagaggtgatggaaattgatagggaatttagttggagattaggtcattaataaaaacggatggctgagatttgcttaaacaaagtaaaggaggaattccctcccaattacctgcccctacccaggtattgaaaaggatggagttccttcctcaattccccatcctcatcccaccaaaattttcatgtctcccaactaaacaaaactattaatagcctcatccctctaaactcccaatctctcctaaaaactccctccaaccaaacgggccaaggaaggagagaaacagagaaagaggaggggaaaagagagtagggtgctgacgtggacaccctgacgtgtgggtctcacgtgggtctcacgctgagtcagctgtcgcgttggataaaactggaatcaaaaccgccaaaggaccaaatttgcattggttttgtaagtttagggatgcgttgtatccggttttgcggttgggggacgattttgtaattcgatgacaagttgagggaccttcggtgtactttttccttttttttactttgagttgagactactatactgaacgggctgcagtgaattcccagacaggcaggccagcggccagcccatccagctggccaagtcttcgtcgtcgtcctcctcaatcacatattggagacagcgacgcgcccatctgatttagacgggaggacgccggccgcctgacttcctccctccgagactccttcgcggcgaaggctttacagagctgcaggcagctcatgccgttataatccccctcgcgactcgcgagccaagtgagaccaacccccaactcgacgatgaccatggaggcggagcgcgacggcgaggagcagcgccgccccctcctctcctcctcctctccgccgccaccgtcgccaggtaggcgtactgccaccgccttcgccgtccgccctcgttctctccccgatcccccatttcaggctccgtctcgtgatcgtctcaccctgcctgcctcgtttcgtcgaattccgttccctgcagcggcggaacatcagcatcagcaccagcagcagtaccagtacctgggccgcagcagctcgtcggcgctgcgcggcggcggtggcggaggaggaggaggagcgggctggggcgtggggccggaggtcagcgccgcggaggtcaggtccgccgcgtcgatctcctccgccagctactacccaccgccgccggctctccaccacgacgtctacccgccggacatccactccccgtccccatcgccagctgcccctactgctccgcaccctcacggtgattccgcatcgcctcttcttcttcttcttcttctcgtctctctgcatttcgcatcgcatcagctgtgtccgtgaccctaacatcagttggttataccttgcaggaggattagcaattgttcctcaagggccgtacccgtatggcggcgaataccagccttctcatgatggcagaaggtgagcacttccaatcgaaatcgggtatttgctgattagctgttatgatcctgctgccgcaagatcatataactaaaatgggtagtatgaagtgtgaacgtggtaagaaattggggaccgaagacgaacataagagagaggcgctgtgtccattaaaacgcgtgagatatccaccctacttgaatcccagttgctcctatatgtccccttctgaacttgtttgcgcctccttttcccatgccaggtacttgtaaaggttcttaagagtagccagctagttggcaagcagtagccagattatctctcatatttagcaagcggaatgtgcaatattttgatttggtgttgcagtggccagttggataatattgcgaaacgatatgtctgcacaaatggcacagtcaggccagaaagattttgacaatttgctagctaatgtagtgccaattacacatactcagattgtaagtagggccaattcagtcatctttctgattgtagcctgatgcatgccacctccttttaccagttattgttgaataggtagtattcacatgatggtcaaatagtgcagtgatctttctagcctccaaaatccaaaataaatatctgttgggttgcctcttattgatttagctgatcttgccttcaactccatctacaaaccaataatttaacatgaataataatgaagagataatgcccgtgcacactaatatgaaattgttgaattttccttcgaataaattctcggaaaaaaaggggggaaaacttggaaaatgagcgaatgagcaataagcactgggatgcaaaatactgtatttgataagattgaccagaaatatattatttcactaaaaaccataaattccactataagcatataggattcaacagagaaaatactggctgcatccaaaagtcaacctggaaatagttctcttggtgcttatataacctcagattctcagtacatcagcgcacagctgaaatattcaaatcacaattaatccatatttccaaacattagttataccattgtgcattctgctcaagcagttagctttcaacagcacacacatgcctaatttaatttgtgccagtattaaaaaagtacatggcaacagctaaattattgtctttgtgaccaacttatgtaagctgattgatacttggtttgtccgttggccccaaatctcataaaaatgaaaacactgtttgctcttggtctgttgtcctgtgcaaatttgaagagtggcaagaagtgatttgggatgggaatgacttggtacttgtagttgagggataatgcatcttgaaggaagaaagctctagagacctagaatatttgttattgagcatcgcttgggttggttgtagtggggttgtttccttgaccccttctttgtacatatatttgctttcttaatgaaatgaaacagagctctcctgtgttttcgagaaaaaaagacctagaatatttgtagaagtaccagattgttagacagataaaaagagattgatgatgtggagcattggaataactagttttgcactaatatctataatgattcctcatttttctctgatggcaaaaggaaaggaaccatagctaacctgcacattatttcccttttgttccatttttttcctgcaatgctttctttcccaagatcataccaattcttcacatggaatgattgaaatatgctgacagggatgtactggatgaggtagagatccggcagctccttattgatcatgttgggcatcggtgctgctggggaagtaggcctgctcgcacatggaaaattacctctattgaggattgcaatgtatatgttggaactttggaaactttcatcgaggaaagggacactgtaactaacaaggaaccctatgatggtgggaaaatagatggaagagacaagggtcctgtgcttgcagtgtgggaacttgatctgaggtctgagtttcctctactgtttgtaccagaaaaagaagtaatggtcaagatccctcactcagaagtaattgaaaaatgcttaggtatggttttcattctgaagcactcatttagtcatatagtttcttttgccgattgtgtaatatctgtacttcccaactacaactactgtgtttcttgcggttgtcctagttcctatctattctgcaaatatccttctaagcgtcagctaaagttctgaaatatatttttcgtcccatcgtatatcatcaccttaattcttttcgtttatgttgttatgatgttatataggaatcgatatgtgcacttatttgggttttttaacacacatcatttttcttagaacacgcaagagatatgcgtatcatttcattaagatagagggaaaaaggtggacggcgttagagataaactctggcacctacccacccaggaattgcaacactgacactacacacttgaactcaccaaaacaggagaaaagataataggagatagtttttttttaaaagatgcaagagatctgtgtatcatttcattaagcaagaaagaaacacgaggagggggcagaaaaccccaaccttgcaaataaacaagtcttacaattacaaagactcggaatgacctttggctttcttaaaattatttgtagttggactccttaaatatatttttcttatcaaacacttctggcttcttcctttatactataattgtcctatcagtatgatggtatatatgttttgcacggcacatatcataatttattcatcattgttttttctattttgaatattctagtttctgatctaaattttctcctagattgcgagagtcgtggagagataccatgtcctatttgcaatgctggtcaggagcacggattttacaaggcaaatcagatgacccgttgcagtgcatgtcatgggaggggtttacttgctcaccaagatggatctgatacagtgttagtcctgcacttctgctgctaactttgttttttagttctacatctcgccgtttacattagtgtcattatctaaaaaaatagttcacatttgcacctaatttaaaggccactaaagaagcacatcaccacattaatcacctaattttggttgcctgttcaatttgagttggtaaaattgtgtacatgttaaggcagtattgttgcatttgttctttggtccactagatatttatttgtatttacatgtcaatggttgctattttatttaagtttttaattcatgcctgattagatagaaaatagtactctaaaatttgaaaaatgctttcctattattgagatattttacatctactggtaaaagtatgccacttctgttgaaaatgctcactttgtgcgtatctttatttgtaacagatgtggaatgtgcagtggtaaaggaatgttgccttgtatagcatgtggatcgcgtggcctagtaacatgcaagacatgtagtggctatggttcccttctcgcaaaaagcactgctcatgttcgatggtaatttgattctttttctgctgttgctgttttagtgtttacgttgagacgatgtatagtaacaagaaaataaaatcaaaatatgtgatggctgaaaggaacttataattgctacaatgctttatatcatgataatattggtttaatagttcagtaatcctgcaaatgtggtaaaaaaaagcgtagtggagaatttgttgttgtagatcttgtgaattgatgctttaattgtgagtttggcctatcatattagtttcattgttttagagagagtcctagcatattagttgattcatacaaaatacctcggtgatgttcagggaacttatttattaatgtttcatttgctggatgctttacagtcgcatctcctaaagctatcagtgtatctgtaacttatgcatggcatagtagaaaaaggcgtttctccatgatttgccatcaaccaagcaaagcaatttgtacacttataacgtgatgatatgcacattatggtttgaaggaacgcctctatgatttctacaggaaatttcttttatgctttttattcatgttttggagaaaatactttacgttttttttttcaataattacgtaatgcgttgatctaacttgaaattttcctgtttctaggaagacactgtcagcaagaaaagtgagcgcaactaggggagctgcctctgtgcctgacgaagtattccacagagcccaggggattcagctatgcaacatacaggcgtaccagtgcactcctgcattcttcgccgattcgtaccagctcaaccagttctcctcagaagtcgtagctagccggcttccagttccaccgtccgcgagggtcatttccgagaggcacatcatctccgtcgtgcctgtgatccgtgtcacaatggctcatcgcaagcaatgtttcagcttctacgtcgtcggctacaatagggatgttttcataagagattatccttcgaaattctgctggggcctctgctgttgctttgagtggctgcggaactagttatttcttgccatgtgacaaaaatcgagtgtgcagtattttatagtattacatacggagtaaggcttgtgtataattatagcaaaaccgaagattaaagagggttgaatgaataagcataaccctgtgtgttatgcattttttacattacagaagctgtatcctcgtattctattactagggcttcgtccatgtagatcatatctgtaacaactgctcgggcatgaatcaaatcagttgtgaagactttcccttagacaattgtgtcggtgttttaattctggcattgaaattttcagatgaaattttaaaataatttgctgaaagcataaaaagaaacgtacgtgcaaatcaattttaaatataaacattttgattttttttatcacaccatagcggcgacgcggcgtgagtctaaactccaaacccatgccacggacggcacaattctttcaagatgcgtaaagtactaaagtgtgaggcttagaaacaggttatggtattctttatttttaaatcatttttagagaaatggttcaaagattagagacgatcagaatttcatattggattttggacagtttcaatccctaatgccaaattgaggacagtttcaacggcttttataaattaacgccctgtcctccttgaacgcctcctttctcctctcatttgcaataaagccaaataacccaaaagcgatcaaagaatccattgcgattttgcgacatcgtgaaccgggaatgacgacgaagaagaagccgctgtcgtcgtcgccgtccacctccgccgtggcgaagcttctcctgcggtggcgcggccggagcaaggcggccaaggacgagagcatcgagttcttctccgagctacggagcagccagcccgatcgccgcggcgccgcctccgatcacgccggtgagaaattgagattgtccgctcctcaatccctcctcgttcttgctgagaacgaggaaatttctgcaatgcagggggaggaggagctccggatgggaggggaaaggcaaagagctccgcccccgctgccgccggtggagacgccggcggcggcggcaagctcttgtcgacgggaaccgagaagcatgactacgattggtacggatgaatcggtggtgcattgaccccgaaatgtagatgaaaaattgtcttacgtttttcttttaccgaattgcgttggcaggcttctgacacctccggcgtcgccactctggtcgccggcgacgagcgccgccgcaggccaccatgtctccgccgcgccgccgccgagccggctggaaagagctagctcggcgccatacgcgaaagggaattcacgggtatgtgcatgcgctctcgccctacccgatcaaaattttcacctcttgcaattgcaaattgttgtttgatcccccatttctcccccttgcgattgcgaagcagctgccattgacacggcgggagaacgggcccccggcgtcgaggctgtcgaggagcagctccgcgacgtcgcaactctccaccgtcgcccacgcgccgggcaccgtgttctccggccgccggacattgtcgtcggcgtcggtgtcgtcgatcaacacggcgagcagcacgtccgtgggctcgacgccgcgggggtcgtcggcgtcgacgagcccacgcacgccggccaccgcaaggggcgcgccggccggggcggcttggccccgtcacagggacagaacacaagcactgcacgtgttcggcgccgccgccgccgccggccaacccagcgcgtcgtcgctggtgtccaggtcgagaccctcgctgacggcgccgtcgagcggagcgctccagcgcgcgacgcccggcgccgccggcacgtcgagcccgaggtcaaccgccccggcgtgtcagcaacctgcagcgaccagacgtggcgccaactccgtggcacgttcggggtcaacgccacgggccgcgtcgccctcgccgcgagcgcgtgacgtcagcattgcggcgggcgcgtcccgtgtcgcgccgccgcccatgtccagcagcaagccgaggcaggcgccggcgtcggggaagcaaagcaacggcaacggcatggcggcggcgagcacggcagcccagaggtggcgctcggccgggaggaacgcacggagggaggaggcggtcacccatgaatcatcaagaaacagcgacagtcgccggaagatcgacgtagcgaacaccagcgccgccgctcgccgcactgctgacctctctagcccgcgcggcgcgagcggcggttctccgacgagcggcggcggcggtcggaacaagtcgacagacaccgacgcgaagcgcagcctatggcagggagcagcggcacggcacctgatggcggcggcgcgccgggacgcaacccccaccacccgccggagcggtggcctctcgtcggtggcgtcaagaagccgcctggggatcacgcccgccgcctcctccggtgacatctcggccacgcccactggacgacggtccacgccggcgaaaggcaggcccgccgccgacgcggccgcggccgcatcctccccgcgggtggccgcgggggacgcgttcccgagctcgcggtacgacgccatgctgctccgggaggaccccaggaacctgacatggctgcacggatgcgacgacggcgaggagatcgacggtggagatctggtcgaggcctcgctggagtcgttcgacgtgccggccgggttgagcagcacggggctgcacggcggcaagactttgaattttggcgccaatttgtaaaggcagccacgtgatttaggaggacactacgtatttccgtatgtatgtactgcaaactatttgtacatggacttctttttctcccatttgaggagcacgaattatttctgcgttgtgggatgcatcaaggattcttttacgctgattgaggctgattttttccgatagcacgtttttcaaaccgttaaacgacgtgcttttaaaaccttttatataaaagttctttaaataattttaaaaaacttattattttatcaagtgtaccataattaatacttcctccgtactcgtaaaggaagtcgtttaggacagtgatacagtcttcaaaacacaactttgacttcttgtttttataaaaatatttattaaaaaatgatataggtatacttttatgaaaatatttttcaagaaaaatctattcatataatttttatattttcaaactcaacaacttgagagttattcacaatttatattcccaaggtttgacttaaacattgtcctaaacgacttcctttacgagtatggagtattcaactaatcgtacactaatggcttatctcattttacgtgtaatgaacttatcaccttcaattgcccaaacagacgtactccctccatactcgtaaaaaagttgtttaggataatgtttaagtcaaaccggacaatgtttaagtcaaaccttggaaatataaattataaataactctcaagttattgagtttgaaaaggtaaaaattatatgaatagatttgtcttgaaaaatactttcataaaaatatacatatatcacttttaaataaatatttttatagaaacaagaagttaaagttgtgttttggagaccgtgtcgttgttctaaacgatttcctttacaagtacggagggagtagctgagaataggtgaccacgctggagcttgtcccaatttagatatactccatgtctctatctcaaaattgaagtatttctagcttgtttcataaaaaaatatggtcaaattctaaattagttagattccctcgtaagcatcatattgactgaaaatatggctgtgtttagttacttggccaaaattttttaaagtatacggacatacgatttgaagtattaaatatagtctaatgataaaacgaattacagatttcgtcagtaaattgcgagacaaatttattaagcctaattaatccgtcattagcaatgtttgctgtagcatcacattgtcaaatcatggcgtaattagactcaaaagattcgtctgaaaatttacatgtaaattgtgcaattgattttgagtttcgctaaaatactgtcgccacattttttgcttgtttacagtcgatacaatgatgcaagacgttagcaactataaaaatatggtgacaaatttttaggtaaaaatacgtcaaataaaatttacacagtagttataccccacttatacaccacttacatatgtaaattagtatgtaattttgggacttacatatgtaattttaggacttacatatgtaattttgggacttacattgaaaatacactaaaaatacatatgtaatttagggacttacaatgtaaatacatgccgactattttttggtaaaaaatatggcgccataaatatagctactcctatgattttttgggtccacatttaatgctctatacatatatccaaacattcgatgggatggttttgaaaaaaaaataaatctaaacacggcctatatggatttttgtgcattgaaatctatcaagtagactcatcggagacgagacggtgtctctctctacgtagataggacctcgcgtaaacagttcggatagtttcaaaccgattttgataatctttggaaatgaccatgtcagttcagatgataactcaattcggaaatgaattattttttttattcggatgatacctcaatttgaaaatctttatctattataaaaattgaagatgattccgtactcgaagagctcttcgtctgttgtccccgtaatccggatcgattccgtatttccgttatttacagcgacgattgatcttttcttacgtgctacatatactccatctcaaaattgaagtatttctagtttgttcaattaataatttattaatagaattcattttattctttatttggaattttaattaatttcgtgttgtgtttttatggtctcttctttcaatattcctatgtttcatttatattttcagatatttctaaattatatttctacttaataatataatagagcttatttttttatttagaatttttattaatcttgtattatgttgcagatggtcccttcttttaatgtttctttctcttcttcttccgaatttcagttattttaaaattgtatttgtacttgaactctcatttttctttttataattttggaaattgttttatttttattttaaattttaattagtttctttcaatatttttgaaatactagttatatctaaattgtatttctagttatcgaaattgttattatgtatttctattatttataaattatatttctacatgctctttagtttctatttctataatttcagaatttatttttttattctaattttaattaaatctagtggtgtgttgtgaatggtctcttctttcattttttttatcttttattccgaattttacttatttcttaatagtattcctacttgaaccttttttttctaatttcataatttattataaattttaattaatctcgtggtatgttgtggatgaacttttatgttaatatttcttcatttttattctgaattttagttattctcaattgtatttttatgtgaactctatttttttaaactaatgtggggtattttaatctttgtagcgaatgtggtgctttattttaatattatcttaataatataatagattggagtatccgtacgtaaaggtactataatatactccttccgtcctaaaatataataacttttagctctcaagatatgtcccaaaatataacaacttattcaccaacattttcttctcaaccaatcccagcccttcaccattcacttttctcacatacatccattactcatccaatcaccctttaccattcacttctacttgctttcttaataaccgtgtccaactctaaaacttcttttatcttgggacggatgaagtattttcaagggcgtgatccaagaggtagtgatctacagtatttatatgtatgtagacacggttgctaaaattagaaggcaatttaatattttttgttgatataaataaaggactagcaatatctctttattgagtcttaatcggttttcatgttctgataaatgctcgtgagatatatatcgttccagttcattttagctcgtgtattcctttcatgtccagagtattcctttccgtttcgataataatagagaaaattatgaaaataaatgtgattaagccagttttcgtccttattcgaattgtttgacactttgactctatgataaattgataatactatcttgtattttgctcggatatggatatatacattctagttgtgtaaatatctggatatggatacattttaattgtgtaaatatctggcaactattgaccggctaaggccttgttcggttacgccctgatttaatccggaccgggaataacaagtacagtaagaaatttatgtagatacaatgtgtcggtgatatgggtccgggagtatcatgtttagagggataaggccgcccccaaacccacgtggcgtcccctgaggagggcggcgctccgatggagcggcggccgccaaatccaagcttagggtatcgagtttggaggaaggaggctgcccccagacccacgtggcacttccccgagggggtggcgcccggggtggagtggcggctgccccctcctcgctcgggggttgggcccgtcccgatcaagactagagggaggaggctgccccaggcaccacgtggccctccccccaggagggatcgggcccgaggtagggtggtggccgccccctcctgcgactaggggtcgggctcctccgaccccctctctaggtcaccacgtgcggtggattaggcagccgcctccaggcgcccacctacccgcatttatggcgtcctgagcggtggcgccacgccgcatttaatgtgatgtgcagtgcactcaaccgatctatgatcggtccgtgaccagtcgaatgaccgataggacagtggctgtgtacccccaccctgtcagtatgctaggcggcgtgcggcgtgctctgccccgtcacatcataatgagaggctttttagtctctcatcatagccggagtcagtttatccgctctagtcaaacaggagcccagaagtcttcgtcccttaaatggcgactgataggggcacccccatgtcaggcggcaagatttgatgggccccatcatcaagatgacgtgcgctgagacaagatatgcatttaatgcaaagattgtaatacttctccactaagttaggttgttgggcctatgtggtaaccccttaaggtataaaaggagttccatgcctacttgcggaaggggacgagccattttaatctctagagcagcttctgccgctcatgaggaatatctttggctccaacaaggagatcttgcaatttctcccacaatcaacatagcacaggagtagggtattacgcttctcagcgacccgagcctgtataaaccccttttgtctaatcgtcttggaggggctaaccccctcaagatcgcacagtttcgctcaccaagtcctcgaatctcacccgctgcccccagccgaaccaaaaaacaaaagggggtctcacggttccctggtggaggagttcaccttccgacatctggtgcgccaggtagggggcgtgttcgtgatttttgaggtactttcgagcgccggcgtgatgatcgtcgcgccgccaatgcgggggaaggcgtagcctcctcaggagaaccgcgccaccccaggcagggggctaggcccctacatcctcactggaaaaggataacggacagacctttgtggcgagtcttcggaatgtccgatggcccccaaagttcgggcccaacctcaccgagaagtacgacggtggcgtcaacccctccgagtccctccagatttgcacgacaatcatagaggcgccgggggggtggggtggggtgaagactaggtcatagcgagcttcttccccatggccctcaggggccaagcgtggggttggctcatgaacctgctgcccgcctcggtccactcctgagaggactcttgcaggtaggtatcaagcgtttgaaaacctgccgaaaccacatggtgcacaaggtcacctggcgccaaccacaagtcgcacgctcgctaagatgggaagtcaggcttacaccgtgctccgacatgactgtgtaatttacaagtcccctcctccagcggagaggtcccttcttagttgctggcgttctgtgctcggatcttgtaggctggttgccaaagaggagaccctgtcaccaccacaatccatgcataaaggcatctgtctttcaagcattgatcatccttttaagtttcaagtatttttcaaattttcaattcatcagcttgaaatcttatatttaatttccccctttctattctcatggccctgcgacgctcgcgtattgcgcatttgttgctccctcggtggtaagagcccaacctctctcccatctacatgaatgattcttcgctaagtgtgggggctaagttttctagccttatcatagccttaagttgagccccgagtgccgtcgaagctcgggatcccttctgctggctcttccgtagcggctggctttggtcccgctggcttgctacggtgcccagcccggctcaactgtggacggggattgctggccttagagttttttggctctcacactcgtgcgaaagtaatcgtccatgtagaaggaaaagagattggaaggaggccaccgaaaggagagagcgaacaaaatgtgtagtgtggggcgcaggctcgtgggaacttgacctcgtttactaagtggtcgcaggcttcccgaaagggttcggagcctagggtggggagccctcttcgagccaaacgtttgaaaagtcgcgacatgcaaacaaggataaacaaaggtaacaaaggaggtattgcaatacccgaaccaaagccggcctctctgggaaagctcagcgttggccgggggatctttttgagcatagcatttgtaatacttcctttaagtttatatctactttgttcatgcttatcagcaaagttattatggcttatatttatctctcacctatctcttcctcgcggtcccgcggtacccacgtgtcgcgcgctcgtttaccctccttggtaacaaaaagtttgtatttgcttcatccattcaaaagattctttgctaaaagcgtgggggctacgattcctagctttatcctagccctgcatcgagctctagtcaccgtggacgcccggggccccctgtgctggctcttccgtagcagctggctttggccccgccggctgccaacggcgcccagcttggcttgat

SEQ ID NO: 79150 - DNA, 3027 bp, Oryza sativa
ccccctgtaacagttgacaaaccggcctagttttggctttgagctttgctctcctgcagctgcatatatacacacatgttttgcctgccgagggacgaaactccatcaattctctttccttgtgccggctatatttgctcctactcctgcatattttgacatgttcagagaatggtatatatatatatatatatatatatatatatatatatatatatatatatatatatatatatatatatatatggactttttccttacatatatatatggttctagacttttagtggagtttgttttgaaaaaaatgattagtcgagagacagagttctagtatggatgcatcgtacacactcactatccggccgcggtccaagcctcaaaggcaaggccacaattttttcttcttcttttacaggatagtaactatactacatgtctcaaaacataagagaaaaccacaaggaaaaaaaaaagaaactcttcttaatttgcctccagtgcaagcttggcccggccatgcgtacatgtttgcttactcaacatgtctcagtacactcgtccgtgcagcctgcagctagctaatcaaactcacactagctacccaaagatctggcagagttagctagctttgattgggactgcagtgagaaaggatcgatttaggtaagttgacatgaaaacattacacatttacacggtgagaaaggatcgatgagatgttataactagttatatatgccataaaaattttaaaaccttttacaacaaaaaaaaaccattgtgatcaaattagaccatcagtataattcccggcccatgagttctattaaggctgtttattttttcagtcgttagaaagtgtatatatacctataagatgatatatatgatgtacaaattctcttaatatcaatttattgtaggttcctccaaaaaaattatgggaaaagatatacgtactatactgtttgtactaactttgtacaagttaatgctattgggtcatgttgcaattaattcttgactttttagaacttccagttgatttaatcaagcggttgagatttttcatcagtaaaaagtttgtaagaaatttttagtatatgtagagcgctatagacgcacacactctgcatctatatattgtcatgtatccctgtataatttcgttacacaattcttgtcatttggcacgcacctagcttagcttatccattcaacgtgtggctcacaagcgcctccagctctgatcttttttcttttcgtattcttgaactccaccaggaagaggggaccaaatatcagctcacagacagagaacaagttgcttccgacaagagattgtcctacaatatctgtatctatatgcaggtatactatcgggatcttttccttcaaatctcgtggtgcatcgctagctctctgtagccatccaagtgttgctgatgattcattgatctccaacccatactgcccatttataattttcattattattcattaatttcatcatgctggcgatcgtcatccatgagttgtttcaaccacaaataaataaaagatatacatgcattaaaaaaacgagcgactatatatatgaatagtcaatcttgtgtgtatttaattctgtagaaggtgactataattaattaatccaaatttcaaaatataaaaaggatagtttgtgccgacggttttgtttattccgacttgcatgagctcttgctgggaaatttatgcaaaattgtatagtaatgttctatgtggtctttgagattttcttatgaaatagcttttcaagtttacacatgctaaacatgtcatgatcaagctctatatttctagctatagtttagtttaaaaatactgagagatggtgaaccctcaatctcgtactagttagatctctgtaggcacacaatttagatctttgcattcataaggagtactagaaaaacaattctgtgcgtcacctgaaaggcacaagaaattgaacttttgcaaatttacgcagtaaaactacagtatagcagaaagtcagcagaaagatctggtagatgacagacacatattagaggtgcaagtacaaggattaattagaaaattatgcacctagcatatgcactatatgcagaaagatttggtagatgacatatgctataagctgaacaagaaattgacaccacctatatatatgcaaggagatgaagaaagagctcatcatgaagatccaaatctggaaattaatctttataataacgaattctatgcatatatattacagccacaacaatgaactacaacttttcccttggccaacaaaactgatcacttgcctagctagctagctatccccctatcttcatctctcatggcctctaacttgatgaacctgcagttgtcggcttctcgccccagctcctttttctttccccacatcttcttgagttgtgtaaattcaacttaacaatcccaactcgaacaacacaagaacatatgcatagtcgatcttgtagatgagcaagcagtatcgacgatgaagatcgatacatatatacatatatgtatatatataatcaagatccacacatgaatatggacatgtacatatatatacttttttgtcttcttggcttggctatcatcagctgtagtcaccgcctcgtcccggcgctgacgacggcggcgggttgtggtggtggtggtggccgcgggcgatgaggcgggcggggagcggcctgccggtgccggagccgccgcagctgcggcagggcatccggccggagccggcgcaggtgcggcagccggagtcgccgtcggaccagcggttgcagaggcagtcgacgcggccgctgccgccgcacgtggcgcaccgtggccgcgcgtcccacctcgacgccgccggcagctgccgcccgtcgcccccgccgcccatggtccggttcgccatggccacccccgccagcatccccagccccgccgacgctatcacgatcggcccaaccatcgtactagtgtccacga

SEQ ID NO: 79151 - DNA, 2213 bp, Oryza sativa
cctggatagttagttggcccatcatcatgatggacctagtttaaacatctagtgcttgtaatagaccgccctcaagaggccccacctgtcagctagacaagctgcccgaatgtcttaaggtaataaggtcattggttagaagcaataatgtaaatttggtaagcctagagtaatcatcggcttcgaagtcctgagattagccgatgagagttatcaagtcgtcagttgtcggattcttgctatattcgattaaggaaattgatctactaaaggaatcttatccagaagagaccgagttcaaagagtatgcggcatagcaagttatctattaattaggaatagtttgttagtttccttttatctttaggaaagtgtgtttagtgtcctataaggattttatcttttcctttttatccttagtttatttcttgtccgacaaggactggtatctccctatgggtataaatatgttcacccggggtcattgtaatctatcaatctctcgatcaataaaaactactctcggtgcatcgccaccctttttaccgaggtttttacttatcatccgacggaacttggcacctaacgcggggctgcatcggctttcgatctccggcaaaggggtaagtcctacgttccgccggccctggtgaatctgttggctacattggtgttgttcaaggctgcatcgcttcgatctcttggatcgctctggtttggttgatatatttgcctacctgatatctcaattctatctctaattacattgtttttagtgacgcatcggtttagttggaactgtctcggttaggtccgatcttctgtcttaaccgatatatctctacaatcataatgttgttctaaatagatttgtcatatccatcacattagatagatctatcggctcatcgagtattagattatcatatacaatctcgtgctgcatcggttaggttcgacctaccatattgttattgataatatgaatcttgtaaagccgataggttcatgctagtgttttatcggggtgctagccgataagttatctggacgttgcatcggcttataaggattacatacaagttgggtttagccgatcgcaacaaaggtttcactatttaatctaatcttgtggatttcatgacatcagacctccagccgatgtacgctttagccgtcggatcagtgcttattctatcatgtcattgttagccgattggtttctactggattatattgctatattatattatcatcagtcgattgccttcatatcattatatacatttgacatatagccgataactcaaaaccctatcgctatcggctgatatcgatatcggctggaatcggcattggttggaactactccatcggcttctcagccgatcagcaatttgatctactgatatcttgtcagttgcagaataactgactggcacgccctcatctcatcaacttttagacctgcacaggagctaagcagacctcccaggccaattaatgtgtgtttttcgggtcaacagttataccgtataatggagttttctgctaccgagaagtctcttggttagctgcatcttacactactcctttcctccaccccaaatgtttctaacactttgtattgttgttggattttgttccaacaatacttattaattccaaaatttaaagtcactaattttaaattgcataattattacttctattagtgaaaaactatagtttagactccaaacattgtactaatcgatatatcttaattctgaattgtctagttattaatttcgaatttcaatattattaaattaacaaaataagtagtgaaacaaatgaaatgttagcatagattatatatataattttatgattactattttttattcttggatctattaataaaataaaattattttcttcttggttagaggtggatactggataacaagctagctagctcggctcgcgttaaggctcagtttaatttaagctcgatatcttaacgagccagtttcactcggctcgttggccttaataaactaaaagagtagccctcgttaggctcgttaacgagccatatcttattatttcacctttctaattttaaatatttcattttatcatatattacataacaataaacattaactaagaaagaattgttgctcagctcattttacgaaccagcgaaaagctaaaacaaagttgca

SEQ ID NO: 79152 - DNA, 11212 bp, Oryza sativa
ttaaatttgagaccaagactgactgttccttggatataccgaagtattctcttcactgctgcccaatggactgtagtaggacaatgtagaaactaacacaccttattaacagagaaagaaatatctggccgtgtgagagtaagatattgaagtgcaccaacaatacttctataccttgttgaatcttctggacctaatttttctccctcgtgtatagacagtttttcagaggatgacaaaggtgtattaactggtttactattctgcattgctacccttttaagcaagtccatggcatacctttcttgtcatactagaagaccgtccttggttcgtttcacttccattccaaggaagtaatgtaaatcaccaagatcctttagggcgaagtctgcttcaagactctcgagaagtcctgttgtggctgcttgggaggagcttgcaacaattatatcatcaacatacaccaaaacaaacatggtatatgtccttgtgttagaataaaacaaggaagtatctgctttagagggaacaaatccaagttcttgaagcttgtgacttaaccgagagtaccatgctcacggtgcttgttttaaaccataaagaactttgtccaacttacatatataatgtggaaaagctttgttttcataacctggtggttgccgcatgtagacctcttcctccagaactccatgaaggaaagcattctgcacatccagttggcgtagactccatcctttagacactgcaatagatagaacaagacgaatggtggccgctttgaccaccggactaaaggtgtccttatagtcaattccatatctttgcttaaaaccctttgcaactaagcgagccttgtatctatctattgagccatctgcctttttctttatcttgtatacccacttacagtcaataatatttttaccactagtggagggagcaaggtgccaagtcttgttcttttgtaaagcatcaaattcattgtccatggcagctttccaattcgagttactcaaagcatcatgcagattagtgggttcagaagtagtgacaagatttaggtacctcactgtaccatcagtatagctcttaggtttgcgtatgccttgctgcagccgagtcacaggacgttgtggaggaggtggcgacggaatgaccggcgcaggagaagcagtgtcgactgagctcggtgaagatcccacgtcctcgtgcggcggcgtctccaaagcaccaccgtgcccccctggattggagacagagcgcgcggagtggagggaggcgtcgcagtggcgccaggtgtcgacggagtagtggacgcggaggcgtcctccgcgtcagaggagacagacgcagccggcgacgcagacacagccggcgatgcagatgcgtgtggaaaggtcattagaggctcctctggaggccatacaagaaggatccccttccacttctcgatcccggcccggaaaagtgaccgacccgaatgaaagaaagggtttatgagccctagccctgtaagcccacacctatgtagagtagatcgtttaacacctcgattaatggaacgtgtattcaggagggctctgcttcgctctattccacctcccgggtgtatggatttcctgaaagtttaattcatatatccgaaatggaacggagagagaactttccgttctgggttagtgaccacataactcctgtaccactcactagtttacaacattgaaataagcgattctttctgcaatgtgtctctcagcgtttttatttttctcccacgatccagaggcacagatgcaggcgaatcggcgccggagagcgcgcctgtgcccgtgctcccgccagcaggcagagcgcccataaaaggacgttccagtgaataatcttgctgtggattgtcgcctgaaaaatttggagagtctacatatgaaacattagtagcaggtgaatcatgcaccgattgatcagctagctgttccaaacaggaggatggatcgatctggtgcaggttctcagggaggagtaaaatctctgcctggaggcgagcgccggcgttaggatgaagttctttaaacggaaacacagtttcatcaaaagtgacgtcctgggaaatataaactcgacctgctgatacatctaaacacttaaaccccttgtgcatagtgctatacccaagaaaaacacaccgggtggatcggaattgaagcttgcgagtattgtaaggacgaagatgaggccagcaggcacaaccgaaggtgcgtagagaggagtaatccaggacttgttgaaagagtttggtgagaggtgggactccgtcattgacaggagtacgcaagcgattgatgagataagcggcagtgagaaacgcttcatcccaaaactttaggggcataccggcgtgagcaagaagggagagccctacttcaacaatatgtcggtgttttcgtttggcggcgccgttttgttgatgtgtatgggggcaagagacatagtgagtgatgccaatccgttgaaaaaacgtgttgaggcgttgatactcaccaccccaatcggtttgaagagcgaggatctttttatcaaaatgacgctcaacaaggttttgaaaatcatgaaagcattgaaaaacttcagatttactcttaagaagatagatccatgtaaacttgctaaaatcatcgacaaagctaacataataagaacgcctgccaactgaggttggagcgggaccccttacatctaaaaaaataagctctaaaggagcttgagaccgactaaaagacttaggatagagaagttgatgactcttcccttgctgacatgcatcacaaatgatgtctttattgaactcactaacaaaaggcaaatcatttttgctaagaacttgacggacgatagtggatgacggatgacctaagcgatcgtgccaccgggtcgaagagatcttgtggacaccaaaggcactcttgttggctgaaggagaggacagcttcaggggatagagacgtcctttacatctgctgcgatgcagaagcctcctcgtgtcccgatccttaatggaaaaatgatagggatgaagttcaacaaaggcatcaatatcaaatgctaatcgagatgcagaaactaaatttttggtggcttccgggacatagagaacatttttaagaacaaggttaccactaggaattggaacagtagcatgaccaatgtgtgagatttccatacctgctccgttcacggcgtgaacttgttcatttccggtgtatttgtcccgcaccgtcagcatgtcaagttcgccggtgacgtggtccgtggcgccggtatcaacataccaattggtatcgataccatacgaagtggtggcaacatttgcagctttttcctccccggtgaaggaggtgtcgaagcgtttgaagcacttgatcactgtgtgaccaagcttgccacagagttggcacttgggtcgttcttgattgccgccaaacccgccgcgaccaccttgagcagggccgcgtccaccaggattggcgttgccgcggccgcggccacgttgtccaccattgccgcgcccacgcatggcggcgttcgcctgtgccatcccttgacgaagctccaggcgttgctcgaagctgatcagttgagtgatcaactctgagacagagattggttccacgcgggctgcaaccgctgaaaccactgggtcgtaatcgaagtcatgcccggcgaggatgtaggatactagatcctcatcgtcgagcttttttccggcggcggtcatctcatccgctaggccgcgcatcttgttgacgtagttgatcacggaaagattgcctttctgcgttgtagcgagagccattcttgtgttgatggcccgcgccctggactgggacataaacatgccctcaattgcctcccacacgccagcggcagtgctgacagctacaacctgggagagaacttctcgtgagagtgaaagcagaaggtaacttagcacctgttgttcttgtgcaacccattcagcatgggcaggattgacgacggtgacgtccttctcgtccttcttcacgatcatagtcggagatggcttctccttggttccatcaaggaacccagccatctgggctccccgcagtgtcgcgaggacttgagctcgccacagcgagaagttgctgcgggacagcttctctgtcaccggctgcgagagcgccggagcagagggaacagcagatgaggatgacgccatgaggaaggagaggaagatggctctgataccatgtaaagtgagattaacgtggatgcctctcagcaccacggttccgtgttaatatagcagggaacagtccccaggcgtggcgattacatgtggttgttacagctttaccaagaagaaaggaaacagaaaacaaactacaagattacatctgttatctaatcctatcactaggatcatctctatctgaaacactatccaatccattcggttgtttaacaccccctggatctggccgactaccgaccgcatcctccgtgagttcgtggtgaagcaggcccagccactgccgttgttgcagccgcgcggtttccggcggcctgctcaggcgatagtgagggagggagggagagaggggtggggtggcggcgagggtgagggttgtcgcccgtgtcgccctctaagatgaccgttatatatatttgtgggcagagaaagtacatgaatatgtacaaggtatttactgacgacttgaaagacgtacgtacccatgcatttatttccttgtaaaaatcaaccagcacatcaccaagttgatgattcagggattcgacatagaatttcgccggtgcctcatgtcaaacagtcaaagtggagacgcatagaaatggtcttttgccgattgccacaaagacaaaaagatgataaggccggccgtgtgcccacccaacggctcagccggccacactatgcactcgctcggacagtcgatcgatcagcacagcaaacatcactttcgcctttgcgatctgacggtgagatcagagcgagcgagctagagtggattactgcacctgccggctgtggcatgcagtgccagtgctatagctcttcctgccctctgccctgacgtgttgcaatagatcgacagagaatattatttttgccacggacggtacggacaagacagtgagcactatttttgctctagtgtctgtcatttgttggaattggcgatcgcttatggcacagtaccgtggaccatgccccctcattcctgtctgtctatctcggaattaacatctcgtgaactacaatactccttccatccaaaagaaattatatactccctccgtttcacaatgtaagtcattctatcatttcctatattcatattaatgttaataaatctagatagatatgtatatggaaaataatagaatgacttacattgtgaaacagagaaagtaattacaataaaaaaaactaatatatgaaaggaaaatgttatagatagtcatagctaattaaatgatactccctccgtcccagaaaaagccaacctagataaggatgggatcatgtccaaattcgttatactatgaagtgtcccatccttgcgtaggttagtttcttttgagatggagtaggtggttaagagtgaaagagagcatagtaaagaagatgggactgaaccggccgttggactggaaaaaccaaaactagcacctttgatgactcactttgttcacaagaccaagccaatcggtcttatgagccagctaaactggacggttttcttgtaaagccatcgaaccagcacagattgaaccgatcggctcattcacataacaaatggactagtggtggagccagaaattattaaagcctagcgctcaagtatagctcaactaatgagttattgattttctcaaaaaaaaattgcttgttgatttaaggggattcaagcccaagtctaaggctcaagtccaagctactgtaggcttatctccgctcgtgaataggacttgggccattttaaggcccatgattgccgaatagatgtttgaagcccattgtttggaataaattaccaaaaaactttcaaaaatgaaatgcaaatataagagcatctccaacagcctctccaaatcggactctccaaacacctatagtcaacactccatctgatttggctagtcaaactagttactcgctccaacagcctctctatccatatgtcaattgcatcatcttcttcctcctctcccgttcttcctctttctcccgcgcgagtcgacggcgcggcacctcgcgcgagcctgttaattactcaactctaatctatttaactaccaagcctgttaatttgcactctacaggcgtgcattggcaatgacatccaaaataaaaaaattcaccgagatgaaattggtacgcagtaaaattccaataactggtaggactgcaaaattcagtagcatacacacccgaaggacgaagtcctcctgcttccagacggtcaggcagcggaaggcgagatgcgcgaccgcgacgccggcgctgctgcacgagtccgactgctgctgctggctcgccgtgaacacaaagcagaaccccaggaggcggcagagcaggaacagatgctgcatcgaagaagaagaagaagctgcccacattggcgtgccactgatccccgtgccctgactgctcttcttcttcttcttcttcttcttcttcttcttcttcttcttcttcttcttcttcttcttcttcttcttcttcttcttcttcttcttcttcctcctcctcctcctcctctcgtgcctttcttggacttggcactcgatttggcttagctcagagaaagcaccggccgtcgagctcctcgcgcgcggcagcgacggtggcggctataggatcgaatcacaagaactaagccaaccagagggggaggtgaatggttgatatacccaaaaacctaaacttttagtggaaataaaagttaccttcgaattcgatgtagatcggtctgaccgaggttgatccgccggtctgaccgagctcgtgccgccggtctgactggtgttgatccgtcggtccagccacctgaagattgcctgccgcgtgtgaagtcgccgccggtctgaccgcctctcctccgtcggtctgaccgccgcctgccgccggcctgactgccggtatgtcgctggttagaccgccgaacccgatgaaacacaaattaaagaactcttaaagtagatgacaactttattgcttctctctgtgtttacaaagtgcaccaacagcactccttacaaaaatctcgactaaactcgaaaccctaactaaactagcaactcaattgctctcaaaagcgataccgggaagcctcatgctccccctctatttatacatgaggtaggcagcctaaagccatgaaccaaactcatagtaagagtcctaaacaccttaggaaaccctatagtacaagacacaaactttacataaccaatcgtaccaaatttggactccttccaaattcgactccgtatcccatacgcacacaatacctccatcgtatgccatatggaatcttcaccaaccacgtgcatcaactctagccttagtatcccgcatgatatctgaccaccacggacatcttcttaccaagccgactcctggtctatcaacgcaaatactctcccgaggcatcgagtcacctacacatgaaacaaacaaagaaaccatattccaagaccaagctatccccaacttgacttattgttagcaaacaacagtattacatacgtatagtatccatctagaagccataaccatgaaacaatcacggatattcaaacaaacaacccgaaaccgaaaccgacacagcatcggccggtcagaccgcgggccgggccggtctgacagcacacatagcgccggtctgaccggcaacctccgcccggtcggactggacacataaaataacagtgaatccgatcatcacctgaaaattgattatctccaaaaccacttcgacgataatctccaaatatcaaaaccaataatcacatatgccaattgttcatcacagaataagaatcaaaacacactttgatcttacagcggcgaggagtcctcctcctccaccggggtcgtcgtgcagcttgccatggcgcttctcgaggaggagctgcgctacctcatggtccaccaaaccgtgcagctcgaccccacgggcatcttctccctgcgccgcctctcactcggctccatggacgacggctgtggcgccgggaggacgacaactgcggtgccgggaggacggcgacggcggcaccgggcggatggcgcggcgggcagggagggagcagcagatgggatggggaaagggagagagagagagagagaggagagagggtgtgggacccacaccgatggcgagccctcctggctggccaactttggctagtgtggtgaggaatttagccagccaaatagcttggccatccagttagcaagtctgttggagcacattttttacccaagttagccaaattttggcttggagagccatttggccattctgtggagatgctccaaaccatgcaagtgaagtgagattggtttgattcccccgcaaattttgcgcgatgtactagcgggctatggaggaaccggctatggatcttcctgttgggccgaggaactagctcaaagagcccatgtctgggttgtgaacttgtgatcgaccattcccagtacatcagcccatggagaaaccgatcgagcagcagagcctccatgcattcgcttaaaaaaaaacggtgtgaagacttctctttaaaaggaaaaaaaacgaaccctgtgaaagagagagagtgacaagcttggagacatgcatgtagcgagaaccagagataatacacgtgtgacaccagaagagaggagatggaggagaggatcagaagctgggaggatggaacgttccaagctgggtaaggacctagtacttggccactttactcgggctttgctgcgtgtgtgcgtgcactgatgcaaagctctagctagtgtagtgttccagaatagaaggaacatgtgtgcgtgtaccgtagtagtgtactatgcaaggctgcgactgctgctgtgctacttgcgatgctataataaggttatgttggggtacttggatacctctgtttcctaacgaggttacaacaattatttggtatttgcatctgaattaaggactctctagctagtctagtgtgctttattgccgggcacgcctaatgcccagcgatcacccgcccgtccccctactcccccttctctctcccctcttcttcctactcttcttctcttcttactacagtaaaaaaaataaaaaaatttatgtatagaaatactatatataaaaaatttgaattcaaatttaaatttgaatcgggtacgtaaacttttgatttataaactttgggtctataaactttaggtgtataaactttagatgtatagaaatactatatatagaaaatatttgaattcaaattcaaatttgaatcggatataattcaaattcaaatttgaatcgggtatgtaaacttttgacttataaactttggatctataaactttaggtgtataaactttagatgtatagaaatactatatatagaaaatatttgaattcaaattcaaatttgaatcggatataattcaaattcaaatttgaaacgggtatataaacttttgacttataaactttaggtctataaacaggtatataaactttaaatgtataaaaatactataaaaaatatttgaattcaaatttaaatttgaatcggatatataaacttttcatttataaactttgggtctataaactttaggtgtataaactttaggtgcataaatttactaaaataggaaagtaatgcggtgccaaaaaaggaaatgtggagggagggagggggagaggtggtgatcgctacccgatcgtggtagtgatcgatcgcgcattagactttccgtttattgccttctcttttacaataacgaggaagggtagactccaatttagggtctcaaatagaactcaaataataaccatagccatccaacctcattgttgatctagcatgtaaaatatcaaatacaatataaaacccaaagcaccgagcaatgagcaaaggatatctttgatggaatagcttactactcaactttcacttaagatgttccccgtcaaatcactcgaaggcggtgagccggtgaccaaatatgttatactagtggttacccatcgcattgcagtggaaaaatttagaaatacttaaaaaacattgaagaaaatagtttataatatgtaaaaggacaatattttaagcttgataataggtgatgtggaattgcgagtgtatattacacacaaattgttatgtaccaaacatgtgaagaattcaatggctataattaatttatctaggtgacatgtatggttttaatggattttgagatttacagtaataactatattaagtgggttgtaaatgaacatgagacatgaatggttgagatcaaagcatgagaaaaatccaaaggctaatattttcttgatgatgtgactttatacatgtcaaacttttgactttatacatgtcaaatatttagataatggaagaaacattacagcctttgcacctcacgttggcgcaatcacattactaaatgaaccaaaataaagcctcaagtcgatatttattaacttcaaatttcttaattattagatcctcaaaattgctaatatgctataaccgagactgcaaatggagtaagatcgatgggtacctattaattctatttttttgaaaaatattaaattaattaagcaatatactgaatataaattccaattataagtaaattggtacttgttgggggaaggccagaggagatcccctagctagctgtctccgctctaacagtaaggatcctccggagaggcctgaggcactccgtggagcccggtgtgaaggctgcgggtcgtaaggtatcacttttttgcagcatcaagggtgtgtttggttgcaagccacactttgccacagtttgccacgcctaaggttaggcaaatttgacaggtgtttggttgtagccacagtcgtggcaagattcccctccaacaaattgggtcccacgtgtcaatagctc

SEQ ID NO: 79153 - DNA, 1716 bp, Oryza sativa
catttttctaggtataaaataaagccctttttaccattattggtccattctgaaaccaatggaactaatgaaaaatcatgctccaatcgagaaattaaggcagaaacttgatctttaatcatctcatcacagcacacggaggaaagtacttcacgaaaaaaaaagagaaactttcgcctccggttttgcctcagaccttagggctgtgttcctagcccaggtttcccaactcatcttcctcactttccacacgtacgcttttcaaacggctaaacggtgtgtttttttgtaaaaagtttctatatgaaagttgtttaaaaaatcatattaatacatttttgaaaaaaaaattagctaatacttaattaatcacttgttaatggaccgttttatttttcgtgcacactgttccagttgggaacaggctccagcgaacagacgaacatagccttagtcttgcggcgatcaatctcgtggacccgatgccatgccccattgttggcggttgttaaatgacaatccataccgccaacatcttcataaagtctagataataaaacatcaacatagtaataggtgcttaatcttacatattccacaagtgttggtgtatatttgtatgcagatgataaaccctgaagttgggaggaaaatcagactaaagtgaggagaactatgtatccatacaagtagggttgtgcacttcatcgaaacatcagtaaatcaaccgaaaactccgagaaatgaatagaggaaggtcccgagagtccaccgaccgaaggccaggccaggagggcccagcccaggtttgaccgaaccctctggttcggccgaaccccccgatcaccgttcatcctgggtttggcgtggatgctccagatgttctcccaatgacggttgcggtgcagttcggacatttccccttctcacaaccgtcataactgccctataaaaggacctcacttcattcactctcacacacacttccaagattgagctgaattataagaggctctattgtactatattgtacactagaataggaagagagtagagtagaagtagtcggaagaatttcggagttgtcggtaatcttctcctatttcttttattctatttattactctgaattcaatataatattcttcttgaataatttagatttatcttgtgagaattatctcttggttagttcctaaatagcatacgggattattgttcactataatcaactaaaatatagtgattgctttgatgagttataaacactaaagtagatattaattgcttagacgtggtatttaggtatttgttatccagtaattgctgcgtatccacagtacgtttgaggtaggtgtagaggtggtgacagctcttgagatcacttaagtcctccctgtccgggtacgtactagagcgacattgggaacaacgggttgcctgtgcctgaagtattgcattaggattaaagttaagctttccctagacactgttctcactagtaaatcctctctatcctggcctatcatttgcttggtgtccttggataaactggaggaagatctaaccatacatgttcctttggattcgatatccttggaatactccgtaagggaagtgctacctcggtatatccgtgcacttgcggattttatctgtacccgtattaaaaaccagcacccatatccttcaaatccaactcacaaaaaatcatgg

SEQ ID NO: 79154 - DNA, 772 bp, Oryza sativa
tgatctcaagtatgtctctagaaatgtaaattgcacaaatataaatgtgacaatcaaatgagacaaggagacaagagatttttcaccgaggtttggaaactcgccagtttcctactccctgttgaggcgagcccaactccaccgctcaaccacgaagccaccgcacgcccccttcgtcaaggggtgggtaaggcgggagccggcccacggagaggactacccaagcctcaatcactagggtagttcttccttcactccgaaggtggtgaactccaaaccactcacaaaccggcgccgggcctcctccacaatcttctcggagaggtcaccgggcaactcctccacaagccgtctaggaggtggcaacctccaatagtaacaagcaatgacccggcgtggagatgatcaatcaagtgccacactagctctacaaatgaaagcaatgcacttgactcttggctaatcaaccttctaacacactagatggatgaacacaaaactcaagtaggtgtgagagaggtgcaaaggatgtatgcaattgaattgggtgccaagagagtccccttgctgctggtgggggagtatttatactcccacccaccaaaactagccattgggggggaaatcccaaatcattgtgctctgtcgtctgaccggaggtatgtggccggtcagaccgtgctactctcaacggctagaaaactagccattgaagagctgtcagagggccccatcggcctggccggtcagaccggcattgagtgggcggtca

SEQ ID NO: 79155 - DNA, 571 bp, Oryza sativa
gttcaatcatcatatattaaaaatattactgaattttaaattggcaaatcatgatatatgggttcttgttctctcttgtagctaatcgctgtaatatgtatgatatcgagttaccgatcatacatcaacgctacaaaatcactgttcactaaaccttaagtgagttgccatgtctcgtagatggcaccctccatctctaaatcttggcttcgccactgcaaagagaagccgtcatggcggtgatggcggcaaggggagctggcggcgatgaagtgtacgcggcacagtggcggtttcagtggtggtgaagcatgggacgcggcggcggctcgaggaggggcagcacgcggtgaagcatctaggcccccggtgttaattttagtaattaatgacaagcgctaattgtggactaaccgttgtctttgagctatatattttaagttaggtcgacgtcatgtgtgcgcatggatgactatcgatggattaaaatttgatggcgcgaagcgaagaaaagaagaccgtaaaactagtgctttaatttagaattgatcgaggtgtagggcgatcaaat

SEQ ID NO: 79156 - DNA, 1454 bp, Oryza sativa
ggaacgagaagatgaattgaagtcagctcatccgcatctgttcgccagttcttccgaatctcgaggacgagattctgtttaaggggggtaggtttgtcacaccctaaaaatccaaaatatataaattgttgtttaattggaattattagaatttattttaaaagcctagaagagaagatctaattttaattaataaattccaatataaaatggggctgataaaatttcattaaatactttgcttaattctatgattcctagattattctgggatttatttgagctaaggaagtatttttaataaatggaattgcatttcatgaataatttaaattgaaaaaggttttttaaaagtctcttttggctttgggccgaaagccggcccaaaatctctctctctctccccggcccagtcggcccagtccagcagcagccgccgctcgcgcgcgcgcgtccgcccactgacaggtggggcccacctgtcagtcttcgtctacctccggccgccgccgcccgaaaccctagcgccaagtcgccgccgcccgctttccaaatttggccgcgtctttcccgatccggtgaaatcaatagaggggaaacaatcttcgggatctcctctaccttttctcttttggaatcatcgtctaaatcgctttggaagttcgtggattcgaggtcgaatcggatcgatctctttcctccgaaccccaatgtttctttcgcgtcgccggtcgccgtgggccttcgccgctgcctccttgcccctataaaaggatccccggtgtcgccgctacccgccaccaccattgtcttcgtctctcgccgtcggaagcgccctagcgccgtgtaactcgagccgcagtcgtcgccgtcgctccagccgtgcttcgccgtcgttccggtcgtcgtcatcgctcggggaggtcgccatcgtggtcgccaagtcgccgccgtcctcgtccgccccttcgccgtcgctgtagaccgccggagcaccgccgtcgtcgtcaagccgaaggtctccgccgcttctttctcgtcgccgccgccgtccgttcatcttccgccgacgttttggtcatcggtgagttcgccgccccgcgctctacgtcctggtgccctccgtccgcgtcgtcgcgccgtcgttcgccggcgagcaagcgcgcccgagccgctgagccgccgagccgccgccggaggtgacgtcgccgctgacgtcatcgtggccgtctgccgtgagccgccgtagacccgatcgatctcggccgtccgttttggatggatcgatctcggccgttcgttcccgtgaaccgctgccgtgcgcccggtccaccgcaaaccctagccgctgacgcaataaaccccttttccttttcaaaaataattcattattgcgtcataattcaattaaaatccatataagtgttttaatccgatttaatcttcaaaaattc

SEQ ID NO: 79157 - DNA, 1450 bp, Oryza sativa
  unsure (1)..(1450): unsure at all n locations
agaacaagcctgaaaaagcatgcaataataacgaaatcatttcacacacaagaaagattgctcaaactaaaactaaggaggttctgactaagaggaagggatgagcagaaagcgatgcatctttctagaaccatcaacatctcaatgtatagatgagtgtcaaatcgagacttatacaagttgaatgataatctgatgatgcatctatttgatgctagctgttgctgttcaatcaaaggttcagttgtagcttgcttctcagcatatgttgtgatctgctttcttcttcgtgtatgcaacatcactccttggcaccagaaggttgctgagcgtcctcgctatcttatatacctatatagttcattctcacttagtttatgctattttttttctctcattaagttatatcacattaattatttttagtctttagatgattaatctatggttcgaattatcttttttttctctcattaaaccatatcatctcaattttttagcccttagatatatggcctaaatgatctttcttcttttgttctttcataaaaccacatcatcttactttcggtggcggagccaccatgattcccgggaatacccaacactttttatcaaaaaataagtatacttctaatatatacacatgtacacatatttgtacacctaaatcctcaactcttttatccaaacacagcccaactagtctcttgcgatgcctccaaccaacccgacccactccatcatgacccatcagacatcaattgacccacttagccaccacttttccagacagccccctctcgctctccctccatgacccatccctccctagctcggctccctcgcgccactccccatttgcaaaccctaggtggcggcgcggcgagacagcaatcggcggcgggagctagaccgtgctaccgtggagggggaggccattgccacggcgggcagcgcccgacactccgccaagctaaggcggtcaggtcggttgggtggccggcggccgcgagaggcagggacgggcaacggctcagcgcttagacgggaatacccaactttgaaatcctagctccgccactgcttacttttctatttgaatcatcatcttacatactatttaaatttaaatcacatcgaatgatataaacttatgtttttatgtttgtgtaaacttatgttgtttaagcaatcttacatattaaaatacttaatattatagtaaactccagccggggttccatctttacatagagttcgtttgcccagttggnnnacttggtcgttcagattgggatcaaaatgagatgacgtgatggagtagccatcacnatatactattaacgctaccattataccattagcgnttaacgtataaggttataccataaactgattcagaatacacattagtgttggacgcattagtacgtatcgacttgctgct

SEQ ID NO: 79158 - DNA, 8405 bp, Oryza sativa
ttacacattttgataaaacatacaatctcaataaaaagacctctagaaaatcagctaaattaataattaacatcataaagcatatcacttacccaagcttaagaagtcctgcgacagtgctggcactaatgtcaaaatcaacctttggctggataataaaatttccttcccttataggctaccattaaatgaacaaaggaaaaacgtagcctgtcattgactgtctcatgaaaacacaaagataaatggtatgcaaaaggtaaactaacctctcgtattaacagtgcaaatcttccttcacatattcggaccctaatacactcgccttctgtcagctgtccactcaacggtatgccaggaagtcttagatacacatcagtaaaattctggacacagctgcaggctttactagcatcgagtactttcaatatgtcttgataagatacctattcatgaaacaaaaatagataaataatcaccaacgtaataataagatgaacaatataaagctcaaacttacctgttttttactttttagtacgaaaagtgagctttcaggagagagcacagggtcaaagtcattttgaatcttaagctgcaaagcacgtggagaaggaacattgcgtgagtccaaacaagttactaaatacatgataatggaaagccataaatgataaatatatatcaaataggtcaaattcatgtttcttgtaccaacatgagcatcgataagatgtggttctatgtattgctgaaatagcggaaacacggtagtcataatttcactctgagaaatagaaaagcctgcacgattcttgtctctctgtattcttgcaataagatgagaatgtactccaccaacctactagacagaatgcagtaaatttccagggagatatttatgatgtaaaaaaaaatcaaactagataaacagttttttcaagatttgaataaaatcttacaacttttttttgagggtaaaaaatcttacaactgcaatccataaatccagtgatttccttatagcaggatgcaaagcatagacaccttcgaagattacctagtagtccaaaagagtaagataagaaacaatgttatcactgaaatttgaggttgattggttcaaaatacccaaaataaaggttaatatcaaatcaaattttatatgtgtattcgctacatcaaatctaattgattttttttcttgtacagcactcacagtcaagtataacagctatcaaccacatcatatagtttccagtacagaataagtagaagaattaaaataactaactacaataccctgtttttacaattttatgttatcttcaatagagttgcttactacaaaaagaaagatgccctcactaattcttgatttgaagaagccgtttgaagttttaaacatgtacctcactctgatattctgtttgctacgtatagaatattttgcatatggaattcatttaacaccgcgattcaacataagatattattatcgcatatttaggaaaaggtcacaacaccaaaacaacattattcaccaaacaggtggaattccattgactatatgccactatttttagttggcactagattttccctcccagttcttcatttttttttctcgaaaatgcttcatttcattaagaagcagaaatacgtacaacaaagcggtccacgaagaaggaaccctctagaaagaaaaaggcatcacaaaaagcgacgcgcaacagattactcctaggagcagctaaccaaccaaaggaagtgaccgatacaggaactcattgagaaccctggcacaagccgtacaccaaagaacactctttcttgctattgcttgcaagacaaccacggcgctgggcatggccttattgaagacaatcattctggtgcttccgaatttcccatgccactaggataatcaaggagttcaatcctttcttcgtctccttgaccaccttggactaccaactagagaagcgggttgccgaaggttggggaaggcattatggaccatcataagctaatcatgaaatgaccagtgagaccccatatctgagagtggccacaggacacctaatcacactttgaagatcttctgcccaccagagacaatgaaaaatatagtgcctgtagcaccatacaagtgaacaaaggcggatgctcgccttacagcaccaaagagagtgacttggtgtgaatcagagaacgccgccaccggcacatagtataatagaccagtccaggccagaggttaaactggaaaaagccggaaccaacaaccttagtggttcggttgactgtaagaattgttcacgcaattgaaccaaaagaaacagacgttttccgatggaattccagcaacttattgagaacacacaggccgcagttctcttggagtccagctaagatatggccgttgggtctagaaacgcctcttgctaaggctcaagagcacagtgttccaaatatatgcgaaaaaatggttttcccacttgtttcaatggccatctaaactactacgctgatgtgttcaaaggaaatatgcatacaacataaacatccagtcctgcagtatccagctgactggcaaagcaggtcagccggtccgccctttttctattatgcaccagcatcctgctcaaacggcgtgctctgatattctgacttctgttgaacccaataaatgatctcagagctaaattgatgtttccaagtagcccaagaactccatcacaagattctgctttcgcacaccttgattgtgtacattctcatggagtcatggtgatccctagtgaggtcaaaagtgattgaggaaggctgatagagtattaggacaccataagaggagaggtatggtttcaatagacagtgaaggagatgatgagttgggaggagaaaggggacagaaaaatggacagtccaagtaacatagtatgtattacatcatgtgggattacagcttcttaagcaacaacgaatattgtagtataaaaataacccccctccatatgtgacatggtagttaccaaaccaagaatattacccagaaatgaaaaatactgggtcccttctgaaccataacaaaatgtatgtcaatgaaaatatgaaagagaaagatggttatgtattttaccactccacattcctcagagacttgaagctcctcgaatttctttcttttgcacttctcaaagtcaaagcaaggaacttctgctttgtgattctttctgatctccataatgttctgcggggcgataagagaatcgtcatttaacaggcactatagaacccaaccatatgattccagaaaagaaaaggcagcatgcaaaatgctgtggagtaagaataattttatcaccactattgaatgcttaatataaccaatacatatttctggcaaattaatgtcacataataattttctgtctctgttgaattaaaatcagttttgtaaatacaagaattatctggtaatgtggttgttcaccaccagattttgaaccctaaattcaagtgatctcgtatagatagaaacatggttcaagaaggcgctaggtgctagagggtcagcagagctggtgcctagtgcctagcgggcacctaggacataccaatcatagaatccaagaaattatcaagcatattacatagagaaaaatagcaacacaatagcgcccaaagtaggttagcctcctaatgcactatctaatgcctaatcgtggcagctaccaagtgcctaggcggcgccttgcatcgacttttagaacaagatagaaatttggaagcatgcttgaaatatttaagattctagtagttatgcacaggaatttgtaattcacatgataatacagaaaaggaatcaatataaaaaggaatcaccttagtaagcaaacctatatccaatgagctatactcatcatatttataatccctaacttgttcaggcttataataactctccaagcttataacttcacaaccaattatattggccatcttctgagctaaacttgtcttgcctgatccactagggccacctacaaataaacagtgtatcaacttaaacagcgacagcatagtcagtaaatgtaatttgctgggtgtgtgggtcatatcatttttgcacaagtttaacagaattattattacagaatcaatctattccatacaatataaaattcttagaagaattcttgtattcacatacatggactagtaaaaaaacagatggggcgcaaataatcgctcagtaatctgccagaaggcccatttatgtttattgtctgctttagcacacattttcacaatagatggttgttcgccataaataagggacaattgcttatatttagaagccgaactaccaaattgaccctactttttcaggtttgctcatttgaccctgtttttcaaaagcgaagccaccatctgaccctgtttttactagtccgttagggtttcagttagaaaaagaaaaaaaaataattttactcgcatgaactgaccaaaatacccctcatcccaacctttatcccacattggcgtggctggccggcgcgtggagggaccaggagcaggtgagcagcggtgctggcaagcaaagagagggacggcagtgggcgccagcgtatggaggagcagcggcggcggcttctgccgcacagagagaggaagggaggggcagcgccggcgcgcggacaggcggcggcgcctgttcgcggaggagcagcgcgccggcttttgccgcgctgagggagggacggctccagcacgtggcaggaggagcagcggagctggcgccggctgttgccgcgtggagggaggagggatgggcggcgacggctgctgccgtgtggagggaggaagggagggagggccagctccggcgcgcggaaggaggagcggcgacgccggcgcacagagggaagaggagcagcggcgcgggcgcgtgtagaggcggtggtggcgatgcgtggataagcagcggatggtgcggcgctgatggggaaacgcgcgggccggcgcttgctgtgtggatggagtgcgtggccgtgtggacggaagcgtgcaacgcttgcctggctcagccggaggcacaggtcctgcgtgaggcgctcatgtggcccacatccttgctcgctcttgctctacccacacctcctctctataccttgttctactagatctggaagttgctttgctcttgttttgctgatctgattgaataatctctcttgttttacatgtattaatttcacacttttttttttttttgctttggggtcgacacaaatttgagcttcgtgatttgcttggggcaattgttggatgtgaaatagcatatatgcttttctttcttcagcgtgcaattggatggataatatatttccaaagttttattaaaattcagtcatctttgcttaagttatcaaatctaactcaaattcacacacaatttgtcaattccaagtcaaatttattaaaactttcatcacatacaccgagtacacaaaactaagccaaataaataaaaactcagagagtatactcaaaatgagcaggggtataaacggcatttggcccctaagttaacaccgttaggttggcctgatagaatagggtcatagctaatgttcatttttgaaaagcggggtcaaataagcaaagttgagaaaatagtcaaactggtagttagctttcaaaacagcgtcaaacgtgcaattgccccataacttaaatatattacaaaaaaggcatgacatgtagccccagcaactggtacaacaaacccacagagaattgtaatacaagttaatcctaaaataacaggtgtataggaatagattaggcacaacctatcaggcactcttttttgcacagcaagcataccattatagcacattaaaaactggatcatgtgaaatttggagatatagatgctctgatatcactttaatgaaactggtagtcattgcaagtgagacttgtcacaagggatatctggtgcagatgtctgactaaatgattttaagttgccccagcaaagtagagtgagttgttttagttatttatcattcacagcaagcagatgcttggtcttagtaaacacaaaactactgctactttattaacggtaaagatgttattaccaatcccaacaatgacaggaaatcctttgttctccaacaatgcctgaaagacaacaattaatggaatatgttacagatcagtaatgcgtaactgtgatgaaaaaaatagaatgtggtttcatttacctgaattgcttgaactgataggagaagacccctatctaagtcataggagtctggcagtggagctaactggatgttacttcctgaagaagaatctgcaaaagtgtaagaatatattcaatggattttctacagaaaaaataataaataaatatggtttccaatgtactccgtaataggcatggttgggattagggcacttgcgcctatttctagttgtgtatccctggacccaagtggcagcggtgccattgaggcagccacgccacaagggcaggagagaaggggaagactaaatactcttgtttattacttgcttgatgagtaaaatacaaaccccgtcatatagatgtgttagcttgaccattaagaaacctatccctagtattaagaaaataactaacttataagtctaaccttatctctaataagaccacctgacatgaactatccacgcacgaaaattaaccaagtaggtactattaatgcacagtaccaccagccctagagaggcagaccactctatgggccctaatgggctgcacatgatatccaatgacaagagaaaatgccctttgttttagcattaaagaacagaatatgcaaggcaaaaatcataaatgaaagcacaagtttaaaaccttgattgaactgccattttcccataacaggctcctggtcaaactttttgggtggagacctcgtccatggttgtgcaaagtcatcaaaatttgcaacattttcggtcgaaacacgaattggctttggtgcaacaatttttttttcttgactttcagtcagtaatttccttgagattggtggtggcgtattaagtcgtgggacccctgacaaccaacatgaaacttattagtggatagaaattattgaaaataaaaaacatgaaaacaaaaatgttgcacctttgctctctaggatcatttcaaggtatgacttcgtaatccatggcccctttataccgagctttctagcttctgctgcaacaatctaaattatgcaagccagttacatattcattttttttccaaagttcaatgacaacaaacatcaaaataaacctaaaggttgcaacatagaagttttatcgagaacagaacaagatcatttggaattcataaacatattattcacttcaaaagataagggtagaaaatttacatagctataacttatcaaccaagatcaatataaattatgcatcagtcaatttcactgcaaatacataactcaactgaattaaaaaaaaaaccatttcaaactccaatttcaaaattttcttggtaaaactccagcaacctacataactccattgtatgttaatgaattgaatgaattgaagacaattcttctaatcaatgtcgcaaaagggtgatctgatacacctcagtctgcaatatgctttatatgaaaaggtgaaaataaaatgaggaacactgatccgttagtgcacattcaatagaagccagaagtaaccaaagttgtttatgaaaacttcatccacatccttggaaatcaacagtttgcatcattgcaatagcaaaacaatatcttttggtacaatagaaaagtgtgcatatgcatattacaatgacgaggagatagagtgaacaattacaggaactggagacaacgttcagttaacttagaaactaaatttaacagtttaaatattgcagagtaaactaaagtacaagacagagaactgggtcatcataaaaatttgactcttgccacaacatataggtaaatatgtgctatccgaaagtgtataccttcctacttggaccttttagcaccagaaatgtttcatttagggtgtcaatagtctctgctgcaattaataactgatctctgctgacagatgtgcatgtacgtttgaagctaacaacaacactatatcctaaggccaacaatcctcccagagttgtacgtccaacctgagacaaattcaaatatatgaagcaggtcagaaacttaaacctgtcagtattgtactttttgtgtagcacaaggttacctccatcccaaaatgtacctatttctagatatgcacctgtccaagtgaatagctagaaatagcaacattttgggacggaggtactg

SEQ ID NO: 79159 - DNA, 604 bp, Oryza sativa
tgatatgaatatttcccaaagtctatagttgtaaaaccacctaatgttacctaattagattgcgaagcatctacctaaaattatactagggataccatgagtagagtgtccactagttgaggttttgtttgtctagggtgaacaaggtaataataataacaataacaataataatatggtcctaacaaaggtaaataggcatggttaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacatgaccaacggaaaagaaaaaggctttaacactaaataacttctcataacagcataaacaaagcacaaaaatgggttctttacattttaaggaaaaattagagacttgaactgtccaatttctagttcaaatggccaagatatggccatttgaagtagatatgctcttttaatggatatttgcgaatttcttcattaaattttcaattaaaaatatgtt

SEQ ID NO: 79160 - DNA, 18276 bp, Oryza sativa
acttcgtgcacaccaactagcaaatgtcacgaaaaattctacaaaaaattaaagtccactcttttttagtcagaagatcactttagctaagtagtccttcatcaaaattgcatatctggcacttgcaaacatatcctatgcacgtaagcttaccgtgcacacttcatgcacaccaattagcaaatatcatgaaagattctataaaaaaaatggacatttactcatattagtattacacatatctacgaagtctcatattcaaattcattatattttagtcgttaccaaaaagtgaaaaatatgatagtttcaagggtaaaaatctgtctgaattttatcttttttattacggctaaaatataatgaagttgaagataaaatttcatatgtaggtgtaatactattctaagtatgtgtacaattttttgtagaatttttcgtgacatttgctagttggtgtgtatgggaagtttgtgtggatattatatgttcccctggcattttagggtcaatctttcatgttgaaagctaaagaaaaggtactccccctctttttaaaaggatagacaattgagagaatagggcgataacgatagacataggaaccgaaataggtcccctttttcattcatccaattaggtcagaatggatcagggaacccggctctgagaaaaacacagtaagagcgcccaaccctctgaaatatagcattctctctctgctcgggaatttaaattttatgccaaaatttaaattctaaaagagtagcttgaagtgactggacctggttcgaggccagttcatgccttcctggctgaaactaagcagggaatacattttcttctgcaattacgttgaaaaagacataagacataattgggttcctgatcgaagctacagtggaacgatgacatatccttcctcccaaagaatatatacacatttcatgatgtttgtttcaacttacaatcaatagtgttcccgcgtatctaatctaacccaggaggggtctgtattataacagtaatcttgcaggcttatctttttttttcagtaaattttagcatctccacggaaaatatggtggtcaggtggatgcagttacaagtgctggaatttcacagctaccgttggtcagtgatgaatatctaggcggcaataatgaatccatatcagcaaaatgtccctcctcgatgtatgcctccttacctattggtgcgtcaaggacagagtttggtatcgcgtcaagagtctcctctaagaaggattcaagtgtctgcacaaatgaagtttatgacttaagctatcatttaagggacatttgaagggaaaaagaaaataatgcaggtgtcagtatgcatgtagaataattaattttcatatacgctgacgacatattcacatttcacaatgaaccaattttgcatgattttgggaaaggtccttttacaccttaagagcatgtgccttcatgctttgcatgccatccaaatagtcatgaaaattttgaatgaagttaaaggcacaaattgtcaagtcataagtgaaacaaaatatagctatgaattgctcatgctatgcaagggtggagtcattcttctgtttcttcatatacacatctgagtttcaaattgaaatgttctgaaatgataaattaaatttaatatttgaatatttttcaattatttaattgatatttgagaggtttggagattacggggcacatgccctcaaggtgtaaaaatccagatccatgattgtgcacctcatactgattttctcattttcaggtagcttaaaacataactggctagcatataaaatgatgaccaacaacattcagataattaagttagaaaaaaaaaactagttaagtgtttgagatgattacttgaccacttggagattgaacagcttcctcattttcatttactagatcaaaattaaccttacaagtattcataaaaccaagtctcacaataattcatttgagtatagtataggcatctttcttctgttgtatttgttggaagaagtaatgtggcatgacaaaggatagacttttttttttataacttaccttgcaatgacgcagtgtagagtcagccttgcgtttccaaaggccattgccaggttccgagtggaataaatttaacaatggctgtcaaaatcaagcgattttctcagtaactgaaagcacatatttgcataagctcataaattttacaaaaggactgataaaggtcaatatagtaattgcattaaatctagtttccagatcaatacacagaatgcagaactcgcaactgttagaccacaattaagcagctcagaataccaggagaaacagatgaaactgtttgatcagtgcatttccttttcttcaatgaactctattttctatttagtgtgctataattatcttttataactcatatcttaggcttttaggcataaagtagaatccctatctatacgcaaacaaaagtaacagttcttgagtaattcagaaagctatgatcaacacaatggtgcatacgtcacagataattacattataaggtgaaacaagtacataaatgccctgctacatcacatcataaagctaacaataggttgttttcattaaatgtaagtgcaacccacaccttgacaagttgtctcacgtttggtctgctggggccatattggcccattattgaatcaccataaacctggtagctctcaaggatctaaaacaaggagttcagttaatacttataaaagaaatagttgatagctgaaaacaaaaccatcctttgatgctaaacctggcgacgagaagagcgtcttgtcggcatcccatagacttcactgtccacatgccccagcatgttccatggactgaacatttattccataccaaaattaaaattacaactaaatactgtttcaggttttcagcaacaaaaggaaacatattctagttacttagtttgcatgtttgaaagcatcaaagaatttagagacacaaaggcttctaattatgaccatacttattatatgcagcccggccaaccataactcgatgtgcaccttgtcttatggatgcagtgacctgcaaatgaatataactgatgttcaataaaaatgacttgactcaggcatattatatctgattgcaacaagagctacttctctgcatgaatgtctagtactaagtacagagagaacaaatatattctttttgcattcatgaaacaaaattgtttttttattgccaaggaaaattgtatcattaacatcagtttgacctaatttgaactgatggactcgctacgcaatttgttcattaaaatagcaacttccaggaattgcattatcaaaactacataactagagtaagatactcacttgatcaatagtagttatacctccatttagagtaaactgcacatctgggaagtcccgcaataaagcaaagtagtattcatatctgcaaaaaaaatgttgaggccggggatgaaaattcagatgagaactagtcagttactggtgataaccaggaaataaaatctgttctgcagaccttaaatttaattcaacagattaggaagcaatttggactataggattgtgtttgtgcccctcatgctctacacgtagtatctacatcatttggaatcttacccaaagttaacaattgaaagttgaaactctacttaatgcatattcttgtttatggaaatggttatcctctttagagattttttttggcgccactccataaattttgttagaacttcaatggttactctcattgagaagaggatagcacccgagatgaggcaattttctggttttcttcattcacaaaacacaaagccatacctacccgagggaggttggatacatatatatatagccatagctcgctgctagcctattgctgcaccctcctagtctaaaattcgaaatttgaatgggatgctgtcctagagggcatccaaactgaataaagcataaaggaggcataaaggagatgctaactgctgttgtcctactaaccgcagctgtcctagcaactgaaaaatatgctaaaggagtagatgctgtcctgaaaaggtgaaactacccaaaagcaaaaagaagaatcacgaccaagtgttagaatttcaatggttactctcattgagaagaggatggcactcgagatggggcaattttctggttttcttcattcacaaaacacaaaagccataccttcccgagggaggttggatacatatatatatagccatagctggctggatggctgcaagctaattgctgcccacactagtctaaaatttgaacgcgatgctgtcctagagagcatccaaactgaataaagcataaaggtgatggtcctagatgctgtcctagagatgctaaaagcaaaaccgaaatatgctaaaagcaaaactgaaaggatgctgtcctaaaagggaaaaacaacctaaaagcaagagagggaccacaaggaccaaagaccacgaggcttattccatcattctccccctaagtcttgtgcgtcgtcttgtgggaaagttgggtcatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtggaagacggggttctttgccatcctcgttgtagtcgacgtcgccgtaccggactgcctcccacatgtgccacacctgcagcctcaccctcatcaccgcggcccactcgatgtagttggttttggtgagggtaggccacccaccgccgggaccaaagtccctgaccaccgtctggacgccatggtgaccatgacgccggtcaggggagggagagccgcgctgcctgcgagggccgcgcgcgggctccgggctgccgccggcacgcccgcgcccgtctgggttcccgtcggcgagcgcgcggtcccttgggtcgccgccaccgccgtggaggtgggctgctgcccaccgctctgcccgctcccgtgcccctcctcttgccagctcctcaagctccctgtcggcggtgatgtcgccggcaatggagccgttgatgctgctgcgcaaggtctcaacctctacctccgccgcacgtgccgcatcttccgccgcctccgcctccacctccgccctgactgctgccaactccgctgccgccagtctggccgccctcgctgctgctgtagcggtctgagccgttgctcgcctgcgctcttctgctgcggcaagctcggcatcctgctgacgccgagtgctcgaggcgaccgaacgccgagaccgaacgtcggacatggcgcgcctccgggaggctgctgcgtggagaaggggaaggagaaggggaaggaggagcagccggtgctgctgctgctggctaagagctcaaccgagcttgggaagcagtggagcaggagatatttagcctacaggaaagtgtggctctgataccagatgttagaatttcaatggttactctcattgagaagaggatggcactcgagatggggcaattttctggtttcttcattcacaaaacacaaaagccataccttcccgagagaggttgaatacatatatatagccatagctggctggatggctgcaagctaattgctgcccacactagtctaaaatttgaacgtgatgctgtcctagagagcatccaaactgaataaagcagaaaggtgatggtcctagatgctgtcctagagatgctaaaagcaaaaccgaaagatgctaaaagcaaaactgaaaggatactgtcctaaaagggaaaaacaacctaaaagcaagagagggaccacaaggaccaaaaaccacaaggcttattccatcaccaaggaccacaaagacttatccatcattctccctctaagtcttgtgcgtcgtcttgtggggaagttgagccatcccgatcctgaagcagagctcgaggaacttaatcctcccaagaggcttggtgagcaggtccgcaagctggtccttggtgttgatgtagctcgccttgatgctcccttcctccaagtagcttcggatgaagtggtacctcacccagatgtgcttgctccattcgtgaaaaacggggttctttgccagggccagagcggacttgctatccaccctgagctccaccgctccagtatctctgccgaggagatcactaagcagtcgagcaagccagagcgcctgggtcgaagcggcggaggccgccatgtactcggcctcgcagctggacagggccaccacctgctgcttgactgactgccagctaacgaggcactcgccgaggaagaagagaatcccgctcgtgctcttgctggtgtcgatgtcaccggcgtggttgctgttgctgtactcgacgaagtgtgccttgccaggacacctcgggtagtagagaccgtggtcgagagtccccgcaacgtagcggatgatcctcttcacagcctgctagtgctccattgtcggtcgttgcatgaaccgactgacgtagccgacggagaaggccaagtccagccgtgtgggtgaggtagcgaaggcttcccacaagacgccggtactgtgtagcatccacttcctccgtcgtgctatcacggctcagcttcagtctctcctccattggagtgagagctgggttgcaatcggtgagcctagccagctcaacgacgcgcttggcgtaggcggtctgtcgaagcgtgatcccggagtcgtcctggtgcacctcaatccccaggtagaaagagagaggcccctgatcactcatatggaaggtggccttcatctcctccctgaacgccgcgacctccgcatccttggtgccggtgatcaccaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcctggcggctggtgcacgtagacctcctccttcaagtcgccgtttagaaacgccgacttgacgtccatgtgatggacgcccagccttcctgagcagccagcgcaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgaggaaggtcagcaagctcccaggtgcggttctcctgaactgcgtccatctccgactgcatcgcggcacgccatgccacgtgtttctcggcctctgcgaaagaccgaggctcaccgtcgtcgcacgcaaggtgcaactgcgcctccaggtcgggaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggttgcgctcaacactagctggcgtcggagtagacgtgctcggaggagtggctgttggtgctggagcgcgtggggtcaccggctgtggtggtgtaggcgaggagctcgtcgtagtcgaagtcgtggcccgagagtgtgttggtgtcggagtcggtggaggctcggggactggggtagacacgctcggtgaagaagagttgcctactcccccagctccctcgaagtggacgtactcgacggtgaagtcgtcgtacttcggagtcgaaccatcgtccaccgccttgtcccatacccaccctcgcccttcgtcgaacactacatcgcgcgctgtgcgcacacgctgtgtctccgagttgaggatgcgataggccttcgagccctccgcgtagccgatgaacacccctggggtgctcctgtcgtcgagcttgccgatgtggccaagctccttgacgaacgcaaggcagccgaagacccgcaggtgggagacccccggcttgcgctcatgccaagcctcgtacggtgtcctgccatcgagggccttcgtaggcgagcggttgaggatgtagacggccgtcaccaccacctctccccagaatatggccggcatccccctctgcttgaggagagcccgagccatccctacaaccgtctggttgcgccgcttgacaccgttctgttgcgggctgtacggcgcggtgtactggcgctgaatgccctcatcagcgcagtacgacgcaaattcagccgccgtgaattcgccgccgttgtcggtgcgcagcacgcgcagcttgcggccgcactccacctctgcagcagcctgcgcgcgccggatggcgtccgcagcctctgccttgctgccgaggaccatcacccacatgtagcgggagaggtcgtcgacgagcagcaggaagtaacgtcgtcctcctggtgtggccggtgtcactgggccacacaagtccccgtgcacgagctcgagctgctccttggctcggaaactcgtctgctggggaaaggggagccgcctctgcttcgttaggacgcagacgtcgcagagctgctccacgtggtcaaggcacggcaggcctcgcaccatctccttggcgctgagccactttagggcctcaaagtggaggtgcccgaaacgctcgtgccactgccacgcctcgtcgtcccgacgagcggcgaggcaaactggttgtgcgacctgcgcgctgaggatgtagagtcgattagtgcctctggttaccttggcaagaaggcgacggcggcgatcccaaatcgtcatgactccgtgctcgaccaacacgcgtgagccgttctcatccagctgtcccacgctgatgatagagttcctcaacacggggatgtagtagactccggtgagcagcctgtgctcaccggactttgcggtgaaggtgacggagccgacgcccttgatctccatgccggaggcatccccaaacttgatggagcctcggacgctagagtcaagctcggtgaagaactcccgccggccagtcatgtgatgggtggcgccggtgtcgaggtaccacccatcagccttgtcgttgctggagctgttgccgaggaaggcgtgtaccttcggctcatcgaggtggaggaaagccgttgcggccggtgccgctggagatagctcgatgccgcgtcgtggctgtcgacagtctttggcccaatggccaagcttgccacagttgcggcaagcgtcgtctcgtgccggcttgtggttgccggcggcgccgccctgggcgcctctgcgagcaccaccctcggcgcgtcttcgcgcccaccgcagttggacgcctccgcgcgccttgcacggcttgcggccgcctgtcgagggagaggactcccccttcctcccgtcaccctggctggcctcccactgctcccgagtgagatggagcttcccgccaatggtgataggccccgagagaggctgtggctcatcgccgtccacgaccttgaggcgacctaacgcctcctcgatcgacatcgtggagaggtccagcagagactcgatcgagcgagcgatctgcctgtacttctctgggacgcaacgaaagagcttctcgacagctctctcctcgtcgtaggtgtcgtcgccgtactgcaccatcttctgcaaaagagtgttgagacggagggcaaagtcatcaacatcctcacctggcttgaaggccaggttctcccactccttgcggagtgcctgcagtgtggacttgcgggcgcggtcgctgccgatacgtgccacagcgatggcatcccaggcctccttggcagtccacttatgggaaagcgagaactgcatctcgagcgggactgcagcgatgagggcatccagtgcccgccgatcctcatcgtagtcaacgtcgccgtaccggactgcctcccacatgtgccgcacctggagcctcaccctcatcaccgcggcccgctcgatgtagttggttttggtgagggtaggccacccaccgccgagaccaaagtcccttaccaccgtctggacgccgtggtgaccatggcaccggtcaggggagggagagccgcgctgcctgcgagggccgcgcgcgggctccgggctgccgccggcacgcccgcgcccatctgggttcccgtcggcgggtgcgcggtcccttgggccgccgccgccgctctgcccgttcccgtgcccttcctcttgccagctcctcaagctccctgtcggcggtgatgtcgccggcgatggagccgttgatgctgctgcgcaaggtctcaacctctacctccgccgcacgtgccgcatcttccgccgcctctgcttccgcctccgacctggctgctgccaactccgctgccgccagtctggccgccctcgctgctgctgcagcggtctgagccgttgctcgcctgcgctcttctgctgcggcgagctcggtgtcctgctgacgccgagtgctcgaggcgaccgaacgccgagaccgaacgtcggacatggcacacctccggggggctgctgcgtggagagggggaagggaaaggggaaggaggagcagccggtgttgctgctgctgctgctgctagctgagagctcaaccgagcttgggaaggggtggaacaagagatgtttagcctacaggaaagtgtggctttgataccagatgttagaacttcaatggttactctcattgagaagaggatggcactcgagatggggcaattttctggttttcttcattcacaaaacacaaagccatacctacccgagggaggttggatacatatatatatagccatagctggctgctagcctattgctgcaccctcctagtctaaaattcgaaatttgaatgggatgctgtcctagagggcatccaaactgaataaagcataaaggaggcataaaggagatgctaactgctgctgtcctactaaccgcagctgtcctagcaactgaaaaatacgctaaagaagtagatgctgtcctgaaaaggtgaaactacccaaaagcaaaaagaagaatcacgaccaaggaccacgaagacttatccatcaaatttgaataatattttacacaaagaaaatcatgggcgtgacatactttaaaggaggaacgttccgattttctgcaggactgaggccacttagcaatgccttccgggcatgaataatgaaatgcctagttggtgattttgaaacaaccttatctacaaattcacctgggaaagaaaaaaaaagtcaatgtacctaacagtgagaaagatacgtagtttgttgcaatatggcactgtatcagcacatgaggttaaattaaccctcaaacaatactcctatgataattaaataccatgcaatacaagaactaattaaacatcatatgaaaaatttatctagagtaacatgaatgagaatcattaaaagtatgcacctacagcatgacatagaatttgaactgggtaatataaataaaaaaaagatatgttacaaattcctaacaaaaggaactatgtcgtgtgacatgttaaaaagaaatgggccatatccatatatcataacaagaagaaaacaattaaattgagcaacttattcttagacttgatttcccattattcagttacctaattatttcagcttgatgtgtgcagaagggataatctctaaataaatgtaaaaggatgttgttatcatacaaaaaggttgatcacatgtcaaatatatacatcaccaattaactggcaaccatagttaaacattgcaatttaataggagtccaatgctttgaagataatcctcagccaactcagggggaaaggggaatttttcaaatttagccaaacagccatgggtgattatttttggccctaaaaaaagataaactgcagtaaatgtcatcatgccaccatttcatctacaagcagatttacatacagtagattaatttggaataagtcatgataaatatatgcagagaactagagactctccactgatgttagaagctttcaactattcttttgatttgagaagatatgagattttttttatgctctgatgctgttgaaaacttgaaatgtaaggagtaattgcaccagtggtacattttaggggtcagttaatactaatccaagattttaaccgtccagcatcactatgcacaagagatactactgtttttttctttcttcaatttgaccttaagggcacaaccaccgccagaagagtacaaatacactgaccagtaaccaataacaactacagctaggtaacctggttcttgtaaaacaaccagataacaccagcaagtgatttacttatatttagcttatggtataggttaacatattttgataatatgagacattaaagcatgccgcaacccattgttgattgatccttttcggtgtaaaagtgcatctgatagagtgtacttatttgacatgatttccatggctcatatctgggaagcctaaggaaatttaaaggaacatgagaggtctctgaagaaagctcacaaagttcttcgtaggagtcacgatcatcaacaccaattctgcacttaacgctgactgggacattacaattggcagcaatagctgacatagcatcccctacaaacttcagataattgaatcaatatttactaagggtggagaaagaacaaattgatgctacctgatggtttactgcaatgaattcataaagcaaacctctggatcaaacattaagcgagcaccgaagcaaccatgaccagcaactttgccactggggcagccacagctgatacaaaacgtttggagtaaattatatgtaataaaagaaatgtcatacatgattagatgagattgagtgacgcttttttactttaggttgatctcatcgtacgaataagcatttgccagttcagttgccttcgctaagttatccagattacttccaccaatttgcaacacaataggatgctgttcagcaggaaacgctaaaaatctatcctgcatattgtgacgacaaaagaataagatttatcaattctgtgtagcagtgtcatgtgcacataatgtgaaccatatgtcgtagacacgtttcacagttgccttcattgcaccaaaagtagaatttaagaaacaatgattgaagacatagtgacaaatatacaaaacaagccagcactgatggtgccaagttgagttgaagtggttcccccatattaagctgccagtgccgccaagaaagctcatcgcaacttgataacatacaaaagaaaaaacatgtgggcaatacattgctggttatcccgataaggcagtaagttgattctttttttcattaaactgcaatatttatgtgaaaaaaagagctgattagctaaaacaatggatatccttcgcatatgcctagattgagacagcagaggagatgaactatatctgacaaaaggaatcagtggaatgccgctgtatgattaggttccaagttgtgatatatgaaagcgcaccatgggctaatggaactattaagatgaacattatactataagactctgatgagtgtacttaaagagtcaccagatatagcttgaagagaatggaaaacttatgcaatgcgcacgggaaagtttttcatggaacacctgtggcattgttattgacatgaatgaaagtgggccaatcgtaaacgaattcagtttgctgctgactccaatcaaatcactaccagattcacatcgcacagtaattcagaatcgtggtaaaaccacaggttgcttcactgctgatcagttgcagggtttcctcctccgtagcaaggatttgcatttctctcatctacgtttcacccggttttaatcatgaagaagtgaagggcggaagggcatatagctcaccaagttatctttctgatgcacgatggtctccgcgaccaccatctccgtgtagagccacgcgtgcttcgagatcagccgcgcgagcgtccggtagtggttgtccgtccagtccatcatcggcgccacgctgcaggagaagagggggaaaaccacgaaatcaatcagctatccatgagcagcaccgccatccccgcccgtctccattgcctaaaacacggaataattccgctccccgctcacctgaacagcggaggaaggtgcccgccacctccagtcgcggaggagctcgccgcgcgagcgcgggcgcgacacgggcccacgccgcgagcgcgctgcggcggcaggagcgaggcgccgcggatgctgccgggcgcggccagcggagggcgcagggagtgcctcgccaccgccgcagccgacctcaccgcgatggccatgcgagctgagctctttctctctcccgcatacggccgccgccacctccgccgccgctgccgccgcctctccttgggaagggtacgggccgctgcgggtgaggaggagaacgtgtggcgagtggtgtcctgaccgcccgatctgtggccaacggtcgtgattgcgtcttgcaatacgactacacgagtccgatccggattacaaacggcttcaatctaccctttcctcctcttacacgggcacgttttttaaaaaaagctgctatataccggtatcccgttgaaaaacaggatgattctaaaaccaacacggtatcgtcaccgcgcgcgtcaacaaaaacagaaagaatcgtatcgtaccagtgctcgccgcgccacctgaacacatcccaccgaatcctcctcggaatcgccggcgcgagctcctcagcaaggcatgcgattcctcgccggcgcaaggcgagctcctcggcaacccgacgaatcctcctcgaaatcgcgcgcctccgcgcacgattcctcgccggcgcgagctcctccgcatccccaagattgatcctcggaatcgcgcgcctcctttgttgatttcgccggcgcacacgccgtctaccgatttcctctgcaatccggtgctctgctcctacctcctcgaccgattctgctccagctatgcgctgcaagctcaacatcagcccgcgtaagaattctaaagccagttctctgttatctctattttatgcatgcaatgtatgtgttttgatgttttgttgctattttgtgtgatttcttttgatgcccaggagaataaaaaaaagtgatgccccctcgagtgaatctcctttgtgtgcactttctgctagtgtgtctgtagctagcgagtcagttgtgacaacaatagtagataagttagtgttggatgagttaagtgctgaaatagagatgttaaaggaggcccttgttagagctagatgttaaagagtgcagtcaccatgatccaatgttcagaagagcaatcagagctagtccagtcgatcctgtgttgcagagtcgagctgttcccaatcacctacctcgggctcccgctccccctctgaaagcttacgaagcacgatgtccaaccgctccttgaccggtttgtcaagaaattcgccgggtggaagccaaagtttctctccgccggtgaccggctgaccttgatcaagacagtcctacttgctttgccagtgcattacatgtctgtacttgagctcccacagtgggcaatcaaagaaataaataggaagtgccggggatttctatgaaaagggcaggaagaggtgaatggcggacactgcttggttgcctggaaagcggtctgcatgccacatgaaaatggcgggctgggaatcaagaacatcaattatttcggcaaggacttcgtctcaagtggttggcaaaaagggggaacaacaggacaggccgtgtgtcaaggttatggataccatatacctaatagtagttgactaaatctcggcaggacccaccacataccatgtcttatacgaaaacaaccttcggatataggaggaattccgcataaggaatgatgaatagagttctacatggaaacgacaaggactacttggattgtatccatattggtttccctagttctacttagacaaggggacacctatgggtataaatacagggccccctaggaggagaggggacacggaacaatagatcaagacacaagatcaacataaaagccaacatgcaagacaagacgccggatatcgaattcagagataagcatggctagtcccttacggtatctacggatattatcaggagagatatagcgctgtctttgatctcgccggatgcggattcgaggaggaaggctaccctgttgtcgactacaagtcagcacttcagaccgccaagtcgacaacagttagataggctactccaaatattgtacttgtgtgatccagatgaataaagagcaacaccggcttcggccaatgggatgtagggctattacctgtaagataaggggcctgaacctatataaaaatcctcgtccccatctcttttacttcaatctcgcatatatcctagtaccaacgattcccatactatgcaaataccggaatcgcgacataaaacgtcgacaccgtgaacaacagttccaatagatcagtcgaaagacttgcaagacctctacctcgcaggaacgagacaagtgttgggtgatgggaagaacaccaaattttggctggcggactggttgctggtgaggagcataaagttgagattccccttgatcttcagccacgtcgagcgctcgggcttgacggtggcatgagggcttctgaaccataggtgggtacgagacatcaagggggcaccctccaatcgtgcaattggggaatactttcagatttgggacgtggtctagggggtgcaacttcaagatggggaggaagatgagacaatctggaagtgggcaccaaatgaaaaatacactccctactcggcctacagcatgttcttcatggcaaacacggtggcgcgatgtggtactctgatttggtaaacaagagcgccgtcaaaggtgaaattatttatgtggttggccgaaaaagggcgatgcctcacggcggataatctaagtaagcgtggctggccgaaccagcaggtttgccaactttgcttggtggttgatgaagattatgaacacctatttgtgtcttgcacctacacgaccagggtgtggagaatgatcaagggctggattggggttggcttcctgctgccatatgagtcaggcttggacttgggcgaatggtggttagcgatgcggcaaaaatttcggaacaactacatggatgccattgatagccttgtgctgcttatttgttggatggtttggaaggaaagaaatgcgcgtgtgtttcagaaccagcggcgctcagccggtttcctgtttggttcaatcaaagaggaggtggcgatttggaaggaagctggggttttcagaaatataggagagaggttgctccggtgacaacttccattactttgacggcttctagttgaagttaaaactttgtatatttgtatatattcttcaatcgtaagtataaatttagttggcctatcttggctggcccggcgaaaaaaaaagagctagatgtgacccagatgatatggaagtggatagaacagatggtatgcatgacttgtccctgtgtggtacaaaaattgatggaatgtacataaaaggactgcttaatctccaatatttgtcaaaagattgcttgtgtgtttgcatactatcgttgaacttttgtattagaaaaatgatcaaaagatgtacactgagtgtcctggctgttggtggaggtagtttttcacacacaatttgttatgtgattgctaaaaattttcacacaagtagcacatgattcatgtggttttcacagatgatactctgttaggatcatgtgatacgctagtaggatcacatgatactcttgaggatcacatggtactcttgtaggatcatgtgatatctttgtagcatcacatggttctcctcaaaaaagtatcattaagtgatacatgtgaggtatcacatatgatcctacttaggtatcatgtcttctaacatgatccctatgggtttcacagatggtacttaatggtgtgatactttacaggtatcacacatgatcctactcaaaaagtatcattaagtgtgatacatgtga

SEQ ID NO: 79161 - DNA, 719 bp, Oryza sativa
agtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggcc

SEQ ID NO: 79162 - DNA, 10677 bp, Oryza sativa
tggtgtggcttgctgagtacggtggttgtactcagtcttgctattattccccctttttcagaagtgtagtgcttttgatctgaagatggagttagaggaccaaggctcagaccccagttgagttttgcctgtggagtggagctgaagccccgctaggatcgcctttttccgctgctgtcgttctgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacacatgttttccttttgctgagatgactaatgatgcagttgctactgacttgaagtttcttgaggatttttcagctcctctccctgcgccgattggcagtcgccgccgccctggtcacactgacccggtggcctgcacgcccacggccctcaccgagcatagccgctctcggccggccgctccaccaactgggccggccactccaccaactgggccggccgctcgcagcttccccgcacaggcttcggtgcgctcaaccactgctgggccgtcgggcccaaccgtcactcctactcggtcggctggtgtgccgaccggaccgcctgcccctcggtcgccctggtcagctggcgcaccgactgggctgtctttacttgcgcctgcctggtcagccggcgtgcccatcgagctggctcccctaccgacgcctgcttcgttggccagcgcgcccaccgagtgagctcccctgctaccaccaccgactggtgctgccacacgcgcccgcagtgcgcgtgtccccggcattcgattgccaacgcagctcggcatctctcccatcatcaatgagcacaccatgacgacacgcggcaagcacggacttcaccaacccgtcaagcgctacaacttgagtgccaccactctctctccagttccgcgcacatatcgtgccgcactggccgaccccaattggcggtccgccatggaggaagagttcactgcgctgcaggccaaccgtacatgggacttggtcccccgcccaaatggcgccaatgtcgtcaccggcaagtggatcttccgctacaagttccagtccgacggcagcctggacaggtacaaggctcgctgggtccttcgcggcttcacgcagcgccccggcatcgacttcgacgagattttcagccctgtcatcaagcctgccacagtccgcactgtcctcagcttggcggtctcccgcgattggccagttcaccagctggatgtgaagaatgccttcctccataggacacttcaggagacagtctactgcactcagcccgccggctttgttgaccccaccaagcccgaccttgtgtgccgtctcaacaagtcgctctatggtctcaagcaggccccacgggcatggtacagccggtttgccagctttctccttacactcggctttgttgaggcaaaatcagatacatctttgttcatctaccgtcgaggctcagacacggtttacttgctcctctatgttgatgacattgttctgacagcctcctctgatgcacttcttcggtggaccatccgtgctctccagtcggagttctcgatgaaggatcttggcagcttgcatcatttcttgggcatctctatttctcggcagtcctctggtcttcatctcagtcaacgccagtactgcctcgaggttctggagcgtgctggcatgacagattgcaagccatgtgctacccctgttgacaccaacgccaagctctctgccgctgatggtgccccagttcgtgatcccacggactatcggagtctttctggcgccctctagtacctgactttcaccaggccagatatctcttatgctgtccagcaggtctgtcttcacatgcacgatccacgggagcctcatcttgctgctctcaaatgcatcttgcgttatgtccgtggcacggttgattatggtcttcacatccgccgctcctccactgttgacttgagtgcatactctgatgctgattggatgagtgcatactctgatgctgattgggcaggttgtccagacaccaggaaatccacctcgggttatggtgtgttccttggcgacaacttggtctcctggtcctccaaacgtcagcttactgtatcgcgctccagtgccgaggcagaatattgtgccgtggccaacgcggtggctgaaacttgctggcttcgacagcttcttcatgagctccatacccctccgagccgatccacattggttttctgtgacaatattagtgctgtctatctctcttctaacccggtgcaacatcagcgtactaagcatgtgaagatcgatctacatttcgttcgcgatcgcgtcgctgcgggatctgttcgagtgctacatgtacctactacgtcacagtttgccgacatcttcaccaaagggttgcccagtgccatcttctcggagtttcggtccagtctgaatgtccgttcccacgacgttccgactgcgggggtgttagattgtgtttatcccttgccatccttccttaatcttctccgatattgtttctataaatcggttgctagatatggaaggcatgtgcctatatgtactctaccatatgtgataatccaatctatcgtgttgagcctatcacacttttatggtatcagagccagaggtctcgagttcaaatcctggctggcgcgcaattaaataaaataattgcagcacactccaatattccacgcttgagacttgagggggtctcgcgtgagggggagtgttggagtgtataaagtgaattgtccgcctttccctatcagcttaggcttctaggtgcaactggctggtgcatgcaacttaatagacgacaacaacaacagcacgtacaacacctcccccgcggctctgccattcgtcagtcgcttctaccgcgccaccgacaggggaataatggagctcgatatcgcttcggatgatcgccggaaaccgccgccgcagatgcggatggcgattgagagttcattgatccattccagccgagcgctgcagagcacccttcacttggtcgacaatggcggggagctgattctggtgcagcggatgctttggccagaccattatgctcatgacgatggtagctacagaacaaagcgcagcaggaagtacgaggcgtggagggtggatttcgatgccgggatcctcgtcccggtaaagggtttcaactggcgcgccctgttcatcagcatgtcccgcgcgatctccgtgtcggcggagaccttaccatttgtcgctgctgataccatctacttcggatactgtggaaacttagaacggtatagccttgcagatggaagcatcgaacgtacacggttggaccgttttgagccgtgtacgatcgtggactgtctctcctattgcatccagggctttggacttatactctgagaagggtgcagtgcaatatcctacctagagaatggaaacaaccagagatgaaagaaaattggcttcgagtctctctattcaagaaacaaaagaaaggtaaaatcgcagtaatttgcaagatcgatcctatagaggaagaccacgcttaatttgaatatcaatgcttattaatctggatcgtgaaacagtttgattacatattgttattataactgataattgttagcttcttaatatgcatgttgttcgttcattatatcccgcaatgaaaatgtcggaaaataatgttacctcaaagcacatcagtacaagttgccgtagcaatgttagagaagaatatgtatgcagtatatcagcgttggattcagtgcaaatataatctgccgcctgctctgcagaaagggccaatatgcagagaagtttgtgtggatatagcggaaaaaaatacaaaagcgattttgctatacatttatcgttgtcaaatgtaatgttaggtcaaagcacatcagtacaagttgccatagtaatgttagagaagaatatgtatgcactatgcagtataccagcgttggatccattcatccagcgcaatataatctaccgcctgctctgcagaaacggccaatatgcagagaactttagtatatcagcattgcagaaacggtgtgaagtttgtgtggatatagcggaaaaaaaatacaaaagcgattttgcacatttgtcgttgtcaaatgtaaatacaacataattctgtaattatattgtaactataatataactttcatataattttaaatcggatttgtttcaaaattttgagaagggaaaaaaatcattgcacacttatgggtgaggggattcggttccacgacaaccgcttcgcggaaataacatgttatcacagaaatttggaaagttatatacaatttcacaaattataattacatgtaattacgctaatattatatcatatttacatctgacaaatttgtttgtcaacaaatatatatagatagtcactacaaacatatagccttaaaaaacttacacgcggctaaggttgtcgagcagacatcatcaccgggtctgatgccgattgcctggtggccttctggttcagccacggcgatgtcgcacgggtggacgcccaccaagagagttggcgacgtcgcatgaaaatatataaacaaaataatttagagtgtgccatatggaaatttgactccaatccaaatttgatttcgcttttcatacacacgacactacatataagatatatgaaaacctttacctgtattgttctatagcttgagcatcccatataatatccttgacgggctaaaccttaactttttcaagttcagttctaatccatcgctggttatactattatggcctcaagaatctgcaccttaatcagaaccaaaatgggacatagagtatgtatcctgaattagaaatagccggcgttactgaatataaaacatattctaatgaagttaaaataaaacaaaagacaccgtgtcatcttttattttgctaaggtatggattaatttgatatcctagccctgtggcttggcaatccggcaaagacgagtttcaactgagtctattatagttttttgagtaaattgcactcacagtgcaacaacttggtaggtgggtgtaatttggtataataatttaaaaaatgagcgttctagtgcaaccacttggcaagaaggtgcaatttagtataagaactttataagtgatcgtataaatacaataacttgtaaggtaggtacgattttgatacaataaattaagaagttgtgacaacttaattatttggagcattttttatataaattcaaaattttaagtacttgacaatatactagcgtggatttgtataaacatatttatatttttatcctaataactaataactctaatagctaataactgaaagtcaattaaactggatgtagaaattattatatttcggttgatatttgagaaggtgaagaaaacaaaaaattcttaaaggtaactgaatgtaaattgtatgtgcaatataattcttaaagattaaattcaatattataaggtaatatccataggattaatgtgtattggcatattgacatcgtgaaaaacctcacctagcatatgcttagctaaattgattcaccaaaatactaaattgtcaagttcttgtactaaaccgcacccacttgtcaagttgttacactcggacgtttaattctcaagttcttgcactgaatcgcacccacctgccaagttgttgtaccgtgggtgcaatttactctagtttttttatgactaagatataagaagataaaaaaacctctacctaattctaaaatttaaaattcaaaatacatttattcgttgtaacatgctgatgtttcatataaatatatttttttagaaatttgttccataccattgaaagttttcaagtttaattttataccatcgaaagttcacgatgcttttttaatggtagtagtaggaagagtaacggtggaaactctaacggtattaaagtgcaacacgaaatttcagtgctatcaaactaaaactggaaacttgtgatgatatggaacactttttcccatttttttcttaattccacaacaaattagaggcatttcactagctggggtaaaaatctagacagacgaagaggtgagattagagcaagtttaataatatagccatctactagctcccaaaattgaaatatcatatatagccaatctaatagccacttatacaatagttagttatagatatatactgcatcattaatatctaatccacccatctctcttacatactatattggaactcgtgctacaattagtcaaccgatagccgatcgactgataggccaatagggtattgttggtggtctcagccgatatagttagaccagatcggctatggacttggtaagatagaacataataaaccctaaacatgtctcatcggctataatatcatttgtttgggtttgataaatagacttcaaacggtatcatgtaaatagccgatagaacaacatttagagcaagaaaaatataatgtaccagctaatactctagtacaaacttatataggcaaatcaatctatataaaaatatcaaactgtgatcggttaatagtttagatagcacagccgataccgatttaccttgatataactatatagagtgatctatctatataagtgataaattacataaaacttggtaaagaagcatgtatattaggtaggatcggctgaaactccaatactatccttaattataattgtttctaggttagtttctagggttcgataaaagactagggatgatgcatcgcaaagtagataaaaaaaactagagtctaaacaatcaagtaaatatttacttttcaggatggtagatgtcttaactaatataatctaataggaatatttagccgataccggcaagaaccctaaagcgagaaccacccgatagagataaatctagatactaagactagattagctaagacatatgatagaagatgatcatgataaaaggattaaaacatctaaagggacataatagccccaatagcacaagccattgagacgtgttacctcttgcgaagcaaagtcgtcgaaaagtaaaaacaaaaagggtggcaatgtgccgaagttgtattagattatctcctatattacatagctatggggttcatatttataccccgagtacaaacttagtccattatggacacgactcaaattttctaaagataaaatacaaacaagaccatatacagtggtctcttaccaaaactaatcacaaccgacttaaactaacctaactaatagatacaattgccttatttaagctctatctctaattggcaatgactgttacctcaatctaggccctgctgagcccaagttatatctatcgtctacttgccatatcggccaagttaagcctttgttctttttccagccgatacgacactcagccgatgtgcagcctgacttggagatcaactcgattccacaccaaatccgtctcgatctttcttcttcctctccaaatcttatgcaaaattctgtcgttaacagttacccttttttttaacatacgcatggatcatatctctccttatcttgccgctgccctttctgacgacactggctcctgctgccactagagaatctcttaccagccacagtggtattgacgaaatatttcgcctctaatgtggaaaaacggaagacttagctgatcctctgcacgaccgtatcatcaatctgcatgttaatatcctaggcgaccctcatgttaggactttcttctttcaaccatgtccctttttttaatttgatccgacaatttcgctaggggaaaaacttatttttgttgtgatgaataatggtttggcagttgatttgatccatgatgagtagtccttgcttctcgtttcgacggcttgtggaggaatcatctccgacaacgacgatgaattttttttggccgcaacgcaaattgtgcatagctattggcactctgtcaatgcaccaaaacatggcggttctatcatgggtcatgaatcgattgatcgcaacagagaagcacacacttgagaggataatcctacctacggtccagttttattcaagcgcggaattgtattaagccaattttttttgatttatcttagctatatgctatgtctctcattagttatacttggtaggaatagaatgaaccgacctctatttctctgcacaatgaatgcaataaaggatcacgatgactattttgtgcagaagagaaatgcagctggtatactagtttaggcaaaaaaaaatgtcaactataccaatacaaaaataaaatctcggtaaagtataggaaactagcatgtaccatttgtctagttgaataaaatatagtttcagtacaattcattaataaaactttagggtgtagattaagaacaaatgattttatcattacttctttttagcacctacctagatcatcacagcaacacttgcactgcatcattcaacaagaaatgactactgtgcatgatgcactacctatatatatatgagtcaacctcaattgaactcaaagggagttagatccatggagagaaagagaaaagaaatgatctattactctgaaattacctaaaaattcagtagcagcacacgtcatcgaggtggccgaagaggcagagactaccgatgatgccaatgaagtggatgatgatggccccgacggcgacttggatgggcgggcaacggtgtcctagatcgacggacggtggcaccctagatggagggtcggcaacgccctagatggacagtcgatggcaacctggttagaggtcggtggcgctatggatgtcgggccgacagtgacctagatggagctgacaacggagctggtgcgaggaggggaaggtgacgtggctcctctcgacctagcgggcgacgaacgaaagagggcgatttgtttcggggaaatagctgtcgcggttggggaaagcatggggagggaaagaaaaattggcgcgaccacacacgatttctgcgattgggagcgcgtcaagttgcccaacatctagttatgattggtgctggttttgggtgtgcgtaaattttaggagccatgtttagagcatcaccaacagttcccccatactcttcccaatatcaaaatttcggtcttttgtgtaaaatttgacctccaacaggatccctactcttcctcccaaaaattgacattcccttctccgcatatctcgttctccacaaatcgggcatccctctccctcccaatttcctccaccgtcgcgatttggtgcgcgctaggggaatcctgcccgtcagaaggtcctcggcgaggtcgtccaccaccgcattgacctgtccagcagccgcaggtgaccccaactccctcgccaacgaccggaaacgtgatgctattcccaagcagccggtggctccatcttccacgcagctggctagacattcgccggtcccgtccatcgccgtaggtgaccccaactcccgcctgctttccatgtcggcttggcacctccctgtcccgtccatcgccgttgtttagagaactgctggcggcggcagcagcggactctcggagtagcctaggagtcggttcccatcgaccacacctaggggcgatctgttgtagctgggtctactgatcgatgttgctgtgctggtgctaatgttgatctgctggcctgccgctgctgcttgttgcttctgctactgtgttgaactgatgctgatcctagaagtagccattgctcgtaatggctggctggctgctgcttactggttatgttggtttgcttgctgctttattggactgagataattttctactaaaatgttgttggtgtgatcgcattgaaatacggatgttgtactaatctaatggttgatgttgtactgagatgttttcttacaagtacaaatttagatggtagtttacaaacattgcaggacaaaatatgtagaagtacagtcgtggcgggggagagcaacgttgtgggatgggaggtgaatgcaatcgtgctgacagcaagtgtcgaggctgatcatgatcactgcgggaggaggaaggaaacatatttctgattgtagttttatagggtctacttttcagtcttagagaattaattataggtcatctcttggagagatgattattttcacaccttaaatttcttttaggattctgaaaaaccaaattttgggatgctgttggtgatgctcttataagtctattggaggcctggttttgatcaaattctcaaaatttatgtttttaggaacctattttggagatgctaccttctgcagccaacagatacgtagacgcagtcgttccggtgtgaccaagccgtaacggtaacattatgcgtccgcctttggtccggtgtgacactgtgaccccgccgtaaccccgtaacggtaatattatgcgaccgccaggtggggggccaaaggtcgttccggtgcgacccaaacccggtggagagtcccacacgccaaagccgcagcagcagccgcaacttgcggcggttccaacttccaagcaagcaaagcaacccaccccct

SEQ ID NO: 79163 - DNA, 7434 bp, Oryza sativa
aatagttaaatgctttttttcttagaatttatgtgatttattatagcgtcacgtggcagcttaaaagcgtttatagagatgctatgtggcggcttagaaccgtttatagagatgctatgcggtggattagtaccgtttatacgaagtttattggactttcagtatataattgatagatagatgggtagattgtcaggaataaaaagaattaacctgagcataaaaccaacatatattttttaaaagttaatacatgcaaggatgcacgcatgcatgtaactctccatgaagaggacatcgataaatgtaaccatagaagtctatatttaattggtgatatagatcaaatgcttttaatattttattatatatgctttagctctcaacaacttacgaaaaaaaagaacagatgctgcatatacatgcttgagcagtgagcagattttaccggattggacgttttatatgttagctgttaatttttcttttcaatctgtaatttttctgattttttatgttttttatttcgatcttctttcagatggatagtacttacgtattttctctcgtatagaaatgtatattagaagtgagagattatattttaatggatctaataataatctaatggtccaaaataacgaatccagagtttaagtattagatgttttacctttttcttagaattctctaattttttatcgcatcacatgacgatgtatgagcgttcgtagaaagccacataatggcttaagagtgtttgtaggaaatttaatggacttttagtaccggctaggagggaagggtgaaggagatttattttttatctaatggttaatattatcgggtccaccattttaaatgaaaactgatggttatatattttttttcagaatttttctctaatttattagaataccatgtgatggataagttttttattttttcgtatagtagatctaatttatttatgcatgttttgtgaaatgatacattatcatgtttttctattttatataataattttaatagcatggatatgataaaaactaaatatttcttacaagttaaattacagattatattgccttttgaatcgttaatggaccacaatggatagaataatacggaagaataaaaagttttatgtgtaattaaaaattaaccacattttttataaattatggttattttaaatttattaattttttaatattttaataactaaagaaaaagaagaagggggagagcaggaggggagggaggaggcatgtaagtaccttacgtacgtcgtacggtacacattggaaggtgtgggccgggcaggaaagatagggaggtgggttatgttttttttgttaagatagatttgataaattaaatagtaagaaataatgggtccaccaatttattagattgccacgtgacgatctaggagcgtttgtaggtgtgggccgggcaggaaagatagggaggtgggttatgttttttttggtaagatagatttgataaattaaatagtaagaaataatgggtccaccaatttattagattgccacgtgacgatttaggagcgtttgtaggaatcccatgtggcgtcttgagagcgtttgtaggaagtttaatggacttttagtatataatagatagatagatagatatgtctactttgtactaaggtaatttttacctttgtgtcacttcggataacccaaacttttatatatatccacatctagcttagactaagtcaaaatctaacctgcataattaattttaggggttcatcagtcggcgtaatattatgatctacatataacttttatgagttttatgagttaaagccttttggccttgaagcatgtaactaactaaaatttactccctctgtctaaaagtataggggattttgccccctagctatgcccacaaatataggcctggtttagttcctaactttttcaaacttccaactttttcattacatcaaaactttcctacatacataaactttcaacttttttcttcaaactttcaattttagtcaaacttttaattttggcgtggaactaaacacacccatagtggatttgtctcctcccaaagcaatcaggactgccagccacccatcaatcaattgctgaaaaggtctgatattactactactacttcattcttcctccgtccaaaaaaaccaacttagtactggatgtgacacatcctagtgctacatacatttgttcagattcgttttactagaatatgtcacatccagtaaatttcttttttttttttgacggagggagtaccatccatgccaaaaacttaaaaaattacaaagaatgtacttgaaagtactacttaccagtactactttgtttattgtgccaaagatgctttttcaaacttcatagttgtactgcttactctttcttaatttatgctattttaggcaataataccttatatacctggacggagggagtaatatatattgttgttacttgtagagacttcgatcaaagatcaatgacaaagctgttaacaaattgtataatgtgctctctctctctctctctgtgtatttcactggttttattgaatatatttgctgccgttagttggggtaaattagagatgacaatgggccccgaaacccggaacccgacgggtaattactctattaggggctgtttgtggttcagtttttgtccccatgggtctcttagcgggcaaaagtgtcacccgtcgggtggagcgggtgcaggtccgttatcttgcccccgtacccgttaacccatggggctgatatgcagttcttgtttaataggtggcccatcagaatttcgtttcacatgcattgtttggcccaaggcccatgcggagaagagctctccagtaaaaatcaacgcaaccctaatctcattcctaagtcctgaccagccgcctcccttcctcgtttctcctctttcctctctcatctcgctgtagtccacacgcggacatgccgccgccgcctctgcactgcgccgcctgcctgcctgccgcgaccccattttgtccgccatccgtgctgcacctgcgcctcgatgccagccaatagatcgacgaccggcggccccaggcgcactgcgtgctcgaccacgccgcttcctcttgttctgcgctgctcggcttgctgtcgtggttgttgctgttgtgtgtggagacccggtgggtgccccgtacccgttgcggggacggggacggggacgggggaaatctacactcgtgtgcggggatggggagggtggcgttcgattttttctgctgcgggggtgggtacggggtggtcgcacccgacgggcgcagccccgttgccatccctaaccatgagcgatggccacatcgtccaggtgcgctacggtgacacaggtgcgggattggggaggaggagcgggtggtcgtggcggagccaccctggatgcagcgaggtggcacctgctcatgttgtacaccgacctagcaccatggttcaagtacgccaccgtgtgcgcccacgagctcagctcctggtgccacctctctcactcgcctcgacgggacaggtgcatccattgtcgccacagacgacgccgacgatgcgagagaagaggaagggagagaagatggcaaagagagagggtaaccgactcactgacatgtgagttccacaatatttctgaattttgtcagcaccacgttagcagaaaccgtcatccaaatcgacttgggaagggtgtgtcatatctagttctacggtgcaagatgaattttagactcaacaattgagggacctaagtgaacttattcctttccactgcagttgctaacttgctatcatgtatagttagttgaactagctagcactgttgcgccacgggtgcctttgcggtactaggctgcgaatggatttacgggcctgttcactttgatgcgaaaaaaaccttaccaaattttggtaaagttaccaaaaaaaaatagctatatttagtttgctgccaaattttggtaattatataaaaaatcctaccaaaattttggtatcaaagtgaacaagctctacattatttccgtatagttgggccacgcagaaaaggaccgacgagcttggtgataattaactatatacacgaatgactcacgatgaaaactgagcaagacttgtacaacgccgcatacagacgccacgccacaagaagctcctatgatatcatttttcctctcatgtgggttgatatatgagcctctcccacgaactgaggctcatatatcagtcacttgaagttatagttaagtcagagggtaataagttagaggatcctggttcctacggacgcaacatatcccatctgtttttccatcgccaattaaccatgtggtactcgtatcgatacaagtccattctgaaaactgtggcatgggactcaacaaatcaaagctcagtagaaaccggtaccctcccaagaatagactttgtagcaaacattcaactgtatcatatacatcttttctttttcgttagtaacttgcaactaaaactgcggttacctgtagtatgcatgattgaacaagtcagtccacctgctaactcaagaggattcttctcatcacatcgcatcaaagagcgaaaagtcctgaaaatgatcaaagtaaatgtcgacagcacattttctgaaagaccggtcacaggtattgcgtgaaaacaaaccttattaggattagtgctgaaagcagcactagtgaggtcaagttggggtcaaatgtatgaattgtcagcgccttagcgtcgtctttttctggaagagtgagtatccaacaagagcagacagtaatatagtccataaaacctgcagaacacaaggggttttaactgatgaaccatgatatgcaatatttaattgtttaatcgaacataatgccaacgcatgcaaactgaattaaatcttaaggcagttgagaaagaatatgggtcttgaacagcatctgaaaataaagagaaattaccatattaattgtattccatctctcaagcctccttaacctagattgcacatcatcaagcacactatctgtagaagaaacttctcttgtaggtgaagataaatctgaattgaagctacctccctgcaccacagaattattcaatatatgagaataaagttaagaaagaacaatagctaattagccatagaatctgatcatacaaacacatctgctattacagttccgtcgaggaaaatctcgaataagtatactacaagttgtaaactaaacaaaaaaaaaccggaaaggttaacttagaatcctcaaatcaaaactagcgcatgacatgcagtcacacagctgatggaatcatttacagcatacattaaatgattaaaagtaacataactttttgatataggaaggtgcaggtcatagcatacatgcacatattcatacatatagctgatggagacatttacaacatccaataaaagtaacattgaattcataaaattaagtgtataagatgtggagaggaagatactaccactgacactaacttcttttaaaggaccaatagacattttttttagatgaaaatagctacagttaaacatgatcgcagcctttggtaaatcatctgttaactgtctgatgtttggtaaataatgtatggataagcatgctacatggacttgaaccaatcaagcaaccatgctcaatgggctattttaaaccaccgaccaggtgaccacactacgaaacataaccgcgtccaacacaaaaggcaatttggtagtatgttctcccacaaacagttgtaaagaacaaatacttatgttctgactaccctaaatcatagccataaaaaatatcccataatgtaacagtagtatttacaactagttggtttgaattaacatacttgtgactggataaactcaacaagttcttgtagcctagcagcttgttggttatgaataccagtatgaacattttcatccgctggcaaactctccagaataatttgaagatagctctgcagagcagaataaaatcatgaaactgatatgcaataatgtgtgtgcaaattaatcaatttaactagctaggattttctaggagacctttgtcgtgtatgaatcatctaagctgagtgcagatgcagcagaggaaactatttccttgttcgttcctttaatctgaagatacggatttgtctcaccttgtagactatcaacctctataagaatcttcaatcaagtaaacaaacgttttagaagttagtggttccagaaccaatgacaattgcaaaaacaggaaatccgctggcatcatcataatgttaactaacttctgtaaaaatattacaattatgaaatgagaaatatggggaaaaagtaggcattatcataaagcagcttcaaatcagaaaaatattagctgttcaaattctgtgcaactgggaacaacaatgtcctgatctgactcctaatcccagtaagtatgagaacactcaacaatgtcctaatcccaacaagtatgagaacactcaaaaaaaagtggtgaaaattattccaatgcaaataaatattattccatcgacccaaacatacataataaatttattcatatacaagagtgtcactattcctaaagcataccagaactttcattgaataaactttttctttcaacaattcaacagatatgaatactactacctccgttttttaatatatgatgccgttgactttttgactaacgtttgatcattcgttttgttcaatttttttgtgcaaatattaaaaatttaagtcatgcttaaagaacatttaacgataaatcaagtcacaataaaataaataataattacatacatttttttgaataagatgaatagttaaatgtatcttaaaaagtcaacggtgtcatatttaaaaacagagggactatagttttctgcatagatatcaatacaggtagagtacaggttgaggcacaactgttaaccaaaacaattttaatttacaaatacttcaaaccgcatcattttatactatatatagtgagtcaacaacagtaacttaaactccattcatttgactgtttcacaatataaatcagaaccaaccatacacacagaggaagcactcaaaaatttctgaaggaatatttggtaggtactatgtctaaaatttcataaaaatgcatcaaactaggtgaaattttccatgatttctatatatcaatatctttgaggaaaatattagccagcagcccaggcccagcacttgctgacaaatttttggccatatcagcccaaacatcagaaagttagacaaagagtgtctccaaagatacattatttaaactacgccagcagcgcaaagattgtatcctgcctttttgagttaaccggaggag

SEQ ID NO: 79164 - DNA, 4075 bp, Oryza sativa
cagaagtatcataggtggggttccgtaccgagcaaaccggcgatctaaccgatcatgggattacacggttcgctactttgatctaaacaaaacccaaattgatctatggggtcgtcctctaaccctaagacctgcccctaacggactcaacttgatacacaacccattgggcccaaataagttgacgcaacaccgttggcagaaaaaggtctagtaaaacggcgattgcagcctctccagaacagatttgacatgaggccggatccatttgaaatagacttgataagttttcgatgaagtacttgcacgccaaatcggagttcgtatgaagtcgtggcgatcgtcagaagttggtgctgtcctgcagtccgaatccagcctgcgcgaatcctctcccctctggatcctctccattgttcctgagtaaaacaagagtgcacgtgtctctggggtataaagatgatgaacatggactcaagaatgaactcacctgatagttgacttgacgtgcacgagcacgggtaataggactatgaagttggacttgtggagatgtggatgtaccgagggtgttgatgtcctcatcaaaaacaaagtgactttatctgcttgatctggttgccttcacttcagaatgaggaaagtcaaaccaggcagtttttgtgaaactgacgaacaaagtgatgtcagaaggattatattacattagctgaccgacttgattgacccacataattgttcctagaatgggtgcctcagcaatcccctgcctcaattttcaaattctctctttccacgtgcccatattcctttaaatgtaactgtgtccccttaactactagcagctggaacctactctcataagaccatcagtgttatgtaaccacaatgcatgtctttcattgctatatcagaagcaagtgctaggtagtgaacatcccaacacatgtattggttcttttctttctttgttttttgtacaacaattgaataaagtaagttcctaattttttatattaatccttttgctatttctctccacaatatgagaaaagatatgccaaagtaataaaatattaatatgtaacaaactgctggttcaaacctatgaacggtggtgaactgtgatttgataacctgactgttttaacttttgagtactggagatattttttatagattttgcaagcttcattaattttggctgttgatttgtatctgattctagtcctataaaatgtcatcagttatattatttgatgagccacatgataattatattctttaataatacaagcacatgtagagtgttcagatgaattactccatcacaatatatagctacttctagtgctcaaatcttgtcgtcgcaaccaattacaacctcctcattcaatttctccacctaccttctccatctcaaccaatcacaacaatctcgtgtttcacctgtcttcttaatctcagtgaattttttttctagaagtgcttatattttgggaacggagggagtattaaataagctgacaagtcactacatgtctttgtgtcatcagtgctacctgtggaaaagtgcaaacatggcggaaaacttatctatttgtcatgacagttcaaattctggagttaattcttcgtttagcagcacttgcaaaattgttactcaacaaagctgtgaaacatgtggttccataagaagagcagaatccaaagatccaagtgaaggatgtaattgtccaaaatttccttctgatggtagatcaggagagtgttgcaactgctatacccacaacaccaggaaaagaaaaaggttatacagttggcagcgccgcagcaaaaagaaacaggtctgttctgtggatgagtcttcagcagaatggagtaaattaaatggcagtaatttcaatatgtctaatggtccatcggagaacctggctggaaaaatgaatgatcaagcacaatctgtcgagctcacagtagataatacttctttggcaaggagcaatgatgacagttcttcagaaatcaaagtaattaatgctactatcttgtcatcagaaaaatcaccttgttcagtgttcgacataaggggttcccagggtttatcttgtcattacagcctgtcagaagtccagtaccaatctacatgtccccaagttgggccctccagttacttacatctgaatgtcagcttcccagccttctattcttttttttacctcttgcttttaagcttgcatttcattcataatggacaaatatccatttatttaatatttttgtacttctgtagttagtttatttttttatcaatttaatttctttgagaacacaattccgtttagttattttgagaaaacatcttttaccgtttagaaaaactgttatttactgaaaatgtgccagaatcaatagtttggatgtataaatagtcaatgtatgggttggtgtacatatattttttaaaatatactccaacagtagtcctgtaaaccatacaactggaaatgtcatattctgtcttgaggataccattttaggactctaatcaagtcaacgtcttgaacaatatgcttgcattacttgttccttgatgaacttactgtaataaagccatgctgatgttctctagtaattatagtttctttggtttgtattgtttttagaaaaaaaattccttggcattgatctgatgcactattctcttttaggatactgttgtttattgggtatgaacttaaaactggaccctttgctggccctggcatgtgggtagaaattttcactcctttagtgtatatccacaaatcattcattcactttttcttgcacatataatgtttctcataatatgtttttcaatctattcttcctccagagtattcttgaaattcaaaagcacatttctgttgaatattttactgcacactatcatggaactttttaaatgttctagtcgtttcatctttatattttttcttgcagagttgttccatctgcttcaattgtataatatcaaatgcatccaaacatttatcattagattccttgatatcaagaaatggtattttctataacagaaggacaacctatagtgtcttccattgcaaacgtatccttttgctgcttcatgtaccctcaaaatctgtaacaagatttgcgaatgcaaagaagtgttacttgtcataatgatggggaaaaattgagtgaaacctgtgcatgagtgcttattttgtctttcctgttggggcctaaggtgaataggtgatgaggtgtttggagttctggaggaaaccagaagcagtttgtctaggaaagggaggattgtacgatgaggtgatgaggtgtatggagttctggaggaaaccagaaacagtttttgtctaggaaagggaggaaaccagaaacagtttttgtctaggaaagggaggaaaccaaatctataatgttttcttgcttgtttctgttacactagctaatgcgctttttaatagggatttaaatagtactagatctcctacattgcaattcgaatatggaatcttctgttgtgttactcagtagcttgttgctagatgtagattgcaatactgatttcctgtaattttggtagcaaaggacacatttggccatcatctttagataattttgtagtcccattcaattagctttaattaatgcaaagagttcttttcttttctttaacattccgtgtcattgtactgttctaaaattttactatttttatgtaggctaggacatttgattttattacaagtagttctatcaattcagtttttgaacaaagttcaatgggaaaaaaaatagaggattatgcaattggtccattaccactgttggattaacatctcctatgtatggagcgatctttacatggcatgttatagtcacatatcagatcccatgatgtgttgaaatctagcattgcctatgattacagtatgttgtctgagtgttccttaatccttactgctgttagacatattaagcaaaaggaaaaggccagatgctctatctcttgtaaagcacatatttggaatcaatagttgctgtg

SEQ ID NO: 79165 - DNA, 1182 bp, Oryza sativa
acaccattttttgccttccattgcaagaactccagagtggtatccaactttttgtgcccctgctcgcaacctgggtacaacgacgttctgtggtcctctaacatcttgtccaatttatgggcccccttttcactttcgcagtcctccttggcgtcctgcaacatctgaccaagatcatctgcaacgtcgttaccatcagcatccctttcctcctcgcccgtttgatttccttcaaatccagcgtactgaccaaagtccggaatattgtcgtcttccacttcatcttcttccatttcaaccccttactctccgtgggatgtccaacagttatagcttagcatgaaccccgactcaaacaagtggaaatgaatagtcctagatgcagaatactccttctgattcttacacttattgcatggacaacaaataaaacccttatgcctgttagcttcggccactctcaaaaaataatgcacgccgtcaataaactctttggaccaccggtcagcgtacatccattgccgatccatctacatgagatggaaaaaatcgtacacaaataattattcgtacaataatgacagtcatacaataattataaaataataacaaactctttcaacagtcatacaataatgacatatcattattcatacaaaaattataaaatattacaccaaataattcttatttactatttctaaagtttaaactaatattaatgtgttgtacttcttttaattttcattttagcttgttttctattatttaagattaactttcactatattttccttctcaactattttataaaaccttctttagcaaataaactaaatttctatatattctttcttccccacacaaattttctctctcatcaacttacaactaaattttagagacaaaaaattgtgcaaaacatagctccaaatgtaatatgacaaaaaaaacattggaggatgaagttgctaaccttttagccacctccgatttgtatataatcaccaaaataaattcactagaaattttggtatgacctcccatcttttttgaagaaattttgaagcttgctcgggcagctggaggaggaagaagacatatatatatatatatatatatatatatatatatatatatatatatatatatatatatatatatatatatatatatatatat

SEQ ID NO: 79166 - DNA, 5105 bp, Oryza sativa
ttgcaaccgggactattgtggaattcggccgaccgatgaaagatggtttctccaccagtgggacctcaaagaatctcgctgttaagttgagggacctccggtgaacttattcctaaattaaacgaaatgccatctaattaatgggccagtctgaatctacagtgtgtgtcaccgtttgcctggtccttcaggactctcttcctagcccatgcacgcccatctatggcccgcacagggtaaaatttttatatattcttaccgatttaaaagtaagtgctaaaaataaagtacaatgaaaaagaaaaccaaaattaagtctgcaactaagttttaaaatttaaattttggctacagaaatgtccattattgaaccttcttcttgtatcttcatcaaactatgttcatcaggaaacaagagttaacctgttgttcataatctcctgtgagcagagacatgttttttttattactctgaataatcatttaggtttttcctaggactgaataattatttaagtagagacactactacaaatatttgcagtgtggtgtcactactacaacagtagtactccatccgttccaaaataaatcaacctgctatccaaattcattatattcatattctattttagattggtttgtttttaagattgagggagttggtaggaacacagcatcaacggcagaagaaatgttgacagagacatgcacatcgcataaacgatttatagtttactagtcttagctaatcttgatttgtcttaggagatattgatatcaaattatgcgtttgatctctgactactctgtcttgctttttcctctggcagcactatgagctggacacattggctaccgagaaagcaacagcaacagacggctacatgctaacaccgaaatatttgtcagcattctgaaagtactgtccttttggtttaattaggagataaggtcaaggtgatggacattttatggggaagattaggtgctaacttgttgcaatttgcaacgatttttcaatggccttttagcaaaggagaactgttgtttctgagaataaccgtgttctcacaaaggcaaaacttgatttctcgctcgtttcacttttcattctgactgaataaaaaaatgagagtattattccagttctaatttgaatgttaggattaagggtaggtgaatccgacgtgatacgggcaacggttgaggcgaccaaccatttaatattttcgggccaggggtgtgatgtaagagatgagatcaatcaaccttgagaaaatagatttgcggtttttgttggaaaagcaaaacaaacttcacaggaaataaacttattcaggtaaaatttctatattctaagtgatctgtatatagctccgcgtgggcaaattctgtaccaaattttgttaggcaagccttttgcgtatttaaaaaaaaatggtatatgtagctcacctgaataagaagagaggaaatttagtgagaaaagaagtcttaaatcctcaatctaattgttccctccgtcccaaaaaaaaaaagacaaaccgtgagttcccgtgccaacgtttgattgttcgtcttaatataaaatttttttataattagtattttcattgttgttagatgataaaacatgattaatactttatgcgtgacttatctttttaatttttttcataatttttttaaataagacggacggtcaaacattggacacggaaaccagggtttgtcttttttttgggacggaggaagtatctaccaagagtgatagacacgactggttccggcttagctccttaaggtggtgggctagatgacctgggttcgaagcctcacaccttctaattatttgatattagatccttccatattattcgtgccttttattattttaaataatactagagaaaatatcatgcgttgcaacgggcgaagttgattttaatcttattattgttatatgatttagttaagataaaatttactgtatgagttcactcggatatattagtgcctgataagtacaaatcccatctccatggtttcccggaatcggatcctctgctcagcattgaagaagaaaacaagatgctacagccgctcctagaaaagtgaagctaaacggtgcttttgttggaacagtaaaacggtcacacagtacaaacagtgacatgtactcctgttgttttatatagccatggaacgagagatcctttgtgattgggaaaatacatactggcagtatactgcatacttcatatgtgtacttaacaactgtcgttatattcacaaatgaacatctgagattcacctatgttttttactccagatttaacagtgagtagtttgtttactcatagatttatatgtaactaatccttttactcagaagacatggatatatatgagacgtctgagacgtctatttatatattcgatgaatttttaggtttgctgtacatagtttttctctattgagtatgtagtatgggtgaaaacagaacgaacatttcctgaccgtccgctcgacggaaagctcgtgggaaggatacgagagagaaaatgagatatctggtaatattctaattcgagtctaaatccgaatccaaacctgcaaacaaatatgggttaggataagcgaagagttgtatctacccgtatatccaatttgatcaaacatgtatgaaaatttattatgaatatgatgaaagattggttcatatttttttacgagctcaccaaaaaatattacttaattttttcttgactatctttttaagactaattgcctcactagatttaaaatctatgaattagaaatataaaattgataggatacgggataagtgatttattatctgataccatctgtgtcggttacagtttaaatggaaaatatggttatgatataggaattttgtgattcgaccataatttcacccatactcttaagtgcaatactactcctttgtcccataaaaacaaatctaatataggatgtggaacattccctatccagattcatagtactagaatgtgtcgtatctcgtaccagtagtctataaacatctagatagtagaatgtttagaataagtactatcaacctaaacatatctcatgtgacttctattgcatgtgtacggttctaatagattgacgtgcaatctttttgcgtcttcgcaggaaaaaaaatgtgtactgaggagttgttgtgtcattagcatcaaaaaatgtgtactgaggagttgttgtgtcattagcatcatcagctcaagtcagtagtactcccttccgtccaaaaaaggcaaaccctgggttttcgtatccaacgtttgatcatctgtcttatttagaaaaattatgaaaaaaaattaaaaagataagtcacgcataaagtattaatcatgttttatcatctaacaacaataaaaatactaattataaaaaaattcatataagacggacagttaaactttagacacggaaacttagggacatttcacacagatgcagaggatccaatgccccagtcaatttccccacgtgccatctcgctgcatccgccgccgtgcttgcgcttgcgattgcagagttgccattgccatcgcattcagttgcgttgatccgatggcgcagtagcaaaaccgagtctcctctcctccctccctccctcccttccctttgccatcaaacgcaagccgggagaagcaccaccacctagatagaacaataaaaattgctgcatccgtcagagctggccactacaaaaaccagctgcatcacaggagagagcaggcagagaggcagctctccagctcgcgtttggggttgaccagttactccggcgaaccgacggcaagccggcgccggcggcgagggtcgtcgggagcggaagagagggagaaagaatggccaccaccgcctccgtccgacctcccctgctccgacaaggtggatccctgcatctcatcgtgccctcttgtgctattgggtttatagtactttcttggattctttagattgggttgatttgattgatggcccaacatagatatcgtcttggaggagatgggagcaacgggtgtgttgtgttttgctgctgttcttggattggattggattggtttatgtttcttgttactcctgtagagcaacccaagaactcaacccattactttatttattttacacttgtgtttctgtgcacttggatctcaaggaatttattatgttatcagttgttagttgtgatcctgttctgtctgctatccggcccaaacccatcaacagtagtatgacctcctagcataaaattaaattaaattaatcagtagcattctctccttagagaaaaacaaagtgggataaagtaaactaaccagtagaataccccagttgggcacttctgattgattttcattccttctaaatgtgcaatagttgattacagatgaacataatagatgatgatgatgttggtacagattatgtaagttcagtattttctctcccttctaaccgtcctgcagaattgggaatcttaaaccaaattgcagtactgtgggggcaaggcaaaacataaatgtttcagttaggagtagacatcatcttggtagtacatgtccaaattaaatattaatcagtgtaccacactcctagcactcagtttctatgcaacaatttcaacactttgagatatcagatatgtggctgaaaaatgcttatctagatcttatggaaattaatagtagtatatctttttttttcgggcctgttcactttgatgccaaaaaaaccttatcaaattttggcattgctaaaattttagtatagttgtcaaaattttggcaggattttttatatagttattaaaatttggcagcaaattaaatgtagccacttttttagcaaccttactaaaagtaaggttgaaaatggcatcaaagtgaacaggccttcaatctaatttctgaattctggagctgcaaatctgcacacacactaacctgatgaacactactacctgtattgcagcagcaggttcagaaaaagcctcactcctttgcaaaccaaagcagagagcttctgtcagaagaag

SEQ ID NO: 79167 - DNA, 3026 bp, Oryza sativa
  unsure (1)..(3026): unsure at all n locations
tattggctacttcatgagctatgttcagcgataaccactcatgcaattgctcatcactactaatctcaacccatgcatcatcacaaacacgccagaaagtaatgtattgtttagaaccccacacaattttagagccgatgaaatcaactaactgcagcaatttgaagctagctatgtccacatctgttgtaaaatgcctacttgtgaaataggtctttggccccccatctggcaaactgaaatgtgaccttactctaacatcaagaatcaaattacatggaacaggcctacaaataggagcaacacaagataaagaacaactttcagtaaaatttttaggtgcttgtaggaatggagacaacatacaacatataaaccctaggttagattagcaatggagacaccaagttcaattagagtaagacacaacatctaaaccctaaattagcactggacacaacatctataccctaaatttgcatggtattgcatatgttcctataacctagcagggtcacaaccacaagcatgcacggggtcacaggatcacaaccacagggtcactggaagagaatagagagaaaatacctttgtatggtaggaatcccttgcatggttgagggagcgtcgatgtcggctacctccgagctggtaggaatcccttccatggttgagggagcgtcgatgtcgcctacctccgagtgctggccctcccaccgtcaccgcgtgtagcacccgccgccgccccgcgtcccacagctcgctgtcgccgcccccacagcaaagccgtcgccgccccacagcaaagccgtcgccgcgccccacagcttgccgtagatcggcgccggcccgctccacatcaaactgccgccgccgccgcccccacagcgcgccgtcaccgtcccctcagatcggcgccgcnccgcgccccatcaaaccgcagccgccgccgcctcctcagttngccgccgcctcaccgcacagatcggcgccgccgcccccctcagatcggcgccgacccggaccggacgcgccgccgccctccaccacaacgagcgggcgccgccgccgccgcccctttcagccgccgtcgccgcatgcgtactcgctgccgccaccgcacacacgagtgagagagaggtgagaccgtgaggaatgcacgagtgagagagagaaagagagagtagaatagggtttgggatttggagggtattttcgccattaggaactctggaaagattttcttttttttttaaattgaaccctaacggagtcagtgaaagagggttagacggaagttttgtactcaaaaaggagggtcaaataagcaaagttcaaaatgtagggccaaatcggcaattacaatttaaaatggggtcaaataaacaattgcccaaaaaaaacgccatactacaacaaacatgtgttcacatattcaaaacaatggaatcatctccactgttgttttcaactggttttactgtttccaattgtgagttggacagttcgttctggatctgcatagtcagaaaatctcgttagtgaaacggcaacgcgcaatcaataactatcctgcttaggtatgagcttccaagtcccgaatccttttgtctcaagtctgccttggtaatgtgaccaagatccaaattcgaattggttcctggtcctgtttggacatagaatcgagtccttgtgaatgggcaattggatttggatagaagggtacattcttttattttagatagaagaaaagtttcttctatctaaaataaaagaattttgctgcttcattagttacatatcctgttcctgaaagaactccagaaggtgaagatccagcaggaggtggtagccattcttattgagaaagataaagaannnnnnnnnnnnnnnnnnnnnnnnnnnnnnnnnnnnnnnnnnnnnnnnnnnnnnnnnnnnnnnnnttcgattccacctcagaacgaaagaaaatgcaagtgaaagagaattataggacaagagctgatggatgatagaacaaaagagccattcaagttgtttggatgcacatacttttttcaatcctctctgattgactttatcagaagattcctatggtctggtttaccttaattacaattcccagtcaattcagttgatacaaatcaggatctagcgcgggccagtttggaatttctaccaccatttccacccgttgaacgttaaaaaaaaaagaggtaactacagcctacaagtatattgcaaaatccttctacttttgcacttgacgaaaatttgatcaactccttgtgaaaattatactttatttcaagtaggtatggtaatggccagatcgggcatggatggagagcaggaacacacctgaaaacactagtgaatagaaaccaatacctatacccatattcaattcataccgggcgggcatgggtaacctagtaggttgagcaacatatgaataataatcaacggtcttcaacatagcaaaggaaattttacaacagtgggagaggtggagactatgatcggggaattgagtgtctttctctctatagggtttcagctgactataaatatccacctaacatatatatcaggagtattttacaaaacccagggccaggtaggacataggttacccatgaacgaaatacaaaacctggctaagcccgctagggtctcggcctcttgggtcggacatacccatgaacaaaagatttaacccacagtaccgggcatggcgcccacccacagggccacagggccacagggccgggccagaaagcggaatcgtcccaccaacaagagactacgtaagcggtgcaccgaaggcgtatttccgggcgacgtcgaaggcggaaagacgtcagcgcgggcggcgtgaaaaggggtagaccaagtgggcgcaggccgcaagtcgactgaccccgccgggcccaacctaaccaaactcgagacggggacgccacgccttccttccacgcggtcgcgacccatggaggaggagatcgcccgcgacgacctctttc

SEQ ID NO: 79168 - DNA, 58754 bp, Oryza sativa
  unsure (1)..(58754): unsure at all n locations
ggggttgcgctgtgtgcaaggacgggatcgcgcagggggagctcgccacgcagctgccgtgcgcgcacttgtaccacggggcgtgcatcgaaccgtggctcgccatccggaactcgtgtccggtgtgccgttacgagctgcccaccgatgaccccgagtacgagaagcggcgggtgaagcggcgttcttctggtgactccgtggcgcaattgggtactcctatgcaaatttgagctaggattgcttggtgatatgtgttggttgcaattccgtggaattgagaaacttcactctctaactgctcattgggatgcttcgagagtgtcatacctctttgatctcaaaactttttagtgcgtagctgtcatgattggtaattgaacggtaagaacaattgctagaatttagaactgctgtaaatacgttgtgctgctccaataatacagaaaattgtttcaatgtttccccagaattgttagccttttttttaacttactgcatgagtaacagccatcataatttgataaaccaaactggaaagtagtcttccttctgtaccagaatactcaaccaagtgttgcttatttgcgttaattaaaaaaaacaattcggaagtgattttaggttcttaagtttcctcttcattaggcttaggctgctatagtgctatttatgataaataccatttataagaagttaccctctctgtccattttaagctaagaatctggataactatctgtccagattcgtagccaaaagttgctatattttgggacaaaagtagtatctacttgttattgtgaataccgtggttttgagattatcacacaacagtgtagcattttaggttcctcaaagcatgccattgctagtaagcagtagctaatagatgactgtgttgcatggtcctccaaaaatggtaaacttcatagttttgttttatcttatatatggtcagtactaactactcacaaataagccatacggtccataaacacatgggaagcaaagtacagctcatatccatttgcagggaacatgctggcaaaacaggtgtttattagctagcatgcaggatgaagaatactataattggcttattggaaacgtggaaaaatggtataaatgccatagtttcggttgtctcgctattaatgttcattgagttaaagattattccatattgtatttgcttatatattagtgtccccttcagtagactgcatagtatgtcttacaaacattcataaccatttatttgccgatacttctgcgtattcacgcagggcaggtctaggaaaacaagacactggagtcactatttactaatgtcacttatggtgcgtttggtttgagggcgaggttggataggacgggatgatacatggttctgttgctggggtgatctgcgttgagtgtttagttgggtggatgggaaaacacagaaaaatgttactcactccatgcttgttttatttgcattgtttcaatgtttggcacagaattgttagccttttcttgttttcgcttactgcatgagtaaaagccatcgtaatttaagaaactacactgaattattgtcttcttctgtactagaatactcaacccagtggtgcttatttgtgttaattaaaaaacaattaggaagtgattatagatgctaaagttttctgtaggttgctatttatgaccaacaccatttataagcagttatttacttgtgactataaatactgtggttttgagattatcacacaacagtatagctttttatttttcttcatacattcagtgttcattagcatgtgtttcttcatacattcaaaaatgttaataatttggaaccatgccattataattttgcaaagtttgagatatgcagtcggtatctcaatgacatgtaggacccacaggagtcaatgacatgtgggtcaggatgacatatctcaaattttgcaaaattataatggcatgtttccaattttccccaataaatatgtgttcattagtatgcgggatgaagttcactgtagcttgcttattgaaaacttggaacattagcatagatgccatagtttccatttctagtcacagttaatgttcattaagcaaaatattctcccatcttttatttgctaatatgttaccccttcggcagactgcatagtattgcttagaaactttcataaccgtttatgtgccataattcgacatattcacatacaacagatctaggagaacaagccactgtagtcaccatttagtaacaacacttaactcatacatatagttgtggacatggatttgggccgaaggtagttggagtcacagggacccccttggaactgtggaatgtggatctaacctgcatatgttatagcacacttgagctagtgtatcatggtgcggtccgtgggtatataattaaagaaaacagatttgtcaggccatggagaacttatctgcaaaatctggttattgatgattgtttctaaaattctgtacgtgctcacatcctttccttggccttgttttgaaattctgtttgagctagatctgaagctgtatcctattttgctggtgatattgcacaagatgagtgaagtttctggcacaagctcattttgcatcgctgtttcagaaatactccttttttttttgcatacctttgatcagattcgcatatattgaaactttgtcctgctatttttcagtgtatgtcaagatttcaaccatttaccctattttatggtcagggtacagaaatcaccacgattgcactgaaatttcaagtcttattaccatataatttctttcactgtagtagcaatacgtcaggggtgtgagcaacagcagtaggcagtggttcatgtctgacagactggcagtagccagtgatttttttactcaatgatcagcttaaatctcttgtttttaatgtctcacagaatggtttccttccttgagtgctccagtcagcaaggattatatttgggatactcttgtagaaatttgctagcgtgtatcttgcattcttgctgtttagaactaggagaacagatgaatcctgatggctgaacaggagaagatgatacaacacctgtttgacacaggttttactgtgcctgttgacttgactctagatgaggctgctgctacctacctgttctgttgttccagacctctcatttttgccttttacacagacatgaagatgatctctgtggtcagaattgcagagaaagagagcttaacagaaggtggtgatcttattttcctggttgagaagaacaggaatgtggtatgctgctatcatcttcatagtagtatatgatagtagaaaagaaggtggtgattttatttttgagaaagacaaaaaaaagaaaaagaaaagaagaggtggccatgactgataaagaagcatctatatacatttatccttgttgggccttcagttcaattgcagctcatgggctcgtggttgtcttgcaaaagcccaaactccaaaggccctgtgataatttgctggtcgccggtgttggtggtgctcggggactcgccgccggtgacactggatcactcactgatgctgctgctgctgcctttcatttctggcaacccaatacaagtagttagctcaagtctttcacaagtaacaaccctgaatcatcaaccactgttcgaccaatttgctggatatttgaggtatttggaacatgttctgttaaatttctatcattgtttttttttggaatttcaattatgatccgatgattttttttcctagcttcatagagattagtggacgaccaaataacaatcctaattaatctcgattaaggcacagtagctatgcacaataaatcaatcacttcctcctaatttaatcacctaatgctaaacacagatactggttttaatcttaatccattggcgccaaaattgcctccgcgccgcagcctcctcccgcttcctcctccgcctcgccgtcgccgccgccgcccgcggcggcgcggaggggcagcctctcccggagcgcgcgtgcctcctcggcgagccgcgcgttctcccgcgccatctgcgcgtgcctcgccggcgcgcgggtcagctccacggcgagccggtggttggcggcgcggagctcggcgacgtgcgacgacagctcgtncagctgncgncgncggcggacccgcgaccggcgcgccgactcgaggttcgacgccagccgcctcttctttctctcgtcgcgcctcgtnacccttccgctccgccgcccttcatcgnccgcgncgtcgtagctggttcccgcgtcgncgacggttgccgcgacgccggccaagaaccgatcgccatggacaccgaccaatccaggctgcggcgaggaggaggaggaggagaagaagaagctcgccgccaagtccaccgcgccgaacgattggtacgccatggctgcgatgtcttgttgcatgatttgattggatgccacaccgctgctgcaattttttttttttggcaatgtggaggagatgattagcaagaactagctaagctctttatataaaactggagggaaaaagattgagacgagtttaattagctcctttaacagcagaaaaaggaggagccctaaaagctgaagccactggcccggttatgctgtaagcaaacttgccttttgcagctcattgcgtctgcatcctatcgagattatcctgttgattctggggatttgccactgtcctcttggttttagttttgtatatatatgcacatgtcatcatcaccagggagaacttatatatgtcgcctgtttcattttcagaaatgttcttgtcttgtggagaattcttctgtcaggaagtaacaacactttcttgttttgttcaggggaatttcaaatctgtaagcatgggttggaccatgtagaaaccatggaagcaaagtctgaaaatgcatttgcttgtggaagttgatttgaaactttgtcaagatctcacctcatcttgctggatttttacaggtatcagcatagcagactgagcacagagaattgtgtattaggtcatttggctaaaccttttcggttcgtttcaaaaaaaaaaaaaccttttcggttgttgtggcaattggcaaagtaatggcagtgctttttaggcctttttgtgtcaagatatgacagctatatgcatatattgtatagcggcgccacaaaggattataagcacaagggcaaatgccagtagtagcccaactgtttggtccactttgaggttttcaggtactgtttggtcaatccctatataagaggtctttgtttgatttgatgtcttttgttcagattcacaaagaactagttcttcctacaaactcaatgcaattatgcaaatgcagtgagtggtgacatttctgaataccctgacatcaccatgcatcttcagatggatacatgatagatgcaatactgcattagtctgaacattggtttctttcaatattgtgtgccattctctggattatggcaaaaaaattatcttcgatttcagacatgagaaacagttcaatggccatcaggattcaaatcctatcgactgactcaggtgcgcacctccttcttcagtgaatgcataataagatattagcttctgtccaatttgttttatatataaatagaactctggacatgacatgacctcttatgcataataagatattatatctaggtctttaggtctactacataggattaattttgatactatataacaagtttttatttgcttacctaccaatgccattagcagcaataattgttccaatttggtttatgctagtacttctaggagacactcaaggcagttgtagtgtccaaagcagaaagtaatcgagtgatgaagaagtttaggacagtttagacatgtttaaagcggaacataccaatcagatggcaataattgcttatggtgactcttgttgaccatcaacttttggaaacatgcaacatgcatgcatatttcttaggcaaactttgcttaatttgctgccgtatgaaacaaatggctcttgcttttgtgctttctggtagaaatgcttcttagcaccagatgttcatgagatgtgctaaattgctctacgcatcaatcacaatgaaagcaacacttacccaagtaaaacttaatttcttgtgatcctgaattcctggtttagttttctattagttgggcacaagatcataactgcagtattgtatttaagattcaacacaggttcaatttgtcacaccctgtaatttggcatctacaatctgaaaatgaatggctaatcaaaaggctctgaggacacaaatggctaatttcttccatctagttgagaaacctttcaattatacaaatggaaaagatatggatgtgatttgtgggctgaaaaccctttatcatcaacaattgttagtgccttcaactttcaatgcacccatgttttcttgttacgtttgcaagatcaaaacaatgttggaaacgtcatctcgccaggtaaagcaatgaatgacgacaattaagaagatttttgctcctgaagactactaatgatggatattaagggtataataacctatccaggattgtgatgtgcaatccccttgtagcatacctgataagtgtggtgagttaaagcagtccatttacaaaaagaaaaaggaaggccatatctagcaaaaaaaaatagactgcatacgtatagtggtttgtgaaaaagttcaagatgcatacaagccgcagttttcttcagatagtgtggcatcttcttacttcaaggaaaaaaacattatgctagtttggaaataacttcaaatttgtccctgtgatggaaattaaaccattggtaagtagtctagcaatatcaaacttaaggtgtgtattgcatatgaattaggaaaaaccatgtcaaaccaactgaaaccaaggaaaatcaaccatactaacatacttaaataccttgaggtgagaaacatataaagcatacagagaacatgattagtaagaatgacgaagataaaatacactaaggtaattagggaaaacagcaaagttcatttggacatttgatatcatggaaagctatagaaaaatgtgtaccttacagaccgaaatggaaagagtccacgataaaaagtcatttttgcaccattttccattgtaatacttatcgagacaaatttatgcgcgcaccttttttcccccatccatccaaataaatttttattggtaaaacttgttgctttatgacagcaggaagtatcttttacaatctaatgtacccatcagtacaatattctagtagtatatctacaacaaaaataaagaccaagggcatgcttggcacatagaattttgtatggaattagttcaagtcatttgttaagcacataaatttggcaaaactctcatcttccaaattaaccttgcaaaatttaaccaagaaaaactatatactatcatccgttccatgtccttcctagagaaactttttatgcaaccatttttttttctcgacagggattattcgtggttactgtgtgcattaatagcattaataacagctagcatgtgagcctgttattaggggtaggcagaaagatctgaaccgaaaagaccgacaccgagaaattcagtcatcaattcggtcctatatagtgaaagaccgaactttgttcggtcaattcggttagtctcctcggttaaccgaatagaccgaaagaccaaattaaaaaaaaaatctaaatgcaacctacaatccaccaagttcaatataattaaactctaattttcacagccctacttcttctaggcatgcaacgtaataagagtctttagtcatacgtgcttatggatttgttttgtgatttttgtgtaaaaatttccattatttctttgcatatatgaaaatgttgctgaatttcggtcagaccgagaccgagaccgaatttgtcggtcatgatattttttgcgttgaaatttggtcttcacttttcgaagatcgagaccgaaaatttcggtcagaccgaatgcccacccctacttgttctctctatacccatatgtcaatgataattattattattatactccctccgttctaaactatgaggcacttcctttttaatgaaaaatcgaactcgataacttttaattaaaaataatactaatatatactaaatattatgcatgttatatcactatatttatattttaaagtactttcatgtaatgctaatttcatattcgttaaaatatagatattataattcaagatggaggagtacaaccaaacagtagaggatccacttcctctttatttatgccaagttattttagaaccatgctccacacaagacacgcacacatgcattgacatgtgctaattttgtttcgtgtggaaaggcatggaggccggttccccacaatgtccaatcgctgccaactctgcgagagagaagggggaggaatggaagcttgtgcatggcctaaacacacactttgacacttgactttgtgttggaatccattgattagccgctcaatgcagcatccccaatgcagaggtctcccctctactcctagctctttgcaaaacccaatgtccaccatttacttcaatttctcagtcttccttgctcatgtctcccttgcccttctctcaacttgggtcaacttcattaaatttctcctttggtatgtgcaaaggctttgaaggtgtaggcctggtgcaaacattgcaaagtcaaaatgtacggtacgatgcatcgagttactgacatggtaaatcttcccgattcccgtgtaaataaactactatttcattcgtttcatttataagatgttttaattttgttatgggtcaaacttgcttaactttgacatagtttattgaaaaaaataggttagaaaacttaaattcaggaaaaaaaaataggtgagatatcctagtataaccatcttggtttggttaagacatgccttagaatagacgagtcggtcgaaacggtcagaatcggtagcatctctttagaaacgacgctcaatcgacctgtaattgaccgtatttatcatttaaactattcattgtcaacattaatacaatgcaaaaagaaattagatttttttttataaatagtcaaaaatggtacgccagtctatcgggaatttatgtgaccgttttcacccctattcaagtgcatgggcacttgagttgtaaaattgacttgatcgagataccaacgtatatacaatttacacatcgaattgccgggaaattggactttgagatcattttagctccccaaggcgatccacacgtactctaccacaaaactttggttgtttttgctatcatctcaaggccactgcagcatgcgcattgcgcacgtacgagatgctactctttccaaggaaccgatgtctctctctctctccagcctccattgcttataaatatgttcctccttcctatactggtaatggcagcaaagcaaagaaacaaagaagaagaagaaagaagaagcagcagcaaaaaagttgatcagttaattagcaagtgtgttcttctttcttttggtgagagagagagagagagagagagagagagagagagagagagagagagagagagagatctcagaatggtgaatccaggaagaacagctagggcactctgcctcctatgccttgctctcctcctgctaggtcaagatacccattccaggaagctcctgttgcaggagaagcacagccatggcgtcggcaacggcacaaccaccacccaggtcagcagattagttcagtatcgtttcttcagcttattaaccgtggccaaatttgaattctataacttaattttagagttgatgtggatgtgttattaatcatagattatttctcaacattgggttttatgccgctaataacacatatgtaaaacctttacaaacaaattatttttcggtcgctaataagcgttacggcttataattttcctagtgaacagtgcatgcattttgcaaacttcttgttggctctggttgcaacttgcaagcacgcatatgcattgagagaagagttcatacacacactgtattatatatatgtacatttgggctataagatactaaaatgaaacaggagcatcgtgttctgaaatggcgtggcgttcttgtttattttcagcttgtgtaattgctggagggcaatagcatgggaaaacactctaatctgaatctgtgacacctggaacagtagcaccattcttgatggcataatacatgtacttaaccacatgtttatcgttggaatcctggtacaatgctccgagctgcatcgatccatccatgcgtgttacctccatgtgttcgaagatgctatatatttgcatacgacaggcacagcttcatgaatgttacttcgcactgtcttaacaaactccctcagtttcatattataagtcatttgattttttttcctagtcaagtatgaccaagcttatagaaaaaattagaaacatctaaaataacaaactagtttcagaaaatctaacattgaatatattttgataatatgtttgttttgggttgaaaatactaatatatttttcaataaacttggtccaacttaactagaaaaaaaatcaaacgacttataatatgaaacggagggagaactttccaaagaacgacattatcttaattttaagacatcgttattgtttttaaaataataataggatcactagtttctattacaatatatttgtaaaacacaataatatgacaatattatagaggtagtactactttttgagatttccatacatccaatctataaattgatcaaagtttctgcttccactctgtttcgttcgttcttgaaagttttcttctaacagtatgatgatcttgatcaatcaggaaccaagcagagagaatggaggaagtacaggttccaataacaatgggcagctgcagtttgattcagccaaatgggaagaattccacacggattatatctacacccaagatgtcaaaaagccataatggctgttcatttatgatttgaactagtactagtagcttataccttctgcgcgtcttttgttcgtttggagaggggattttcttgggatttagcatatgaactaattaaattaaatcccaggcaaatcccactcagcccattttgtgcagaagttgtcagtgttgcactgtataattatttagtcatacacaactactcctggtaactactcctatcttcgatgaattttctggttttgccagacgtgacaatagtccagtagcatgcagtaccctctcagaatccctgtaatttagcaaaaaaaaaaggaagaaaagaaaagaagcttccctactactttctccgtttcacaatgtaagtcattctagcatttcctacattcatattgatgttaatgaatctggatagatatatactccctccgtcccaaaaaaaaaggcaaactgtgggttcccgtgccaacgtttaactgtccgtcttatataaaatttttttataattagtattttcattgttgttagatgataaaacatgattaatactttatgcgtgacttatctttttaatttttttcataattttttcaaataagacggacggtcaaacgttgggtacggaaaccagggtttgtctttttttgggacggagggagtatgtctagattcattaacaacaactagggaggaagcccgcgcagatgcgcggacaatttagttattatttattaaaagaatgctaaaacatgttatcttaccatattttatttaaaatccatagattatcttatctctaccctaaaattgaccatagactttgatgatacactaaatttaattataagaatgtctctcatattaaaaaaaaaacctagctggttatatataaagtcccctatcacaactacttatttttgttctcttgaaagagttgggtgcctttttaataagatagaattgattattaaaaaaacaaacttaatatatcattaatacaataaaaaaatcatctccatttcataccgaagtgcacatgtctcacttgtgtctaaatgtataaatatttttaaataccacttctatcaattaataagagaaaaccattaaaattagatataaatacccatctaacgtgctaagttggccatcgctgctaaggatttattctataatgcctttaaatatgggtgccgcattgatgtagccatacccttcaagactatcgtcgatcacaaattttaatacctagctcacggtctatacacttataaaaaagtgtattagtaagtaggctagtgagttctcctaccaagagtgaaaggagtcatagaggactcgatggactgatcgtatgtaggtaggtacaaacataataaagttttagttttaaatttgaggattaggagggaaagattaatatttttaatcatacatgcgtaggtatgtttttctaggtttttttcgatgaatagtacatatttttctgtggtatggatacgggagattaatatggagagattactttgatacatctaaactaatgtttaaaaataataggtcacatgacggcttaggagcatttgtatgatgttcaatggtattttagtatataataatattcttgcctcaatgattggtggatagtagtacatacacagaattgatacaagggtttaagtgtaatatagaattgacacgtaaggcaagacatgtatgagtcaagtacactggaccttatatactatatactcagattaacttaaacttatactccgaagactaaagaggaaaagatcaacatatacacctcctattagtcttaattaagacatatcggtctagttcatttaattattttttatagtcgttgaaatgctaaagatataattatatcaaaatatttatctggatatatctagatttacattaatgtgataattcatattttaaaacagaaataacattttttagtgctaatcacaattagagtattctagtttgggatattgtatattcctttaaatattaaatttatgataacgtcaatttttctgaaatatttaactaacattactttgttttgtgaaaataatattattttaacatatcaatattttagaacagtggattttttagagtgctaatcagaactaattattatattttattttttgatattatagagctaatctaattatgcatgattgtgaagtgatatatgatgatatgatctacattatctatgttctacacaatatttttttattgttggatggcatgtgaaaggttcggatatgatttgaaataatggaggaacttttttttaatgttactcatgctttaagtgtttttattttttgtcatatctattatatttaatttatttatgaaagttttataaagtgatacattgttgttttttcttcttttttttgacagcttcaatagcatcctaaggttaggatataataaaaaataaatatttcttatgagttaaagaatgtagtacattttattggtatttatttggttaattaagcaccatgaatacgataatgaagaatgataaaatagacttatgtgcaaggttatgattattcctctatacggaaatgatttaaaaatattttttttaattgtaacaaatttaaaagaaagaaagagatgagaagattgcataggagggggagagatacgtacgtacgtacataccatagggaggagggtgggttggtggggaaaggggaggaaggtggattatggtttttttttctaaaaataaatctcgtaaatgaaaatagtgggtattctaaaaataaatctaatagatgaaaatagtgggcctagcgatttattagagagccacgtagtagcttaggagcgtttgtaggagtcccacgtgggggcttgagagtgtttgtacgaagtttaatggacttttactatataataatagatatgaatgtgagaaatgctagaatgacttacattatgaaacggaggaagtacaatatgcacaatgcatgatggtgaagctgaatttttcttcgcagcttgcagcttctgttgtatcccaatcggaaactctgtaagaaatgcagtaacgcagtgttatgcgcagggtttcagtgtgaatttgggataaaacaccgccagatcgaaagatagtttagttgggatgagaagagattatagattgagaagaacttgaagggaaactaattttgattattcattgcttaatctcaatgcccataacacgcagagagattgatcctattctcgagatcataaattgggccctcaccatctcagcccaccatggaaaagaaaaaaaaaaacaagaagaataatagcataacagagtgtgagttttcagagagagaacttggaagtatacctgggctgggctcgcaccaatttgggcacgaaccgtttcagcccacaaacccattatttcggttacttgcacattatttctgcaggattctttgagaaataaatttattcagcacttggctgagcatttttctcccccatgataataggccacaaccgattgggtagcttagctttgctgtctacaaaaatatcatacatgtggctttattttctctcgaacattcctcctacatgtggctcatagtccaaaccaaaaggaaaaagaaaagaaaaagaaataacggatctgccaaggatggcctcaattcccagtaatatttttgtagcgttttaaaaatatctcggcccctagatatttcaattaagaagaagcatacaaaaccggggtaaaaaaatatcacgaaagtctatcctccctacactaggaatatcgttctctacggatcaggtcttaactcgtgctttgaggccctagctatccatacatacatatatgtcgacttttagcccatgtttttgtttttttttttggtggaacaaaggaccgaaatttcttggtgggatgaggatttaaaccctggtcgatagcttcccaccggaagacatccaccaccattccacaagcacgtttgcaatttccagcattcttcctagctagctttgattccatcgtccatacatatgtatggtcctttcaccttttgtagtcctgttcctagctccattttttgacctggcaacagctcgcacacgtacgtccactcgcccttccactactcgatccatccatacctatatctgcttgcgattggtcgatcgatcgacgacgaaacactgaaaaaagtcgatctgaaccggccatattcagaaatcacagcaacgatgcagaattattgcagatcaacgtacacaagatgctggtgcagtgtgcgtgatagtgtcgacatcatgagccagcatcaccacacctctatccatctcttcgtctggtctcgatctcaaaaacctttacacttcatgcaatattatcactgattattagttacatatatatgtgttcatcgctttttagagaactgagacagatgcagtcaggggcggatccaggaaaaaaaattggagaggctcagttacacagtttcttcaatctccaaccatttagggatctttagtttaccattcattgtgaaaaaaaaaatcaaagggggtgttccagaggtatccataggtcttgtggatgtagggggacttgcacccatgttggatccgcccctggatgcagtgaaggatgatggatgcacgtaaaaaaatatagaaaagatgtgacgatcaaattcgatggatatacatatatacatctatatcttctttctccccagctaaaccaccaagctgaaagaaaaaggtgtgacagacaaggaaaaagatagagctgacgatggcgaagaaacgatcgaacgatcgatcaatctctctcctttcccccccccctgaaaacctacggcgaagtagaaaactttgtcttcgctttaactgcttgctgattctctcgcccatagttctcccatcactggtggagaaactatctttcgtcggtcggccgaattccacaatagacccggatgtaataaaaactggggctaaagatgatctttagtcccggttaaaaagggtaacggacatatttgatctttagtcccggttggtgaagatcatctttagtcccggttcaaatgctgtcagggcctgtcaagcccccccccgggatctttagtcctggttggtataccaaccgggactaaagattccactgggtgcattcccgtacgaacatgctaagtgtttcatatgtaatgcatccaacgcacattgcagattccactgggtgcttttactcttcgacctggaggcctgcaccgtcaacgtacatgactcaatggataaaaaagagtctacgtttgataaggttttcgaacttatagacaggtactgtcataagttcctatgttaattaagaatcttgttatagttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgtcgtttgtcatttatttatagtgcgcaaagcaaaagtagggaactaacttgtgaggctactacgtgtgcgagtattgccactaccttgtagaccaaatcatcaccacaagagagctcgatgtacgtacaaataaattcaaaatttcattttgtatcgatttgttgtttaattactaatcaatttcatacattcatatagtttattcgcatgagggataacctgatcacacacaaggaatttatcgtggcggttcaagaacaactcatgggatttatcaacgaacaaatccttgatcccaagggtgaattctactacgacggaaacacaattcataggtccttagcttctgagatagcgactactactacgtcaaaattgtagctagctaggacatataatggattgtaattaatacatgactatgtttctatatgcatctgtacacattttctataatgtaaatatatattttggtcatatatatatatatatacatatgcatttgcataacatatatatgtataaatacatatatattatgcatgtacatatgtattggaacatatataaatataatattttatatatatatatatatatatatatatatatatatatatatatatatgtattgaaacatatatatgcatgtatataaaccatgtagcaatagggccatgaaaaaaaaataggtcagctcgatctttagttccggttatttcacccgatactaaaggggattatgaaccgggactgcaaacgctttctccaccagtgcattttccgttaatttagcactgtagatagcatacgtggtgatctgatctgaatatatatctgaatctgacgcagatcacgctcagcatgcgagtatataggcttgtagtggcatatcatgggttgctgctgccattggcggtagctcatcgaaaagatcaccaactagctataagctggagtagcttgtagcttgcactgtggtatgcctgcttctgcggctgctgctgctggtagctgcatgcagatgtgtttgctagagagaaagcaaaggcgtggcgagaatattcgtgaggataatgcctcttccgagtcgttccaatctctgcaattctgcacacgctcctcttcttttatctgcacgtactgttcttgcagtagttggcatccaagaggcggacttactccatccgtcctaaaaaaaagactaacttttatctacgaatcaagatatagatatagacataacctatgttcagattcgtatattttttaggtgaatggtgtatttacgatgtgcactaaccaatataataagggtgtatttagttcacgtcaaattagaagtttggttgaaattgaaacgatgtgacggaaaagttaaaagtttgtatgcgtaagaaagttttgatgtgacagaaaagttgaaagttaatttgaagaaaaattttggaactaaactcagcctaaactgtcaatgtaggatggagcgcttttgatcatgttatttcatctttggttgtaccgcagtttggattgcagggagaaattttggatggatcacgtgtgtttattccttgaaattattttttgattttgtatatgttttaactaaggataacagggatgaacatggtggcaaaaatttccgaccgaccgagtatgattgctctaaactgttttcaattctaaacatataacaaatttgattagaatattttttgtaagtatcgtattggtatcgtcgctaaactgttatactaataaatatgataaattctcaagtgagtgcgaaaaacgtttctatagacatgatatcatttttgaccattttcattcaacaagatgtatcatagccaaaacattacgatgacaaatcgttgttagtaaataggaagggcttatttggaacacaagaatttagtatgattctcgcgttaaaagagatcgcatagttttcatgtgctatttctatattgcaatggtaaccatttaaaggaaaattttgcgacggtaacctacactacacagctacatctagagtagcatctctaactaggagagatttgatgatgagctaattagagcctaagctttttttctcagtgatcaagaaagtgcattcaagcttttttttttcctctgttatgctatcggcttgtttttcaagctgggtaatgaaagttacctgttgtcaaaaaaaaaaaagtgcattcatgacgatattatgatcgatcgatggcaagtgagaaaggggtccagatccccaccgagtggatttggcctaatctcaaccgtccttttgacttatacggctgagattttctctaatctctgtaaccgtgtttctttcttttcctaattaaattacaagtaccaaagcagcagaccatcgttttccctccagagccacaacagcttcatctttgtcatcgaactttagttcagctatggtgttaatattggcatattgttattcattgcctcaaacagtcaaactgaagattcaagggtatctacctccaaccatggtgaagaacataatgctaatgtttatttagatggttttgtgatggacaacgttgttttattgatattattggccggagaataatcatggttatggtgggaagtactaaaaaactaaatattttcctctaaatctatatgattaagatagttgattagaagaagagtaggggccatgatcccagccatagaagtcagaagaacggttaagattgagccaaatccaccggtggagttagccccaactctaggggatttggacccgtgagaaagagtcatatgctccaggatattcggcaggctaggcaagagaaatttttaaaagagattgaaattctgagccctggtggtggagacaatgatggcagggtacaaactgtgttgttcactagctacctctgtctttgattatctatgatgcagcggattacagtgagaattttggatgcatcatgtttgttttccaaagaatttctatttgatcatacatgcattctaaatatcataagtatacccttcgacaaacttattttaaaacgtaggaattgtcccaagtacttcccacctcttcatattttatttgtagcttagcccataacactagttcacattattaatatattatttagtccatgattggtggtatttatctctaatagcacttttgggtatttcaatatgtatttaaatatatttgctagttgctaccgtatctaagttattcgtatgtttttgcatcctgctaaaaattcatactaaggtatgtggtgtttaaatctcctgaagataaaaatgaagataaatattaagtgttttacgcaaaacaatgtggtaataacgtgtgattaatttagttttaactattacaaacttgaaaaatggattaatataatattttagaataactttcatatagaaagttttcacacgaaatataccgtttagcagtttgaaaaacgtgctacttttattaaaaatttattcaacttttgttggagaaaagaacagggttcctccgatataatccatatcccataacacattcacaccgacaagtcgtcggtcgtaaatactaagggcttattcgggcacaaagaatttcatatgattattgtgttgaagatcacctagtttccctgtgccatttctaaattgcagcggtaaccgtccctacactacatagctagctctacacgcccagagaagcagcatctctgactccgagagagatttgggctaatcagagccagagcttttcctaattctccatggcaacaaaaacccaacaaattaacgagcatatatatgaaaaattaagtgcatccatgcatccatgacggcatagatatgatcgatggcaacaaagttgcgacttggcgacatgaaacagagtaatatgctccaggatattcggcaattgaaattgaaaaaaaagttaaagatggaaattggtgagctcctggtggtggagacaatcatggcagaggggtacaagctgtgtgtgttccctgcctctgcctttggttttctgactaggcccccactcccaaaagctccttttcccaaaaacttctcaagaaatgaaggcgttgcacacggacgatccgccgcttccactagctagcaaatagtactactagtactagggtactttcgtttatgtatctcaccaaaattagaacaatattaaaaagaaataaaaaaaattagagcaacattactcagttcatggatgcttctgcgaatgacaggtagtggaaactaccagtacctgcatacaatgaatggagaccgaaattttgacaaagggacccttttgcaaaacttgtttttaagaatgaaccgtgaattcagcgccaattaaccctaatagcgtggagatatgactctcgctagttgcattagagattttattactcccttcaaccacaaaacatgttattttgaaatgttttactccctccactagtatgtaacttaaaacgtttaacactaatatctcgtcaactatgcagattagatgtagggaaatcaaatgtgtatatttgcctcataaagtaatttagtccggtttcctagtttttcaaatacaaattaatgatcaaaaatttattttaggtaatgtgtcaatgtctaaaacatatttttcgcgggagtggatacttcgatcttttttcccgaatgtaaaagtttctctagtattgttcggtcttgtccacaatatctagtgagagtgaggacgagagcgaagaggaatctaggcggcagtaacctcgacaaccacatcggcaaactaaggatatttgctgaattatgattttcaaagtttatggatggagtaatatttgatacaagtttaagaaattaaatagcaccgacgaattttacttttagatatatagagccgtttcatgcattttgccactcgaaaaaatgtctttaattatttttcatcctagtctatatgccatttgaattagatggttatatgaaatggcagcataatcaaaacgacaatatttattgtgtcaattcatattcctcaaaatttaaatactggtctagactcgaaataagatgatttaggaggacggaagagcacaaagcttccccattaccctctacacgctcgaggcgccgcttccaggctagccgcaacaaaaacacagaacgccctccttttggaaagtagcgtagggccccgaagtgacatgacttggatatcatattagcatcgctattggatttggacccctctactctacacacacctctctctcttttccccttttattttctcttccattttcttttctatgagagcaaaaaagaaggaattcttggatgatgatcactttggaagaaaaagattttgggggtgaaatgaaacctatgggaaggaattgagaactggagggaggaatcgatcagtcaatcagtcagtctgtcactcacccaagtcactttaattgccaatctagttagttatgctaaggaatattacttgccatcaaacaagtaataataatgatgatgataaagcacctttggcaaaagatggaggtatgtcagccattgataatggattagataagcaaaaacgtatggttgatctcaacttaatggcaaaagaggtatatatacaatgcatagttattcgcgcattggccctgttcctgataccagcttgtaggtaaaaggctaacaattaatgccaattaactaagaggctacaataccaattaattaagagatgttttattggcaactctgccactggtaaactattttgtttacttcttccgtttcactataagttaatttagtaccacaggtgacacattctaatactacaaatttagacattatactgtccagattcttagtattaggttgtgttatatccagtactagataaacttattctggacggagatagcactttagaaagaaaaacgaggaaaaccattagctagcatatgattaattaagtattaactattattaaatcagagtaatagattaatttgatttttaaaagaatttctatatatatttttcataaaacatattgtttagcaattttaaaaatatattcactgtaaacgagtgattaacccaacccaaactcactttctagaacgctccctaactgcagtttaaatgcagtaagtagccctgcaagccagtttacagatgtttgtgataaggtgtcattataattcataacatcgatcatgaattcggtacggtcgttgacaaattaaagtgaacaaagcacatcaatttggtaagaatttgccccttttgttcagtttctaattgctcaggaatatatcctaattgttcaataattaatagcagagatatctttttgttgaaaagaacaatgccaatttttttttgaggcaaatggacatacaaacaaatggatcatggatgcacctgatcgtacaaagtggcaacagaacatacgaccttatttctcctttgattaaagttatcttatttaatttttttgggggagagaagtcaatactcaaatgtctcaataataatatatatcagatgtggtcttgtatgcagggcccatagttttggtaaagtttatacatcttgaatgatcgccgctgttgtatgaattccacgcaacgtgtcgcgacacactttaattgcacttatttttaagtacctgagtattttcatttgctaagaaattaaactaactaaagtggtttgatcgatctaaaaaaaaagccgctagaagggatatccaaaccggttttatgatttgagattttatacttcagagcttaaatggactttattgatgtttaaaataaactgtaaaattaactaatgttaatttatgattagtttacttcacaggaacgcattgatgcatacccatatatggcttgtatagcatgtttggcatcaccatgagggggtgggtggtaaggttataggatgcgaagagagattttaactctagcatctccataccaaagcatatgacaattttgttgatgaactttacctctttttctttttttaaaaaaagaaaatacattaggcaatcgtaatatatggaaggtctcccttttttttttacctctcgatgtgatgggaggtaacctaaaagttatcttatccatgtactttcggaaataattggagtgataatcgaggtcatttatcttaggggtgtaaagttttggcgtgtcacatcgggtattaaatagggtgtcacatgaggtgttcggacactaataaaaaactaattatagaatccgtcagtaaaccgcgagacgaacttattaagcctaattaatcgggtattatatagcatgtcacataaggtgttcggcactaataaaaaactaattatagaatccgtcagtaaaccgtgagacgaatttattaagcctaattaatccgtcattagcaaatgtttactgtagcaccatattgtcaaatcatgaagcaattaggcttaaaagatttatctcgtaaattagtcgcaatctgttcaattagttattttttagcctatatttaatacttcatgcaagtgttaaacgtttgattgcaagtgttaaacgttcgatgtgacagggcgaaaaattttaaggtgggatgccttattgaagttgatttgttgggaactgtggatatctacctcagtgaattgatttgttctgagaaatcgctcgataaaccggtcaaatttagaaggaaaacaaactagatttttagcttttggcaatttttgctcttaattcgttttcaagatgatcgacccggcttttcagaaagcctaaaacataacaaagtcttttagagaacacaatttttttaaaaaaaacacacacgagcttacccaaattttaccattaaaattttcagccaaacataaccaaattttgcccattttcacggtaaccacactaaaatcaacaaaagtgaccggtcccccactatgcaagagccccaaacaccactgtgtatgtgtgcatcatctggccatctgcactactcgtcctatctgttgtgctctgcagcttcttccttccttgcgacccccttgtactgtagcagttgaagaagcaaaaaaacacaagttccaaccaatcgtgcatgcggccaagctactactgtaccagtgctagcacagtagtaccggtcagggtgcgcctctgctctgtcgctccacacgaattttgcatccatcacctcaccaaacacacgattactctgccctgccccccacaaaaaggttgtggtgtgagttgtgaccaatctgaattccgcaaatgagtgcttggtgactcattgccatggaggaggttgtccatgaactcatctcactgatcaatcagaacaatgatgaacagaaatcatcggaaaaggaagaaaggaagagatgagatgagtggaaaaggaagaattttttggagttggaaggggaagaaaagccttgatgcatttattggaagcacaaagctttgccttttgtcagttgcaacaacaaaccaaaagacttgaatttacagattccaaagccgaagctggccaagaattcgacccaaatttgacctctcgtctcctctccatgtgtgctagagctagcagccgatgattacaggggtggaaaaaattaattcctagtagcaaatctcacgaacaaaattggtcccacgcgcaacttgcagcacgggcggtttcccctacggctcgccggcggcggccggtggcggcggcggggggaggacgaaggaggagagcggcttggcgctggcgaggaaggacggcgcggtgtcgccggccatgatgacgaccaccttgggctcccggtcgagcggcaccagcaccttgaccgacgccgccgccgacgccgacgaccccgcgtcgccgtggttcttgcggcgcgtgcagaccagcacgagcagcgccaccgcgatgaggcccatcatcaccgcgaaccccaggaaaaggtacggcgtcggcgtcctccacatccccgggtgcccaccaccaccacccgccgccgccgacgacgacgtcgccgccaccccgcctccgcctccgcccaccagcttcactcctcccctcattctcgagctctgcgtgtgtttgcctctctcgctcgctctctgctgcggcggtgaggagggagaggggagaggagggggtatatataggtgggcgaggagggcgcgcgcggttgcggctagccgctgctgggttttgtgggcgcgacgcgacgcgacacgagcgcgggcgcgtcgcgcgcgcgcgcgcgcggcgctgctgggtttgaggcggagtctgcctggcttttgcttggtttgggtgacaggtggccgacacagtggccagtggagagtggagatactactactgttgttgtatccagtgtgaatgtgtgatatggactgtaagtacaaagttgcatgtattgatttaattgatttatatgtggtgtattttggagtgtcattaaatgtgaatctggaagtttcttgtggagacaattgaagggagtgcaaatttaagggggtgattaaatgagtctcttctgcttttaagcatgaagagagaaacattaaaaggtttttggaagatatgaattaaatcctggaacttcttcaattggtctaattatattatgccttatatcataggttctctgttacgtggtaaaagatatctaaagcaatagtctagttacttttccttcgttccaaaaatatatagcaaactaagataagattggaaattttctagtattaagaatttggacatgagaaaatatctaatttaatcctaagatgctatattttacaatggagggagtgccctttttttcgcaaaacggtattatactatgttcgaatatgtagttaccagcctgatactcatagatactaatcctggttagcaggcatatatcagacgtggcactcgtgcggtaataggatgggtacttataagtacatcctataatgtgctattcttggagtactctctcacatggccgcgcctcctttcccatcaacaatagtcggagttgaaggtgacgaccctcgctagattgttgtggtagtaattgttgtacaagaactccacctccccttagctttagcaagaatgagggaaacaacggggccactcctagttgtgcaagttatcggcgaggaggttaattatatttgttctagtggtgcagtgagccagtgaggtgagtgtggagggggattgttggccgacatcaatggtgcatgccagaaaaggatgacgagctcctcaatggtgaatttcttgcggcggaagtcgtagatgagccaaaggtgggatttagaaggtcgcgctgggcatccaaggtgcaggagaagatgttgtcaatgtaactagagatagccttgaagtggacgtgttaggatagcactcctccatcgccgccttgatctcatcaatcagctagaacgataccggtcgaccaagcagcagtggtggcacaccgcacacacctttctcaaccgtgcgcatgggcggaggtgcggcactgtatcatcctgcgcgtccatatgggatgatgtcccataccccttttttttcccaatatttttagagatttttatgtaactgtgcggtggagcacacctagtagttaaatggaaaaccgaaactcgagtgtacatgtgtgcaggggagaagtcacgtctaataatggtctaaagcagttaggacttaccctagattagcttatactccctccatactcataaaggaagtcgtttaggataatgtttaagtcaaaccttgggaatataaatcatgaataactttcaagttattgagtttgaaaatataaaaattatatgtatagatttattttgaaaaatactttcataaaagtatacatatatcacttttcaataaatatttttatagaaataagaagtcaaagttgtgttttgaagaccgtgtcgttgtcttaaacgattttctttatgagtatggagggagtattttctaatttattatactcagatcctcttaaatccaatgaaaattttggagaataaccctgcccagcggtcgatagttaaatgcgtgcatggattcagtgaacctggccgtagtgggaaaacgtcggaaggacgaacctacccgggttgcttggaatgatccattccagagggtcatatataatagtactcgcgtccttttgtacatttgtactgcaaatggctcgccgtcgtacgttgctatccacaaccactgtgagcagtagacagtagtagtgcactagtgcgcgttacgtaatactactagtagctaaaccgcgtcttttggctctaattggccctctctccccgtgccttttcttcatccattttcgctgtgctccactgaggacagacaggcgatcgaccaactactcctctaacccttttcactggaaatcgacatgcattttgtacaattgtactgctagtgttagctcgctcgcgtatgaaacggtgacagaaaaagattaattaggcatataaccatgacgagataaatatattaactgtgatcgaatcacgtagtagctggcggcgaatgcggccggctgggcggcgacccggcgtgcgtcacacacgggagaaaatttagttggctgcgtgctcgatcgatcggttgctctgcgtcggtcgtctcgcgtttccgagtcgccgcgcgcgggcgccggcgcggcgtttacgcacacgccacgcgagctgtcgtgcgtgtgtgtatcagcaggaggtgggcgcggcaggtggcgtatgtactgcgtctcgaggcaagcaaagagaagcaagcgcgttatgtcgtaggagtacgtacgtatacgtgtgagcgtcgtgtgccgctagcctttggctattcactccgccgtctcacagataagattttttttaaaataataattatttgtatcgaagtttataaaattggaaataaatatattaaccgtagataaagaaatagataattgtattgtgatttgctaaaatgaggatattttgatttttggttttatattgatatgagtaaaaggtaaatttattttaaattgggacagatgaagtgtacttcagaatcagatatggggatcaaattcgatcgctagctgctgcacacatgcgattttccaagtgctcgatcgcgtccgtccaacgatcgcatgggctactagcggctgtttgttgttcgaagtgtctctttgctactactccattctcgttcggatcgagtagcttctggagtgatcgtatatatcatcgtacacaaattgcgtagaagtagcactgtactgcatcctcacgtctgcgcgcagaggtctctgatcaaccgatgcatcgcctcgtgtgcacgaaaacggccgggaaaaaggcaaacttcgctactcagtagcacagtacggcgtacctacgcacagtacactgatctactctgctcttctttgaataacacaagacagaacacgatagagagaaaggaaggagaataaaatcacaagcgaaacgagaggccatccgtcaattttgcgcgacctgcgtgcgtgcgtacgtggaccggccggccggccgcgcgccggcgcgttcgcgacattccttgcacacccgaagacaacgagtcgacgacgacgctgacgaagacgatcgacgacgtacgacgaaggcggcgtcagagacaatggtggagcggttagttttgacatcacgcgggccgggtcgccgcgtgcgtatcatcatcatcgacaacagcaacatccggatcagcagctggctcgcgtcgcggcattggtttaacttttacttttgaggcagattttcctctcttctttctgggataaaggaagattcgagcgcactactacttcgttagtggcggtaattaattaagggtacccattaattaattcagtagtgcgctaatggcgtaattaatgggccagggcgaaaggcggtttgttgggggggggggggggggaatttggtaaagtttagtactgcttgaccaggctttaggtaaaaagctattcttaaaccaggtgctgaagttaaagttagttgtgagtacgttcatccggaagtacaacgaatgttgttgcgagatccgtctctcgggtcagtacgaaaagtgatgtgatttcctggattactatttctctcgtcacactctagaagaaattaactttaactttgccatgatatatagccaccaattgttaaaaggtttgacttgcacatgccaaagtacggtttaactagttgttactagctacgatcggtatgcatgactcatggattaaagcgctaattaacaaattaagtactggattgctacacagttataaaaacgagatcaacacaccagctaaacctaacaaacgttgcatggaatatcataacactcatcaaggggttattatattgtctccaacaagaagagattttctgctccagaaaaaccggtttaatcatatgatctgaactcaaatctgtataggtggtgaacatttcaccaggaggaacagatgcaaatgcaacatgaattgcacatatttccatggccaagactagcttagcaactgctagtaaggagtaaactagctagtacatgggcggatccaacacccacaaaacccatggatacccccctaagccccccttcaattttttcatcatagttgataagataagaagtgctaaaggtcttataatagtattttagcatagtttaatactgagattatgtgtttatatcggtgtactcggtatgttgagtcccctcaactttttttttctggatccgccctgctagtactccctccgtttcaaaatgtttgacaccgttgactttttagtacgtgtttgaccattcgtcttattcaaaaaatttaattaattatttattcttttcatatcatttgattcattgttaaatatactttcatgtcacatatagttttacatatttcacaatattttttgaataagacgaatggtcaaacatgtgctaaaaagtcaacggtgacaaatattttgaaacggagggagtacttaaaataacagacaatcgctagtgcccagatctttgacaaacagaaaagcagcgtcgctctcagctcgatccggcccctctccctgcgatgcggtggctcgaccggcactacattaattacacgcgccaataatcaatcacgccacaaattcttgtcatcttggaccgacagccataatcatcatatccactcgatccatcgatacgatcgatggcgaggtcaacattacacagctacccacagtacgacgacggcttcatcaacacctacgtggctgcacgtgccatgcattttcagccgattcatcggcgccgccttgcgattccggcgtgataaacgcccgctccgctccggttggagcactcgatcgatcggtggatggtggtgatgcgacgatggcgaaggtttcagattggagatcgcgatgtggcagaagcataccagcgctctctgtcagctgtctctgttaatttgtgtttctgcccatcattttcgggtggagaaaatggcttctgctgaaaagttgtttcttgtctggcctcttgcttgatgggccgcgtcaaagcccagaaactagttggcccagctactgtataattgaggaattttttatatttatatttattttctaaaagattgaaaaataaaatattgttctaaagtttttaaaaatatacctctcccgacataccgtagggtggggcatataaaataccctatggtagggcgggctctgtacgtgtcacaagatgaaagaggtgccgtaccatgataaaatttgcatattgccctttctcgtcctctcctaggatgatttacttcggtgatgtagtagatgtgctatggcaattttgtaggtgccccgctccccagcgataaatcgcccacccaagaataatttatcgccgagagggggctgcctgccaaattatcacggtgtaccctctcgcgggatgccacatcatatagattaccctttcgtaggacgatttatacgtatcgtgctacaataggacaggaggagtatatttctgtaaaaatttgaaatgagaattcatttttaaatcttttgaaaaagaaataaaaaaataaaattctataattgagctctccttggagccacaaatcagagggatggtaaaaaacagaaagcccacgagctaaggagatgcttagattctcttaaaccatcacaaaagttttggagaaaacccttaacttgttaaattagttgagccctagtcttaagtgctccttgctaccagttaagggcttgtttggcacagctccagctccagctccaactccactcctcctagagctagagctcagccaaccagttttaactccatcaaaaccgggagtggagctgggtggagctctcttacaaaataaactagagttgtggagctgggtttgggtagctctacaactttactccagacccaacttctgaagctaaatttagcagttggagccgtaccaaacatgccctaagtaatggtgagtttaagcctcgttctaaacaacttttatgctgaattgatttgtaaaagaaaaagaaaaaaatattagtatataattaattttctaagtattaattattacaagattataatttacatttataattattattaaaagaaaccttcatatgattttttatgtgaagtgccctgtctagcagtctaggcagtctagctgtacatttagctgttgtgaacgtggccgagagttaaatgcatggacttaggcctgctttagttacaactttttcttcaaacttttaactttttcatcacattaaaattttctacacacacgaactttcaatttttctgtcacatcattccaatttcaattaaacttctaattttaacatgaactaaacacacccttagtgaacttagacgcgtgaaaacgtcggcaaagaacgtactggttgcttgggatgatcccgaggcgcctacaaatcagactcaaatcaggcgctgttttaccaaatagatcgaacatgtttcacataatagatcgaaaatgtttcactcttttagaaaactaaaacacaaccaaatcacctcatgaaacattttgctacaatgtatgaaacaactgtcagggttatagataaggtatacctcctatcctgcgacttatgaaatataccgataaggtttatcttcacgtatacggattgttcctatgaatgtcatgaggaaaccgactcatgttatggaaagtatctctacgagtcaagtgatttccaaagttctactcggaatagatagagtttctgttataccgtatcagatccgatatcctcaaacctttcttggggatcaagatgatacacggtatgaaagggaccccctggcaggggttcaagacatccaattcaatcgccaacacacccaacaaagtttatgaagccggagtacgcggagtcaactcgccgggagatctcgtcgaatccctcgactacgatctcgtcggtaccatttgtttcgactactctctttgtaatctgttctcatcatcatcaatctcatataaactggattagggcaattacctgacaaggggcttgaaccaatataatccttgtcttttgtctgcttgatgccgtactacgtagaccctcgttccgacataccctaatactctactcatcaggtccgtaagtatcactcgtcgacaacaacggtttctaaaaaatcagatgttgtttcaccctatataaaaacaatgtttcagtaaatagcgaaagaatgtttcaattcttaaaaaatgtgaaacacagtcagatcgctagatgaaacaatttggttcaacgtatgcaacaaacgatttgaagccatttgcaacacttaaaccccgtgtacatcaacaaaccacgtgtccatcagatggaaaatattaaacaatacaaaaaatccactgcaacatttcattcatatatagtaaaacatcacaagtacacttgctgaaacattgttggtggaacaaattaaaaataaaacggattcccttaataggacgtttccgtttatatccgggcggttgttgcaatggggacgctgttaattgacgtatgaagtaattagaaaaatgtgttagaaaaatgtaattccttaataaatacatacgtaccccacttttgtgtctcccgaacggcactgacaaagtatggattatcggcatttctacctggaatgccggcggtaaagaagaaccttgcccatgactcaccaatggcctgcctagcttgcttccccttctttgtgaagaatcctatgtcaatgcgtgtctgcacagggaacttggcagatgctagattgtaatctcttacagcaggtgactccctatgagatgtagcccttcgtagcatactggtaattgggttacttctacctttccgtgcctcgagctgagcggatccactcccaccaccatgctcataagtgccaccacgctcctccacgtggctcctgaagttttcctcttgtcatgaggctgccatggctgcttccatttgttcctcctcgtcggcatcacctgttaggtcataatagttgacccctgccgcttcaacccttctattgctatcattctgacgcttgtcacctgtttgttttatcctctccaattcacgcttgaagaaatcacggacatccggaggcactgaattgcaatatgtaacccccttccctttgtgtcccaagtgcatttttagtcgtgtggccccaccacctttcttcctctgatggcaatacttacaacgccatccaggtgcaaaatcctccccgtgctcccacacaaggtccctactttctgccatctccaccctgtatgaaatgcatgaaaaattatcactaggaattataaacatacctctcataacgcaataatatgtatacagctaagcttgcacccaaattcgggcatgtatacaacaaaacaatcaaatgtactcacatgcatggttttaggcaagtacgggcaaccaaattcgctaataaactcatattcccaacgtacttcacataatccccaaatataattcatattcacaatgttttcacctaatatgttcatatgacagtataaaaaaacatataccacggtttcacgcacggtaaccacggtatcaaccacggttaccgcggtttaaacaacgattaccgtgctcaacaatagcagcgaacgtaaataacaggctacgggttctcttccaaaccgcacggttaccggacaaatctcgcggtaaccgccccctttcatgcgcatacctgttggtgggcgagccagtcggtaacccgcttctaccacgcggttaccgctgcataccgcgcggaaatcagccacgccggcacggaggcggcggatctggcgcggcagtcctcgtcgccccttcgaagcaatgcgcagctgtgagagagagaggaaagaaatagaagaacgcgacagaaaccaggaagagatgcggtagatattttccccccactgttgggccttattgggcctcctgaacagtgcatatttggcccattacattaattattttttctattttctaatcgacattagtttttgcgctcaaatttgaatttctattactatttttcaagaaatttttacaccataacaacatacaaatcaagctatacatccatgattttttttggttatttttgaaaattttgaatttgagcaaaatttgctcaaaccctaccgtcggtaagggttaccgaccccccgcggtacggccggtaaccgcggtaaccggcggtagggtgaaccctgcaaatgacatataatatgaaacggatagggaagaacttaaaaagcaaaattaacggacaatcgatcgctagtagtgccaggtcttttgacacaacaggagcacctagcgtggctctcagctctatcgatccggcccctccctgcgtctgcgatgcggtggctcgaccaataaattaattaatttaatcacgccacaaattcctgtcaccttcgaccgacagccccatcatcattatctccatgatgaggcggtaaaaaggatgtaaaaatggcaacggtttcagattggagatctctgtctgtctatctgttaatatgtgtttttacacatcattttcgcgtggagaaaatggcttctgctgtgaaaagttgtttgttgtctagcctcttgatgggctgcatcaaagcccaggaatcagttggcccagctactgtcgttgggcccacgatccagggagatggtggcggcccggcctactgagttggttcttggtgggccggcccagcacgtgagacgttttctgacaagtaggcccggcgcgcaaaccctagatccgtggccgcagacttacacgacgacgcgccttatctcccccggtcgccgtgcccgcccgtcgccgtcgccgtcgccgtcgccgtcgacgccgcagcagccgggagggaggcctcgtcgtagctcctctcctctcccgcctcagggtcggggagcccccgcccccccgccgcgggttccgttgacgtggagccctagcgcgcgccaccgccgggcgtcgccctcccgtagcgacaccgccgccggcgtcgccgccggtggaccgctgatccatcgtaggtaacccccgaagtgcgtctgctacggttcgtgaatttatcgattcgattcgtccggcaaaacttgattgttcgacacagcactataaagagaggcggttatattacttcttagctttgtaaaatttcgaaagattagtgtattattggcctcctccgatgaataaattttagtgcttccgctccgcggctgcttgcgggtttgggattctggcaggagtggtactactacttgttttactctgaattcagctaatttctgccatcttagttatgcaattggccattatggattcttggtaaatcttgtttacatgatttggaaaagtagcgtgaatgcgtagttattattatgcctgaatactgggctgggcaaggtacacaattcctgtgttgtcgaatttgaaattagaagggcagctagccttaaaaccttctttaaagccctgaattcctgggtccaggtcacccaccaattcgatcataattggacacgtgggaccagctaaaccaatgtttaagttctaccgttcatcattacttgaccaggcagagtttgtgcttcacaaccacactgttttacacccctgtagtttcacatggttgcccttgtttgaatttacaaaagagaaactacaaggtctgcaggtctgattatgaaatccttgaggtaaattgttctgttggaaaatccatataatcttcaggattctcgaatcttgcttattaatcgctaagcaaatagttgctttcctactaaggctaactcatgtgactcatttccctgaaagtcacaactttttacataagcctaattgttggattgatcgcttgtattttaggacataagcgctcatggggaagggagaaattgtggctgttcttcaagtaggtggagaattcagcacagatgctgatggactaatgtcttactctggtggagaagcacacgcaatgcttgtcaaaagtgactggacgttcagtgcattcaagcatgaaatatcttcaacgctgaataatatcagagtcgatcagtttgtgttcaagtatttccttccaaaaaataagaaaaccttgatttctatttccaatgacaaggatctacaccgcatggttgagttccatgcagaatctgagactacatacatctatgtcatgaaaaagaaggttgacaacaggtacctatctagttttgtcgtaaatttcttgtcaatttctttgccaaattgacacaagacatctttgcagggcatcgattgttgttgctgactctggtactcctgtagataccactgcagttgtgccaacgactcaggatgggtctaagaggcagaagatctgtgcaacatggaagaatgtgattactggagttggtcaagtgtttgatggtcctaaagatttccgtgatgccttacataagtatgccattgcccataaattccattacagatttatcaagaatgattcatctcgtgtgactgcggaatgtactggtgaagattgcccttggcgaatacatgcttccaaatcccctgccaagaagcaattcatgatcaagaaaatatctgaaagccacacctgtgaatcagagacagtcaaaagtcatcgtctggcttctcagcgatgggttgctagtgttataaaagaaaagttacgcgatagtccaaactacaggccaagagatattgcaagtgatcttcagcgtgagtatggactatgcctaaattactctcaggcttggcgtggaagatcaattgctcaaaaggaacttcatagcacacacgatgaggtaaccagtcagctaccttggttttgtggacggatcatgcagacaaaccctcaaagtgtggccactgtagtacctatggaagattcaaaatttcgtttgtttgttgcattccatgcatcgcttcatggttttgagcatgggtgcagaccattactttttcttgatgtaatatctgcaaaaccaaataagcagtggaagctacttactgccacttctgttgatagtgaaggtgatgtgttcccagttgcatttgctgtagtggatgatgagagcagtgaacactggcattggtttcttgagcaacttaaatcttctgtgtcagcttcccgtgccataacattcatatcgaatggagaaaatggactatgggatgaagtgcctttggttttccctgacagtcaccacggatactgtgtggactatcttattgaagaatttaagacacaattggatgatgcatggaccgaagaagcaagagatgtcatggttgagcatcttaagaaggccatatatgcatgcacagttgacgagttcaatcagtatattgaactaatcaaaggtgaatctgacaagcttgctgaatggcttctggagattaaacccgagcgatggtcagatgcctttttcaaagggtcaaggcatgggcagtattcatgcaattttcctagcactattgttgagtggatccccaccagatacgagctttcaattgtccagttagttgacatgataagatgcaagctcatggagatgatgtacacacgcagggagtcttctaatgcgtgggctgagttattaacacctgcagctaatcagaaattgcaggaagaagtgagcaaagcccacaccctgaacgtcatcccttctgaaagtaatgaaaatggcaatgtgttcaaggtgtgtgatgattctgttaatgttgtcaatattgatgcatgggagtgtacctgccgaaagtggcatatttctgggttgccatgcatgcatgcaattgcagtaatagagcggattggacactgcccttacgattactgtgtgaagtatttcagaacagaatgctaccgcttgacctactccatgtcgataaatccaatacccgatgttatgctgcctcctgctatattaagtgatcaatctcaaagtccagtaacacatgcaaccccaataagaacccgacgacgggttggcaggccaaaggagaagccggcagacccacgcatcgcaattaaaagggcagtgcggtgcagcaggtgccagggttatggccacaataaagcaacctgcaaagttcctctgagcacatagtctacccatgggttcagttctcctatgtacatttaggtggagagttgctcttgtttgctgtaatacgagtgatgctatttctttataactcggtacatgcatcagtcattgattctagctctaaattgctttgtatttgcttgctttgttaggctaacatatttggtcgtaaaatcgcacattgtaatggacgcaatagagagacttgggaggtttgctgttatgtaatgctgtccaatttgatctggtttcccgttctagctattgtgtgccaatctgatcatctcaactctcaggcaaggaaaggaatatatatagactgtagttacttgaaaaacctttgtcagagtatttgaactttgcattattagtttgtttggtttttgcagtagcatacattttatctgttatgtacaaagtaatttcttattcctagagcactggtgaatataattatattttaacacagtcaactgattctctttgaaattccgttgctgtgatatacttgtattgactatataatctacagaacctgggggcacaatgaggatgaggatgatgagctattttgcagcagcgttgagccaggtaatgttggtgctgcttttccatgttcgaaatttctgcttcgcttgctttgttttttgcttcaagatgaatttgttctttttttatgctcaattttttatgctcaagatctatcacctgcatctgaacttaggtgtgtgatcttttggggaagatcttgtcagggaagggtattttgttgtaacgaagccttgtatctgtgaactaatgctgtaaactcaaaatatcatttcatggtgttgttcagcgagtgcttctatgctctcgccgtccagctagagctgtacgtacattgcaaagtaatgttcataagtacatataaagttgtccctcacgataatagtactccctccgctttttttaacgtagtttaaaattgaactaatcaaccttaaatattaaaggatgagggtagtatttctcttctagtaacagaatgctacttatcaattattttttatttttagtcctccgattaacatatgctcaaaattgtttctattctccctcttcccttgtgaagcaccatagcttaagtttctagtctttctggatgattgatcacttgcatactgtgtccaaaaattcaaggacaattagaatttgaaattctttcaagaatacaacgacatccttggatttcccatctcaactaatcataactcatttaattttctcatctactactttatctcaaccaatccagggataatctgatacaaatacgccgggttttaagtctcccgctatagctgcgctatctcccgctatagctgtttgagaaaggttttagctatttgctctcatatacaatttagtcgctatagctccatttggccctctatagtttgagaagctaaccgctaaatgtcttattccgctatttaaaacattgaaatacgtggtacggcgatattgtgatatgtcatattttcaaaaatatatgaggatagacaaatatatataataataagtaaaatttaaaaattatataacatgaagaaataaaaggttaatgttttaaagagagctattcaatttgatcaataggataatcacatattccctctgtctcaaaatatgaagtgtatttagtttttgcccgatctactttggggattccgtcccctgtgcggcgtgaggggatggcgacttggagccacgcactccacagcgtaggcgggatgcgttttctccgccacgcatagactcgcgggacgaaaaggctaacaggtgatcgcggcgatcgacactcaccctcctccacgtgttttcctttttttggcattgcattactttcctattttagtaaatttatgcacctaaagtttttgtacacctcaagtttacacatctaaagtttagagacccaaagtttataagtcaaaagtttatatatccgattcaaaagtttacgcatagactcgcgggacgaaaaggctaacaggtgatcgcggcgatcgacactcaccctcctccacgtgttttcctttttttggcattgcattactttcctattttagtaaatttatgcacctaaagtttttgtacacctcaagtttacacatctaaagtttagagacccaaagtttataagtcaaaagtttatatatccgattcaaatttgaatttgaattcaaatattttttatatatagtatttctatacatctaaagtttatacacctaaagtttatagacccaaagtttataagtcaaaagtttacatacccgattcaaatttgaatttaaattcaaatattagtttatagacccaaagtttatatgcccttttcaaatttgaatttgaattcaaatattagtttatagacccaaagtttacatacccgttttaaatttgaatttgaatttgaattcaaatattttttatatatagtatttctatacataaatttttccaactttgtatttttattttttaaaaaaatttatggtgtagtaggaagagaagaatgggatgaggaagggggagaggagcgtatagggggggatgggggtgatcgctgtgcgatcacccgcccattagccacgcccctcgcgggagggttagaatcgcgtctcccgaagcgagaggcccatcaagagcgtgctctggctgacacttactacctccatcccaaaatgtttgacgccgttgactttttaaaaatatttgaccgttcgtcttattaaaaaaatttaagtaattgttaattctttttctatcatttaatttattgttaaatatacttttatgtatacatatagttttacacatatcacacaaaagtttttgaataaaacgaacggtcaaaaatgtttaaaaaagtcaacggtatcaaatatttagggaaggagggagtactatgttaattttctagttggcgatactaacaggcccgttgacgaggccgtgcgaacggagtgtcagcgcaggccccccaaatcagagagaccagtacaaccagccagccttaggattacaactgacgtcctatgtgtgttcatgtgcatgcatgtgaaaccagctttgatcaacaatgacgctgcccagagcagctagccaactacctcgtctaccatattaggttcctttgaatcaaagtaaaaaccatttgaattttagaggattttatcctatagaaaataatactatagagtcctttgaaacaaagaattgtttcctatcaatttctttgaaattcctatggaatgaaccttattagagcaattttggaggaaaataagtatgagatatcacctcatgttttcctcttcatgtgtctaagattcctgcgtttttcctgtgcgctaatcaatattgtttggagactttcctgtgtttcaaaatcctataggaattcaataagtgtggcattctattcctacgtttttctattactctgttttctcaatcctgcgatttaaagggaccataaagagttagactggacaactggtaattaagtcaaatactgaattgttcatactcaattattgaattgcatgcatgtatccatgcatgatcaattgaatgtttcagtactcttcttttaaatcaaattaccatgaatataatttactaatttaaatgatctattgaatcaaaagtaaaatgtaggatctcaaattatatttcgttccggggtccccgattccgggagacggccctaggtccgaagtaactcgccacgtctactctctatgaggagtgcgggtagcacacttgaggagcttaagcctccagctagaccaggaaccgagtaaagaaccacacttcacgatgcatgtgtcttaaacaatacatgttagtaggtcccacccgtgttagtaggtcccacccatctctcttttcacatccatgtctccccccctctctctcttccctttgccttccccatcgcagcggtggcccaggcggtgatgcgccgggcgagaaacggaccggcggcgcgccgagtcgggaacggatcgacggttgggtggcacatctccagacgatgacgccattgagctcccttttcatctccctctctctatcctctctcctcatgttccaaggggcaagaaggcatgtacgccggcgcctccctccccctacgaccctccgcagcgacgaactctcggcggggtcttcctcgcggaggtcaccacgcgaccttgtcttcctcgcgaaaccgggtggagcaacagcccgagcggcgacattgggctgagtggtcagatgtgtcctaggctcactggatcaaggtgacagcgagctcgggcgtggcctcgacctcgagctcctttccttctccgtgctttcctcatcgagcccgcgagcttctccgacaaggacggtggcggtggcggcggcgcagagctcccaagcagtgtggcgacgaactccccggtgacaccgaggtcggtgatgcggagcagagcgcagggacgaggacgagatcgacgacgcagagcgggagagacgctgtggagggcacgaggggatggtgagtcggaggcacaccctccacagcgcgggcttcaggcgttccctccaccgcgcgtggtctcacgcgagcaaggaatcgcgttgccttgtgtgggagcgagcagctcaagaaggacgcggtccggcgcgacacgtctgcgatattcctagctggtgcaaggaggtaacgctccacgtaggagcatgtgagaggcctgaaaggcgtaggtgattcttcataggttagcgatacgaagtaactcgccacgtccactcgatgaaaaggttcatctttcgctttttcgtgttcagctggagatgtcagagcctcatagtttggcctaaacagccaaagaataagtcaaaatttgaatttttgaacttaattttgaagttgattttgagatgcttttaacgtaagttttgttaatgttagcttttaagtcgctatgaacaaatctataaaagttttacttataaattaatttgtaaaatgggcaaccgatgggagccttagatggaagacagtacttcatctgtaaaaaaaaaaaaccaatctagaaggagatgtgatccttattagcacaataaatatggacaaatatttatctagatttgctatagtacaacgaaatccatctcatgataggttggttttttccggaccagacatacactccatctgaccgttgtctgaccggcaatgaattctgagagggagagaagccggcctgaccaaccgacctccgccgtctcgtcccatccaacaccatctccgaggagccaccactccactccaaccaccacgcccaggcaggcagccttctcgccgcgttcacactcactcacacggctagctcagctacctgcgacatcgtggctgtcgcgcgcttctcccactctccaccgagcatgccactctccgccggctcactgcggcggcggcccaagttcgccgcgccgctgctctcgccggcctgcctccaccggctggttcgtactactccgagtccgatcgaccggagcccggacgtgacgagctgcgtctcggtctcaccagtaacgtgatgtgatcatcgttggtttgcagagcgtcccgggcgagttcgcggcgaggctggacgacgacgacgccgccggggtcggggaggaggaggaggaggagagtggccgacgggcggcggcggtgctcgtggtgggcccgctcggcaaggtctggcgcgtggagctgcgccgctcgccggccggcgacggcgaggcgtggctgggcggcggatggtcggagctcgcggcggcgcacgggctcggcgaggggtggggcgtggtgctgaggctggagcggcgcggggtggcctcgctcagggtgttcgacccgggcttctgcctcgcgcgcttctgcactcctcacgcaggtacaccaaatctcagcaatggcgtatgtgtaactgtttatccatttctatatgtttttctataatgattcatgagccaaagttgagttaaattatttttgcttgaaatatgactaatttggttttactttgtaaagatttgtagcttttttttttaaacattcggattatggttgcatttacaggtatgagaaccaaggacaggcctcgcttcatcaagctgctccaacaggaagacctggaaaagatggtgagcattcaccaagccatcatctttaccttttttttttttttggaatacgcaaggagcgtatctttgtattaagaaggaataaatgtatgtacaaagtgggccgaaaagacaaagcgaaggggacagggtacaggaggagaaccaagaaacaaaagcttaatctccaactaaattttgcgacccttctccactaacatgagctaccaaaacagggattgcagctctagctagccgccacagctccgcttcacccgtcataacccttgcaacttccgcccaagttctgctcttctggttgattacctgcttctcttcttcttatgataatgcactctggccttgtttgatttagattgttaagcggattatcgatcgattggattatggggataagttaaatgctttaagaaataaacttaaacaaataacttaaaacaagtggtaacgtatttttcgaagagtggagcaaataaccccgtttcaatagttcgatgaatgagatgaaaagaacagggccgccttcagctaataagctagtgctagtagtactatgtatttgtggaattgataggctattagctctgaaggtgatgcagttatatgtattatgtgctcacagcatgctctttcttttgctgtcaacattctttcagaaaatccctgagaagtttgtgcagcaacacctgactgaaacctacacaaacaaccaccagaatgccattattgtttgccctcttggcaagttctggcgagtcgaactacaacgggagcaaccggacgtgctactgcgagacggctgggcgccatttctggctgctcatgatctctccgaaggcaacatcctgctgttccggtatgaaggtaacatggtgttcacggttgaggtgttcctacagaacggctgcctgaaggagtacaaaacggcagcgctgtacttaactgatggtaccgaaggaccgagcaatgcgcctcaacaaagtaagccagtagcattccagctccgttgtagtttcaactatggattttccgtgtttcttttcaaaatgtaattatgcaggtgcagcaaaagttggagtttcacctgtcaagcggaaaaggacgcgaagaattgagggtacatgcttagagggaccaaacaggaaatctagggcttccccaatttccgtgaaggttgaaccacataagaaacatgtcagcattgtgtcacagaattcattcacaaaggaaatgacggcctatagtattcatagcctacttgtgagcgcttcagcttctgctgtttttatctagcttaactgcttatgagcttaagaacaaaaaaatgaaattaatcaacatgaaagatcactgacattttgtttcttctatttctgaaaactatctgttcaggtctaaatatggatgatttttttggtttaatacgagcttaaggaaaaaaatatagaaattatcaacatggaaaatcactgacttttgtttcttcaatttctgaaactatctgttaggtctaaatatggatgattttttttgctttaaagaaccaaatctgtaattgtaaaattgtcatacacatagagaaaaaggacactacaacatgatatcaactaaaaatgtagtttatcatgagaattttggttaaataccatcagttaaatgtcgagaatttcctgacaagaagtccttggctgtttattttgaccattttgtagtacttgttattgattctgatatgaaaatgaaaatttcttttgtgtttctcaatatattttttttgttagggaaggcaatacagaaatgccatacatattcttaatctacagtgtgttgacaataacaatccttctgatttttgtgaacgtttattttttcaaaaataatgaaacatctcactactattttatttctttatattgctttaacattgcagtctgtgagaggcaccttttgctctcaaattggtctgctagaagcctgtgcgatcacactgaagatatccatgaagaaaaaaggatcttggcgagtggctttcaaaacagcgaacacctatggctacataaatggaccaggttggagaaaattttgcctggaaaatgaggtaaaagaaggtgatcgcctcaccttcaacgccattgaaacaacggtctggcatgttgttattgtgcattgctagcacaaaaaatgaagaacgcgaaaaaatagtcccactactttgcctagcaatgccaatcccagttgtaggtttgaaaatatgtggtagaacatatcactgaaaaccagctgtatatatcggtagcccagttagataagtctgaacaatggttttgttgaatgttggtacgccagtagacgtatcatgtactgaaatacgtagtactgatctctttacttgtcccgtaccaaccttctgcagttctgcttctgccaacatatcagtgtgtatgatactaaaatctgttcataattcagctagaggttcagagaagataagagagctacgcacatgctacatgcgcttgttgcatagcagagaatcgatgctttgggcagccttttctcctgattgaaagcaaaattatcaggtgtggcttcaaagtgcaacttgttctcatcatcgaacgcaagctcgatctgcgatctatatttgtcatggtggaatgaattttgcggcactttatagatgagaacaatctctgaattctgacatatgcatactgagcaatctgctggtaattgccccaaagaagaactccctcttttctttttcagattccatgggatacagcttggcaaaaaaggaccaatgcaaatcttggctatagccaggttcttgtcacttgtctaatgatagtgtatttatgtaagatttaatgcatattgccccatcaaggagctatctgaattagaatctcatgtttggttcactgaaccaatacatataataccaatacctatgatgtcaaaatcaagaatccataatttattagcttcaggatgcttaaaggatcatttgaaaacataaaagggaaacctttattaggtacaaaggttcaatctcattgtaaaaaatagtttataactagaaagtcctaacaagttaggctagcattcatttatcaaaatttgtttttttttcttccagaaacctggtgtactatggatgtactttttccatagtaactggtacttccaaagtactgaaaaaaaaggccttctttgatagccttttcacacatcatgtgctcacagctgtgcaacaccatgtgaagattgctctcctccgtccaatgctgcccaaagaaatgacataattttgcacgtttttgttcctatcaacaaggggaaaaatgagaaaaagaataaaagactgtttctgagcctatttgacgctatgtcctgaaaaaaatgtcccttgccaagtttgaaatttggtgataatttgaaatccaggaagtgtcatagatacttctacaagcaaccattcagcttctgaaaatccatgaacaagggtgacacaaataggcaattttgtggcacatatggcggtgtctattgatttgatcatgatgtccaaatcatgcaacagtggcaagcacatacacaggctattatttgcagatgaacatgaacaggaaatctcgcggacaatctcagagtttggtacagtagaaaagcgaaagcgcggtatatgccaaaggaatttccgctttctcaaaacgatatctccaccatttcttgagaatattcagattcaccagccctgtcctctcaaacatgcagagattgacaggtcaaagatatagtaattgggtaattgcaactccactgaagaatgtaatgtaaccggtatatgtaaagcgcaattccgaggacgatgatccggtgccattggtacaaagcaacgatcttttctgataattttccaacacacaaggtccagtgacttgtcacaaatcattggctccttcttcttatctacctaaagcaacacttgccatgggaggatttgataccccagccctaaagtattgatgatggcttgagaaggggaattttcggacgttaagggaaagaaaggatgagagttcagagacaaattcaagtgatccctctaagttggatcgaatcttaattttgccggggaaagtgtgtatcacaggttcttgggagcttaagttgctgatgatccttgtcgaatgcgtttttttttactgcaattaataacattccgtatgaaaaacagcttactagtactaacctgaattttgaagttttcggtgaaatatattcatatggaagagatgtgttgcaagtgaaaaaaattgactgaacagatatatgtaaaagttaattaacagattgacaggcaacacatcacactgatttttaaaaatagaattagaatgctgatcagtgatggtttggaggaaatgtcatgaatgaaagcatcaagtgacagttgattaatgatttagtgtgacagcagattgctaggcaggaacatggttacattgctaggctggaacatggttctggcctatgagatcccaccgtacatgaaacggggacaagtaatgcgacaaatatgtttatgataaaagcttttgtcgggaaagattgtcgcgcctttcatgttttgtttttaaatgtttttattttttggttaggtccttaaaatggttggtgatatgtagctgtagaatatgttcattgcactgaaaagaccatacggcaaaaatatatttggtactatctgttggtacaaaatcctggtaatttttatggcaccaaaactccattgtactgacgaaatagtaggcaattgattttttgttttactatgcaatatttgcatccaagagactgtttagataagtatcgtccagcgagccgagcatttgatcatcttttcccaagataagcttgaatcttttgtatccatatgtcaaaccttttcaacttacataaatataacaattttcagtaatatcatgtcttttaaaacaaattaacttcataaatgttgtaagaaaattagttgcagcagaaattcagttagaggcaagaaattaagtactgaaacaacataaatgttttttttttattttttgaaaatgagatgcgatcgaatatcatcacaattcttgcaagggttaatattactcaatcatggatgtataattggaagtaaacatatatcagctactaaatagtgctaagtgttcaatcaaaactgttactccaataataatgtgattcctcaattatttcgcattaactttattaacgttcaccatcacattttactgtcaatctatagcagatctccttctaaatatctgaagaagatgaactaatcaaggcatcaatagtaatgcttggatgcaaaggctgaggtttgcataacttttaatcagtaagtccttaaattgtcatctctttgacaagtatttagccaaagaaaacatccatcgtttttctgtaaatgttggaaactctacctcgacttggtaaagtgctatgagtgaaaatagcagaagggtaaaattgaggagatccactgtggaatttcctttttctctgactttaattaagctgaacataatgttgtaatccgttacagataagctagtcttgatgatgagcttaccgatcgaggcttcaagtatatcattatatattgttaatttgctagttttcaaaggaattaatcgaatcagctagctagtaaaactaccggaattgcattgttaatttagtcgtgaagggtagccaggtaagtgggtaacatagtctataagcatttgtatgaagggcaaggctagttacataaatattttcttggtcaaaattggaaaattggaaagcaaaaaatcagcattcctgatatggctagcgagaggatgccagtctgaatcagcacttaattcacatataaactgcgtgccaaataagttttgtgttaattacctgaccagccacaacatctttgtagagttcactacttagtactgataaataattaatccttactggaacttctgttctcctaatgcaagtaattattaattcactgcatcctctcaaatcccatcaagcaataaacattgcatttcacttcagatttcagagaccaactcgttgcaagaaacatgtacttacatacaacagcagcttgtgcagcattgctcttatttagcagaataataataatacagatttacacgtccttaattacaccgattaagtacatacattgatatacacatacatatatctatatatgcataggactagctaattaacacagttaattatacaagaagagaagtaaactaaacgaaccaagcagatcaccagcatgagcagcagctagctagagagagtgacccaggtatagatccaagaaccaagatatctgaagatgtcatcaaattaggctcaattcaagcctccacgaacctagccgaggcatggaacttggcgatgaactccgccgccttcctgtcgacgtcccgctcgccgacgtaccacagcctgtcctcgtcgctcggccgcaccttcctcgacgaccgtcgcagctcgtacgccgccgccgccgccggctggtcgtcggcgatgtccccgtaacctgaaccagccgccgccgacccgaagcaagacaggtttcctcccattgtgtactcagtacagctgcttgcttaattagctacttaaatacacttgtcaagtagctggtagtgatcacttggaacacacttgtcaggtagaggaagctagctctgcttaattttggagggtaaatggcttggccctctccaatttataggggagggatggcaaccccccaaggagatcacggacggccgggattcgctcgaaccgcggccgcgccgtgatctgacggtggagattgctgcagagaacgtgcgtaccgcgtgttgtgcacgttgcgcgccgcgcgcaggggtggtggtggtggtggtggtgatgctggggttcaggtagattcttcggaagacaacggcgcgtgtgaaactcgatcagcaaagttcctagcttcttcagacttctgggtggaaggaatttcagaggaaattaatttgaaacgatttcattaatccttaggaaaattttcttatatattaactcctttggaacgaaggaatatactccatccattctaaaatgcttgacgccgttgatttttttaaaaatgtttgaccattcatcttattcaaaaaatttaagtaattattaattcttttcctatcatttgatttattgttaaatatacttttatgtatacatatagttttagacatttcacaagaatttttgaataagacgaacggtcaaacatatttaaaaaagtcaatggcgtcaaacatttaaggaatgagggagtatatgattaagaaaaataacttgcttcctacgtatgtcccaattctaaatgaaaacaaacatgaggtcttatctcatgttttgagaagtcgcatgcactctctcttcccctttctctctctagtatctctcgtccattaaattattttcaccaaccttctgtcgtttaatttgtttcgtacaaaccatccaaatgcccaaagtccaaagttcctatacagcatattttttttattgccatattgtaaagtgtgcttagcgatatatattttttcctttcaaaatccctcctccctgatatagtgatatgctaaaaaaatatttttagtaattgtctaaagggagtgcctagatccactaaaaaaactaatttgtttggaagtgtcttatattggttaatttggcattatcgcaatgatatactattcaatgataaaaaattttctaaccattacaggttatcttcatgtcttccttccagttgactccatttttgttctggatgctttcacagaaggagcatgatactgtgtgcagtgtagctacacactcttgaagtcgatagctagatgtctgttgttccactttggatgttgtagtttttatagaatatcgttatagattttatatgttctattttcggtttttcagctagatataattaggagagagatgtgggtttgtctcataacctcaagtatttatttatcttttctgagtcattggccgcatgcaacttgttggcagaggtcggggatataaatcattttccttatctaaaaaaaatcatgaaacaatagatttagtagtaaacttattatgaaaaaatggaattaagattgagtatcgcaaaaatatagatatactggtaaaattattacaaaactacatgtttagcgccaatttaatcacaaaactataatatatataactccaacataatagtagtgctaaagattaaactctaaatgtgtagttatgtgataacttcactattatatctgtaattttgctttatctcaccttaaatctatagttttatgataaatttaatgttcaatttgtaattttgtgatataacaccttaaatctgtagttttgtgaaaaatatctatatgcagttttttaaattcacttaaacttttatatttctattgctacaggtttgatgatagaaaatagaatttgatgaaaagatcttaaaatcaactctaaattatgtatataattattattttttttgctgtggccaacaagtacacaatgagagagttagaatttagaaataggatttttcttaaaattttatatctgtacttatttcattcttcctgctatcatgattgaatgtttaatatatttcctgataaatataaacttatatgaaaagtttccatggtttttctttcgaaatgtaacaatgagagttctattggtcaccaaagctgtctgcactcagctctgaatcctgcaagcctgatctgaatgaacagggcgctagtacagacaatgacagtagtgatgtagtataggcatagcgtgatgcacgcattggatatcttggatatgaaatgtcatgaatatattaaggtaataatggtggcgaaatggtattttggtttcgtttcacatgaagctgtctataagcattttaacttgaggaaataatttccttttctgaattcagatacggagcaactgttcagataagaaaagtttatggcgataagccggcatctcagagtcactaatacgttcggtcatttcaaggccaattttttttatatataattaacattcatcaagatttggtctagctatatatgcaggcgatcactcactacttgcaaaaaaaaaccagctgcttgatttgcaaacatgcaggcgtactgtatatggcctctagctagtaagtctcttaatggngtaanttncagcgtttttcacgttgcatatgtctagttgtgtctacaactaataaaagcaatgtgtacaacttgtttatacagttgtaataaacaaatagaaatatgttcacctttacaacttaaatccactcgttaactacagtttagcttatattaacacaataatatgcaaatcttttgtatatatatataattttataaaagacataaatgtacagtctagtcgtctaaatgtaaagcaatgcataccaatccgaagaaaatttccccgtttttacctatcagcttaaacctctgctcgatgaaacgatgactatagcttaattacattgaagaaacgaaatgttcaagcttttgagagagagagagagagaaatatctttcatatagctctcttcatctttaccatattcggtgcctagctaaccaccctaactagcccaaagtttcacagttcaaatggtaccttcctccttttaacatgcattatttcgccaaggtcaatgcaactaacataaaagattaattagtactaactaatcaggtaggaccagtcaaaaaggtggcattaaattgccatttcaaagtgcaaattggatgcataatatcgatcctagctagctagtagaactttcactgtctttttgagaaagctagagttgcagtgtttggtttgttctggacgccaaactgcatatataatctctctctctctctctcgatcgtgtagtgccatcatatcgtgcatgtaatgcttgcatgctgtaaccacaatgcttatatataataactagcttttaggcagaatcttatgatgataatgatcacttgttcagaggtctagctagagccgttgttaggcgagagcaaatgcctgtggacgacggatcgatgtagtgttagctatatattcctcattggtttgtgtgcacgttgtgcagagaccagaagtgtaaaacacttcttttttttatacggagaaaagccatatattctctaaattacgcggctgataaagttacaccaattgtgatatcgttgcgggctgaaatatatctctatctacaataaagaagaagaattagttgatagagataatgaaactctcatacatggatcttatccattttctcaacaaatgtgaaggataaaaggatataggagatattttcctccatcagcaaaaacaaccaccccatcttacactcagccggcctagcactagtagagaccaatcctggccaaaataattttcctcttgcagatagaacattttcctagattttttatgatatttaccaaaacacttccctcctcttctctgctagccacctgtgtcaccgcctgttgaaatatatctccatcaacagttagaaaaagattagttgatagatagcataattaatgaaaatcacatggatggacatggttatccgttttctctacaaacttatggatgcctacacgctgcaacgggaatttagaaacacttttaacaacacttgaaaaaccacattaactaaattagtataatctctttaattaaagaattaagttaaacatgagtcgaataaggtggaaacaaatggacatgaattgagatatattaaaaatataaatatttggatatatattgattataaacttaaaactgtaagaaaaataaataaagaacaacaaattgtttgatacatcaatcaattaaatgttaagagtaacacgcaagagccaccctataggaacattagtgctaggaaaatatatgaatcgagtcaataatcctaagtaagacgcatgctccaaaatcctggtttagaaaaactgaactaaaatttaaacggtttcataggcaaaaggaatggtaattttacttgacaaactaatggttgtgatcaagtacttcagtgataatttattacctccgtcccaaaataagtccattcatgagttttcgtgtccaactttgatcgtccgtcttaattgaattttttttatgattagttatgcatgacttatgtttttagcttttttttaaaaaaattaaataagacggatgatcaaagttggacacagaaactcatggctgcgcttattttgggacggagggagtatcatttaatattattacagattaatttcaacattggaagagaaatgttgccatgacaaccaaattaataaattaatatcaataatgtgcattcttccttatcaacccagagagctagccaacgtatgcatgcatgtgcattgcaaattgccttgtaattgggaataaagtacacctatatatgttttcaaaagaaaatttttaataaagcagcaccgggacaagagagtgtttaggctatgagcatttttttccaggttcttctaataaacctgaggagtttctcttctacttgcatagttgcatgccctaaaagatgcttgcctttacattaatttctttaattataccctttctttgtccttgacatctttgttaattactctgatcgaggggtttaatgtttaaacccaagacgatgatagggcctaacatattccaggttcccactcaagcgtagctagagtttgaaccttttatttttcttatcacttttgtttatcttctcgatctcttctgctttctgtagtaaaggctatgaacttattgctgtctagtcatttgatccaagctaggtcatgcatttagattcaggtgcgttcttagccactggaactcaaatcagtttccttcaccatcaagctcaaaacatttctcaactcaaattattgaggctctaaatgaggccttaccaaatgtttggtgggctgaatatatttatgctacataaattaaaggaataaattcaccgaaggcccctcaattttccttaatggtgagatgttttgaggttctttaaccacaaaaccaccaaaggccttaccagatgttttgaggggtggacagaaagcttgtcgctcgttacctagctcggctcgtgataggctcgacttggctcatttgaatttcctaacgagccgagctggcatttcagctcgttagagagcttgagctggctcgcgagccttaatgagccagagcaaatgaggctcaggcgcccagcccagcccaacagcccatccccttctcaaaaccctagtgagtgaatccccttctggcttgtccccatccccaatccccacccaagccgccgccaggcgccagccctcaacgctgccgctcctccccggtgccgatgccaccgcccgtgcctctcctccccggcgccgacacggccagccgtggacgccgccgcccgcgccgctcctcccggcgccgacaccgccgccggcgcctctcctccccagcgccgacgcggctggccatggatgccgccgcccgcgccgctcctccccggcgctgacgccgccgtggatgccgtcgcctgtgccgctcctcccggcgctgacgcggccggtcgtggacgccgccgcccgcgccgctcctctcggcgcccctctcggctcctcccggtgcccctcctcggcttctccccttgttcgctttctctcgtccccaaagctcacgagctaaacgagctagctcgagcttgctgacgagccgagccgagcttggtttctagctcgt

SEQ ID NO: 79169 - DNA, 12237 bp, Oryza sativa
  unsure (1)..(12237): unsure at all n locations
ccacatgtcagctgcacattttttttcttcttttttcttctccttctcttctctttcctctattctcttcttcaggcccaccacgctctgctcgcccaccgctactcctgcttctcgacgaactccacctcgtcgccggcgacctccttctacttgaactccctcaccatgttggccacgaagtactccaggtggtgcatggcgaagttgagccccacgcagatcctccgcttgacgccgaacggcatcatgcggatccccttgctgcccgtcacgtccactccctcgctgtcgccatcagggaggaaccgcttcgggatgaactccattggcttcgcccactcctgctcatccctgctgatctcggccaccatgaagttcaccgttgcgcccttggggatgaggtagccgccaacctccatgtcctccattgccttctgcggcagcacgaagtgccccggtgggtgcttccggagaccctccaggaccactgccctcaggtacggcataccgtggacgttctcctcggagacctcgaccttttcgtcaccggtcttcgccgtgatcttgtcgtggatatttgactggatggacgggttcttgaccagcttggccatgatccaccacaacgtggtggacgtcgtgtcggtgtcagcgttgaggaactcggagcagagcttgatgatctcaacgggcgagtgcagcggcagcgggcgagcggcggctctggcactccttttccactcgcccgccgcgtcccctgcccctctgctcttcccgcgcccggagccgccgcttcgcctgcctccggctcgcccgccgacgtcgccactccccttttttggcaaagacaaaaaaagcaaaagagaagaagagaaaaaaaggaaaaaataagatatgtgggcccgatattttttcatctcacttacatgtgtgacggagcgtggggctcctcaccgggagaccgcacaggcccccctttgccggttcggccgggggcgctaagtgaggttcttcgccctcgatctgaggaacgtccgcgagagaggaagcgcacaagacacgggcgacgtagacaggttcgggccgctgagaagcgtaacaccctactcctgtgttctggtggatctgtgtgtgaaggaatacagagtgccggagagccagacagagtttccgctctagcccccccccgtcctccccccttctcccttaggcctgggcctcctttttatctggtcaggggtcaccacatgggcctctagctgcctaagaaaggaaacatgctttttacaatgagggctagtctacagccggaagtgatctttgacaagcagagcgcacgtctcctgccccgctcgtcagcttttccggaggacgcccatttcaaacttcatttaatggccggcgacttccttgccatacttgcgctgaaccctggaatgaatctgaccgggactgacataccaactccaggagttagcacgccggctccggctagggacgagagccaggaagctctcatcattccgacgggacggggcgaggcgtgtgacaggcccgcctgtgccacctaacccgcgatctgaccggtctgtgaccggtcacacaccgcgactggtcacggaccggataaacgtgcgctgcgccgcattaaatgcggcgtgacgcgctcattcaatccgctataaatgcggttaggtgagcgccgctgtgctcacctaacccacacacgtggcgccaataccacggggagtcggggcgccccagccctcggggccgaaacgggagcggcccgacccctcggggagacagagtgtggggtggccacgtcacccttgggcccgacccccccaagggggtcaggccacgtgggtgaccgcggctgcccaagcctctagtcatgatacccccggtcccatgtcaccgacagtagcccccggcgttacgccagggcgatcgcccccctcgagggaagcgctcgggcgtgacgccactccttaggcctggtgacaggtggggccggtctctacaggcgggcagaaacccagcggtcgcaaatcgcgtgcatcggcaagggaaaaccgaccgacaataatgagcggtctcttcaagaccgctacattactcgagcagcgcgcgaatcgggacgagccggttcgtttcgcctggagacatgatgatggcgctcttctcggttggcaaacgtagttaatgcgcgcacgatctgtcccatctcaaccgccacggccgcacatctgccgcgtgcgccgcaaacgggcgagtgggattagtggaggcgtgggcgcgagaaacgagggggcgagatagtgggcgcgggaagcgaggagccgggcatagcgttggcaagggaataaagacgccgaggaagggattcgtttccttcctctcgccactcttccccttgccttcgccacctgtgctctaactcttcgtttcctgtgccctacccttgccgcactcgctcgctctcaagctcctcctccgccggcgtcatggcacggggctccgcaccgctcgatggtagcgtgctgccgccttcccgcatcgtgagcgagaggcaggccgggctgccgcgccgattcatgccggaatctgccaccggccgggaggtggtcgcgctgggcgagggacgcctggcgccagactacccggggcggtccgtcttcttcctctctttcgcaatggccgggctggtcccgccattctctaatttcttcatggatgttctggagttttatgatctccagatggcgcatctcacccccaacgcaataatgacgttggccatcttcgcgcacctgtgcgagatgtttatcggggtgcgcccatctctccggctgttccggtggttcttcaccgtacagccggtgtcgccgccgacggtagtcggtggctgctacttccagccgcgggggcaggtgctgcaccgctacattccctgcgtcctccgcaagaagtgggacgactggaagagcgattggttctacacccccctcgccgacgaagcgcgcctccgacttccgagccagcccccggcgcaggcctccagctggcgggagacggtagatctgggagacggctacgacgccgttcttgaccgcctggcgggtctgcgatcccaggggcttacgggagccatggtgttcggcgactaccttcgtcgccggatcgcgccgctccagcggcgcgcccggggcgcctgggagtacaccgggcccgaggactacatgaggacccaccaggggcgcaaatgggactgggtccctgaggacttcaggatggtggtccaacgggtgctgaatctcagctccgtggaggcatcccttatcccccaaggtgtcctccccctctgcagcgatccagatcgcgccaacatcctgatcatcatgcaggcggtcggggcgtcgggggagcgggccccccgaggccacgatggcgcgggcgggagccgcaggaggaaacaatctaccccgggagggggtcatgcttctgggccccgcgacgggggcccggggggcagccgccctgccgacgcccgggggaagaggaagcaggagggcacgcccccccatctcctccccgagggggcggggcggtgcgtgccagcagcaggcgcccggagggtgccgtgccgacgccgcagcccgagggggagcgaaagaagaaacggctccgcaagatgggggggaccgagccatgccgggggaacctcatctcgcctccgaggtggtcgtttagccgacctccccgcaggttcgtccccgcgcccaccgcgccgtgttcattctcccatctcccaaggcgagttttcactcgcccgtttctttttgtcttctggtttttcttctgcctcagcgagatcccgtcgcgcccccccgccattccaagtccggccggtttgaggccgaggagacggcgaccgcggaggcccggaggcgggaagctgaccggcgagaagccgcagaccgcctccgggaagccgaggaggctgcctaggaggccgtccgggttcgccaggctgaggaggccgctcgggaggaggccagactccgccgggccggggagtccgtccgggaggaggaggcggcgcgcgcacgccaggcggcctgccaagcccccgacccgactccgcccgaggcgacgacgacttccgaggccacccacgacgaggccgcggacgcgccgctctggcccgacccctcgggcgatgcttgggacgagccagcttcgggggacgcccccgggtccggcacgtcgatcggcgggccgagctgcgcggcacccacaccgaggcggctctcccctctgccttccgctgctccactgagcgcggagcccctcctgcaggccttagccgccgcgaacaccacggtgctggacgggttaagtgcccagatggaggtcctgcaggcagagcgggcggagctcgacgcggcgtgggcgcgcgtcgaggaggggcggtgctcggtggaggccatggtggaggcgggccgcaaggcacaccgccggcacgcctccgagctcgaggcccgtcgtagggacctggcggagatcgctagggaggtggaggaggagcgggagactgccctcatcgccaccgccgtgctcgacgaggtgcgggacgacctccgcctccaatacaggagccgggcggcggagctagagaagaagctctacgccgcccggggagtccttgacgccgccgctgcccgagaacggcgggcggcggagatcgaggcggcgtctcggcagcgcgaagaggcccttgaggctcgcgccacggcgctggaggagcgcgcccgcgccctggacacgaaggagaaggacctggcgggccgcgaggccgccgtcgccacccgggaggcaacactggcggcgcacgaggccgcctgcgccgaagaggagtccgcactccgcctccgcgaggacgtgctcaccgagcgggggcgagctctcgaggaggccgaggccgcggcgcagcggctggcggacagcctgttcctccgcgaggcagcgcgggaggagcaggcgcgccacaatctggaaggcgcccacgccgagagggccgcactggatcagcgggccgctgagctcgaggcgcgggcgaaggaactggacgcgagagcgcacagcggcggggcggccgcgggcgacggcgacctagccgcccgcctcgcagccgccgaacacaccatcgccgagctgcagggcgcgctggactcgtccgccggggaggttgaggccctccgcttggcgaacgaggtagggcccggcatgcttcgggacgccgtctcccgtctagactgcgccgggcggcaggcgggcctctggggcgggcggtacgcgaagtacgccgccaaccaggggggcctcgcctagcgcctctcagagatggccgggaccctcaagcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggacggcgcgcgcgcgcaggtccgggatgccgccgatcacatcgtccacagcttcgagggtacggcccctcggctcgcgttcgccctcgactccgacgaggagggtggcgacgacggtgcggacaacagcgacgatgaggccggcgacccgggcgcgtcggagtgagcccccaggcccccgccaatcttaataacttttccttcttcttccgaggccttcgggcccccttcttgtatagactgatttaatctgcaatcaagtaaagaggaaatttctgcgtcagttctgtttgttgtttgtatgagacgaggatggtctgtgccgtggtacttctatgtcttggcttgaacaagggctcgtgcccaggtcccatcctcaaacggcgcgggtcggggctagtgcctggggagatccacgtgtcgagactggccaggccgggagcgcggtgaccgagggttatggatgacccgattgtgggcctttgccgattcccccccggagttcaccacgccccggggcacggctcggttctgggccccgtttggcgattttagccgacccgggccaccgagggcagggtcgagcacgagcgtgctaattcaagccaagattcttcaaaaggaaaacgatggcacagacacagtccttaggaaatcgaaaatgcttttattgaaatacggaagagaaaaaagatgagtatatgcatgtggtagcccccggccaaccctgcacgcccggggggggggggtgcggggttggcccgagcccgagacatgacacccgacccccgctaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcctccaaatagtcgaggtcgtctcggcgaagctgatcttgatctgcctcgcaatacatggtgacccgaggggacctcagggtgagctcagatgggaggaccgcctccgcgccgtagatgaggaagaaaggcgtttccccggttgctcggcttggcgtgattcggttcgcccagagcaccgctggcagctcctcgacccacgagtcgccgtgcttcttgaggatgttgaaggtcttggttttgaggcccttgaggatttccgcgttggcgcgctccacttggccatttcttctggggtgggcgggggaggcgaagcagagcttgatgcctatgtcttcgcagtagtcaccgaagagctcactagtgaactgggtgccgttatccgtaatgatacggttaggcaccccgaaccgagcagtgatgcccctgatgaatttaagcgcggagtgcctatcgatcttgatgaccggataagcctcgggccacttagtgaacttatcgacagcgacatacagatactcgaacccgcccggggcccgcctgaacggacccaggatatcgagcccccagacagcaaacggccatgaaagaggtatggtctgcagggcctgggccggctgatgggtttgcctggcgtggaactggcacgccctgcaccgccggaccaggtcgaccgcattgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgatggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacatggcgcacgtaagcgtccatctgcgggtcagagcaccggtactccttacagacctggttaacgaccaactgggagtcgcctaacactaggaggcagcggatccccagtcctgctgccactctgagtcccgcaaggagtccctcgtactccgccatattgttggtcgcccgaaagtcgaggcggaccaggtatctgaggacgtctccgctcggcgaggtcaacgtgacccccgcaccggcgccctaaagagacagggagccgtcgaactgtatcacccagtaggcggtgtgaggcagctgcgaggggcccgaggtggcctcgggggcgaagacgggctcgggagctggggtccactccgccacaaagtcggcgagggcctgactcttgatcgcgtggcgtggttcaaagcgcaaatcgaattcagagagttcgattgcccatttcaccacccgtccggtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggtatctcggagggcctcgctaacgaagtagacgggccgctgcacctttcggcggggccgatcctcttcgccaggggccgcatctccagggcgctcttcgtccgagaggccgcgcggggcgcactcggcttctgtgccgacgacctcggggtcagagggcgacaggcgtggccttcccgcagtggccccgaggccatcctgggggtcgggagcacctggcaccgtcggacaagcaggcggagggccagctccggccgtcgggggccttgggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgctaggtagagtagcaacggctcatctggctccgggacgaccaggactgggggagaactgaggtacgccttcaactgagcgaaggccctctcagcctcctccgtccaggtaaacggcccggagcgtttgaggagcttaaataggggtagcgccttctctcccagcctcgatatgaaccgacttaaggcggccatgcagccggtgacgcactgcacatcctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcaatgcacatccgaagcttgccgttcgccttgggaacgacgaccggattcgccagccactccggatggatgacctcacggatgaatccggcctccagaagtcgcgccacctcctcgcggatgaaggtttgacgttccggggcctgtcgccgcactttctgccggaccggccttgcgcctggccgcacggcgagacggtgctcaatcacctccccaacttcacattgcaaacggtgggggaaaccacaatcgcgatctgtcctccccgggcaacgcacggcgggtggtcggtctggtcgaaggtgagggtaacctccgaccaccgcgcccgccgcgtagcctcatgggtaggggccgcggccagaagctcgcgcttcatggccttgaggctccggcaagaaacgtgagcgcacgctcccccatcgacggtggcgacggtggcctcaggctcctgaaaccccaggtcatcgtcgccatcgtcgatgtcctcggcggtggccttctgcttggcctcacctcgccggttgccggcgggagccgccggggccttgccctcacggcgctcctgcctcttctcctcctcccacttcctcgtccgctcagccaaacttttgaccgcgcggcagtctgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgtcggaacgggtcgaccccttcttcctcctcctgtcccgccgccctgaccgagcggcggacccgggggcggccggagctgccacaccagaaccggaggagttctaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctggatgtacgagcgaagagactcatcgtcccttcgctgtactgcatgcaagtccgcttcttcacctgggcgtggatatgtgccctggaagttcgtggtgaactgctggcacaaatcctcccaggagtggaccgacgcgggtggcaagttcattagccaaccccgcgcctgacctttcagggccatggggaagaaattcgccatgaccctgtcgtcacccccggcggcctcgatcccggtcgtgtagatctggagaaactcgacggggttgacgcttccgtcgtatttttcggtgacggtgggccggaaccttgggggccaacggacgttccgaaggctcgccacaaaggctcgacagccggcaccaccaaccggggacacggggggccggcccccgtgcccggaccgaagtggcgctccggacgaggaaacgccctccgttgcgtgggtggcgcgacgagcgtcgtgccggcgctcgatatcgaggcgggcatccgacccccacgcacatcttcttgggtcggaggcgttgacgagggaatggcggacgaacggcgggtaacggncgccgttcgccgcgcccttncgcttgacgacgtggagccggcggcggcagcgccagaggcctcggtgcggaggaccgcccgccggcgcctaggcgctgctgcgccgtcatgaccaagtcggccacgtcatccagccaacgccggctggagtctctggatcggggacgatgggcgggtgacgcaggagcgcgcccgcagcctggagcgcgccctggggcatgccgccatcgccgtagacgaggcggcgacgcgccccgtctcgccgtcctcctccgtcgctcgcgggcggcgaagtcgcagatccttcgaccccctcgagcgccttcccccgcccaagatttcggcgagagggggacggtggggtgcgagcccgacggcgcgggttctgctccccgtcgtcaccgctagcgctcggagagaggttgtgcgccactgcccgttcggccattgggctgagcgggagaagcttggcgcacacgaaaggaggacgagggctcagaaagacacgcgccccctacctggcgcgccagatgacggagcgtggggctcctcacagggagaccgcacaggcccccctttgccggttcggccaggggcgctaagtgaggttcttcgccctcgatctgaggaacgtccgcgagagaggaagcgcacaagacacgggcgacgtagacaggttcgggccgctgagaagcgtaacaccctactcctgtgttctggtggatctgtgtgtgaaggaatacagagtgccggagagccagacagagtttccgctttagccccccccccccgtcctccccccttctcccttaggcctaggcctcctttttatctggtctggggtcaccacatgggcctctagctgcctaagaaaggaaacatgctttttacaatgagggctagtctacagccggaagtgatctttgacaagcagagcgcacgtctcctgccccgctcgtcagcttttccggaggacgcccatttcaaacttcatttaatggccggcgacttccttgccatacttgcgctgaagcctggaatgaatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgactggtcacggaccggataaacgtgcgctgcgccgcattaaatgcggcgtgacgcgctcgttcaatccgctataaatg

SEQ ID NO: 79170 - DNA, 1662 bp, Oryza sativa
tatatatatatatatagatatttctgtgtatgtatatatatatatatatatatatatatatatatatatatatatatatatatatatatatatatatatatatatatatatatatatatatatatgaccaaaatatatatttacattaaagaaaatgtgtacatgcatatagaaaaatagacatgtattaattacaattcattatgatgtcctagctagctacgatttcgacgtagtagtagtcgttatctcagaagctaaggacctatgaattgtatttccgtcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaacaaatcgatacgtacgcaatgaaattttcatattatttgtacgtacatcgagctctcttgtggtgatgatttggtctgcaaggtagtggcaatactcgcacacgtagtagccgcacaagttagttccctgcttttgctttgcgcactataaataaatgacaaacggcgagagatctaattaatatacacttttatgtatttgaattggagattgaatataaatgtagagcatgtgtactcacaggaaaattgaacttccgcctaagtctttctctccatttgccgcggaccaaatgacggaaccgataccaagccctacatggagtttaaagctatgattcgtagtagtaattaaatataacaagattcttaattaacataggaacttatgacagtacctgtctataagttcaaaaaccttgtcaaacatcgactcttctttatcgattgagtcatatacgttgacggtgcaggcctccaggtcgaagagtaaaaagacccagtggaatctgcaatgtgcgtgggatgcattatgtcgcgtcccaaaacgactctaaaatacatcctcgaaattatgcctagaataattaaaatccgtgtgaaagcctccaacaattaaaatgtgcaaagttaaaagtcaaataaggcttggaggattttttatatttcctaaaagcctaaaaggcgtaaataaattttagtggaattttcagagcacaaataataattaagaagaaataaacaaagttaaaaaggttttataaaaagaaaaaccctaaaaagttccctttccctccctctctccctcttgggccggtccggccagctccctccccctccctctcctctccccgcggcccattcggcctcctgcccgtggcgtgccgctgacgggcgggcccgcccgcctccctcgctgacaggtggggcccacccgtcatccccttcctcccgtcgctcccgccgccccgcccgcgccctagcgccgccgccgccgccgcgaatcccgccgcccccgtccgccccgcgtgcaatcaagaggggggaaatattccccgtgattccctccctctttccccccatttttccctctctctctccctcggattcgtttggaaacccctcccctaacctcgccggcgccatcaatggcggccggatcttccgcgcccgtttccccctcgtccggccgctctcttcccctcccaaccctatataaacct

SEQ ID NO: 79171 - DNA, 4404 bp, Oryza sativa
acgcgtgggacccacggcgccggcaggtgcgagcccgggtgcgcccggtccaccgtggcccgtggggctgccgcgtgggccccaccccagtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttcttagtgtaaaagccttttcttttccgttggtcgtgtagacgctgcagcttcggaagatccgctcttcgtggaagttgaagccggcgtttgggaaagtgagcaaggcaagtcacatcatccttgaacatattgaatcccagtttataaaattatgttgctttaaaattattgcattatcgctttatttaaattcccgcgttatcactgttttatctagccatgcctatttacctttgttatgaccttattattgttatggttattattaccttgttcaccctaggataaacaaaaccccaactagtgggtactctattcatggtcccactagtatgaatttaggtagatgcttcgctgattaattaggcaacattaggtggttttataactctagactttgggatattcatatcacctggacactttggaattgttggagtattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtagctcagactggttataaacaaaagtacacggatggagatggacgaagtcgggggtcgatggacatctctaggacaaatgaaggctacacgagctgcggcccggtagtcgagatatcatggcacagggccggtgtcctgctgctgggggctcagtcctgcctacctgtcccgggggttccggccgtaggtggggttgggtcggtactcttgtttatggctaggatgggttgggaactatgtcacgtcttccatccgtataccgtggtggtatgtggcacgtggttgcacgtgaggaagatgtgtcttgtgggtaaagatgtacacctctgatcagagtataatctattcgaatagccgcgccctcggttatggcaagccgagcaatgtacccaagttagtgttttaattcttaaaacctgcttaacaactaaaatgtggaatggttggcctgggttggcttgggacgaggtgggacccagggtcgggttgccggttcggtctgaatcatcgtaggccttgggttaaggcaggttcgtgtgggttcacggccttgataaataatattgtatagttctagaatcgtgtttacaaaatagctttgagcaactaagtatctttaaatgctgtttactgcaaccctaaccctttatgttataactcccttgtactcccttgcatttattatgcacttgtgggtgtgtcttgttgagtacggtggttgtactcagtcttgctcaattttttcccaaacccagaagaggagtctctggaagatgaaggttttggtgtctagctcgtgcctgccgtcaagcgcctgtggtcgtcgccctagtcttccgctgtttctcgtttgtctttgtgtgtgccgggccttcgctgcccatgtaataattaactatttacgcttccgcttgttgaactctgaattgtatcaacttttggtgtaccttgcctcctgggacaaggaataatgcacgcacgtaaggaacgcccgttgggttatttccggtcgtgacacattacatatgaaacacttagcatgttcgtactgacaggcacgttatcccgcacaacccaaccgctgtgtcgtacgtagttcttggctgcttccgccggggcactaggttagccgtctttgtccactttcgttatgatgtgccgaccctctagcttcttcgcggcacctcgttgcccacgtgccctcttctgtccagcggagggttgacttccactagcctcctctacctggttccattccacatccctctccacgttcccctcctggttcccctccgcatccctctccacattcccttcctcgttcaagtactggtttggatcctcgttcccctcttcttcgttctagtactggttgcttccatccgcgattgtatcgtacattatctgttcctcatcgcgatcaaccatctgttcatacaagaaatagttgctaagtctataggtcatttttgatttaacaatcttatatgctaacaatcatatatgctaagtcaaatatgctaagtctaactgtcgtctattagaaccctacacaatcttatatgctaagtcttattacaaatctaataatcttatgttaaactttaataattttatattaaaactcaaataatattgtattaaaactctaatagtcaactatgctaagtctaagtgtcgtatattaggaccctagacaataattatatactaagtctaattacaaatctaataatcttatattaaaactcaaataatcttgtattaaaactctaataatcttatattaaaactcaaatattcatatatgctaagtctaactgtcgtatattagaaccctacacaatcttatatgctaagtcttattacaaatctaataatcttatactatgctaagtctaagtgtcgtatattaggaccctaggtaatcatatatgctaagttgtctaagtgtcatacattacaaccctagataatcatatatgctaagtttaagtgtcgtatattaactctagtagtcttaattgcattaaaaatctaacaatcatatatttacatcacttgcatgcgcgaattcctttgagggctagctaccactccggcttgagggatggtgacgacaacgtcttttctgcaacatacaaaaagatgtattaggataaacgcaaagtaacatatattgtatttcatgttcgcgttctcgttaagttcatgtttcgttcacgatcgttcacgttcgcgttctcatgaagttcacgtttcgttcacctacgttcgttcgtttacgtgcgttcacgttaacgtacgttaagttcatgttcgtgttcttgttaagttcacttttcgttcacgcacgttcgttcgtttacgtacattcacgtacaacgttaagttcacgttcgttcacgttcacgttaggttcacgttcacgtacgtttgttcgttcacgttctcattcatgtatgtttccttcgttaacgtacgttcgttcgttcacgttcacgttaacgtacgttcgttcgttcacgttcacgttcacgtacgttcgttcgttcgttcacattcacgtacgtttcgttcgttcacgatcgttcgttcgttcacgtggcagcaacggagcggcggagtggcggcagtggagcggcggcgtggcggcgcggctgcggcatggcgcggcggcggcggcgggcatcggcggtgcgcgacggtggcgtgccgcggcggcgtcgtggtgtctcggcgtcgtggcgcggcgggcgtggcatggcccggctttgtcggcactgccggcgcgacgtcgtcgccggtgacggccgcatcgaggtcggggtcggcatcgtcggcgcggcggagtcgtgttcggccgcgatgacgtcggcggcggcgtcggcaacgaggcggctggcggtggtttggggagagagagagagatcgaggtcagagagagagagagggggaggcggtggcggctctcaccccagagatgcggcggcggcggagacgacggcgagatacgacggcggcgtcggcgcggggatgccctaggtagtggcggcgaaggagaagccaagggagatcgatcggggaaaaaacttctaagtgttggtggagaagatgagggcgcgcatcgggaatatatatagccctatatctttactcccggttgttctcatcaaccgggactaaagatattttcccgctatttccaaattctttttaaacccggttagggttaagaaccgggactactgataaacgcattgaatattgatttccattacatatgtgtttctaaaatagaaaataatgcattaaaattatttaaagtcgaaaaattaatgacaattacttcgaaaaattattgttgtttgtagtaaattaagtggataaaacgtaataagcaaatatatgatttaaaattaataaaagttctaataatcatataacttagcatatgaatgatattaa

SEQ ID NO: 79172 - DNA, 17752 bp, Oryza sativa
  unsure (1)..(17752): unsure at all n locations
agccttctagttcaatatataatccctttccagtctttctatctcaaacatcacaaagataaaaaccgagaaataccaagacgataataacaatcttcaaggctgtgtagtctacacgctgtgctgaaaaatcaggtaggagagcgtcttgtacgtgcgtgcggccgcgcgagtgtgcgtgcgacacgcgcgcgtcgcgcttttggacttcgatgaggaccacgcgacgcgacgggtccgtggcggtggcgaggccgtcgcgctgcggttcccgatttcgggggggacccagcgagctctcgctctctctcgcgcatgggacggggcgctgggcgaacgtgcgcagcggcctcgggctccggcgaccgcatcatttggtaggccggggagcacgagggccgcccccgcaccccggcgtgccatccaaccccgcgagcgcgacacattttctgccttgaatcaccttccaaagcactactactcctagtaacgaccctctcgcatatcgcactaccagtaccacatgtgttccctacacacgccaaagatgcaagtgacattgggcccttggaacatacaagttcacgactattctactgggaacaagactattttgtatttcgaatcgcatccctagctcaactgcaaaaccggatataacgcctctcctaacttcaaaaattggtgcaaatatactacaaaggcaggattgggcccggttatggctcacaagacatccgacgcggcgtattgattgggtcttcatcccatgtcagtgaaaagaataaaaaacggtaggccccacatgtcagggactatctccttcctctggcctctcccctctccttgttatctcaaggcggcaaccagcaaggagatgggcgacgacgtctcctctctatgagcagtgcaggcgggggtgcctcgtcgggaggcaacgacccgatctggagtagttcctgactgctcctacccccgttcccccgtgagctcgatgaggcccacaccgtctgctgcgcctgcaacctcaagctcgagatccatagtcgtcgtcgcatcttcgagctcaatgacaccgtcgatgcttgcgccgctcgagagggaggacacggcacaccacccacgccactcccttccatctttgttgcgggagcccaagctccatctacaccaccgcaaagctcgaaggccacgaggttgttgcagtcaccgctcgggtaagaggacaccacggccagcgtgaccccaagctctcctattctcttgctctagctcccctccatctctgttgcaggaacctgagctccgtctgtgccaccacgagctcgtcggccactgggctgctacggccaccgctcgggagagaggagaccacggccggcgggaccccgagctctctcgtcgcgaaagaggccaagcctagcggcgacagtcctcttgctccagttcctcgtcatctttgtcgtgggagcctgagcattgtctgtgccacgacaagctcatcagccactgggctgttatggccaccgctcgggagagagaagaccatgaccgacaggaccccaagctctcccgtcacgaaggagggccaagcctagcggcagtagtcctcttgctccagctccttgccatctccatcgcaggagcccaagctctgtctgcgtcaccgcgagctcgccgaccattaggctactgtggccactacaccaaccctcgacgtcgcctcaacgacctgtcgtctctctgtctcagtttctcttctagatctaatgccgtcgttgcctagggtttgttcggttgaccaaccggattcacctcctagcctcgcctccgaccttcgactccttccacatcatcgttgacttctgcatcccatcgttggccaccgggtccccgccactcctgatagcggcccagactcgtgccaattcaccacaactggtcatgtcctatggcctcttgcctccatggttgcatatgaggagagaggaagaggtggaggaaggataaaagaaatgtaactcgcatatgggcccactatatatattttgccatatttcactgacatttaaggtcatgcgctaactcagcgagtctaaccgcagtcaacctaccacgtcagcaggaactgctttccaaaccatcgaaggagcatatttgcaccggtttttgaaattgggagaggtgttaatatatagttttgtggttgagggatgcgattcgatcaagggttagagatgcaaaatagacttattccattctactgaatgcatacagccggccgtggcgagaggccttggtttgaacctgggctatcactataaatcacattcaggcctcaatcctcagctttgcccttttcccttcctagtttcctagtctaggcctcaatcatacggaacccggtctagcagtcctggaccctggtcagatttgggccgaaaaacagttataacagcaccacgagtgtatgaaaatgtattaaccgattaccatccattacccataactcacgagtgctaatggttactcacaaataagtactaatatttgcatatcctttcttactataaaattataacccactaattctaaaactcaacatgcaaacatgccacctcatcatccactaacaataattacatgcaaaactaatacaagcatgcaacatcatctataattcattgaatttacatatcaacatctaatcatcctccttcacattatttttcacagtatttttaacatgtatatatccaatatttttataatccttaacatatattcatgcatataatcaaagtgcgggatatcatgtatatttcatctacaatctcatacatagtctattaaatgtatttatctcagaacatagtctgtcaaactaattttatttgttgttaataactaatataatttttatttttatctcgattattaaaaatttttaaaagttacttaggaatttccgcagcaaagcgtggggaatcacatagttcaccagattgtaagtacttaacacggctacgcagaaactgaatagtattaaaagggcttcactgaagaaaggtgatgcataaactcacacaatagagccatttcaaggcttcaagctcagtccccagaattatgacgaagtactgtaactagcttattttcttcagaattagtacatgatcagacaataaaactcgcgagagggacaaaaaaattcccagttttgttagatcacatctttgaaatgttcccgtgtgaaagaaaaactggacagtataatgatacaacaatatgtacatgacatctatgtaagaacggtgctccttagtgctccacggcagtgtcgttcttgaactcaacaaaagaatgtactccaaaaactcaaaagggttgggaaagaatggctatttcttttcaagaaacaactcaaggagaagacaaggccttacccaaatcaatataccttccacagcgtatttccgaaaaaaaaatacacattccacagccagccacaaacgaacaaagaatgcaaacggggtaaatacagatgactcacaaacactaacctttcagtattctcagctcccagaagcataggttactttgaaacagtcaatattgcacaacttgacggatgtcaccgacctcatcatccctccaaaactgtcacagcaatgggttgcaacagtcaaatctcatctggtaacaggaatccacaaagaaccgtgaaaacaaaacgagagcatataagaatacacaccgatcgatgcttctccgtggtctatcaggttgatccacactagcccttggcttatcaggatgatctatactctttctgcttttatctctcctatctatgcttcctcttggtttttcccgcctatcaacgctatgcctgtgatcaatgcttgacctagatttatcctttacatccgtgctttttcttgagctctgcatactttctgatcctatttcacaaggatctgaaggacctgagctccctgaggattcatcttttgtaggtggtaatttctcaatggccatgacaaacttttttaggtgcttgatgtattctggatatagttccagattacaatgatttccacctttgacccacagaggctcatactttattttagagagttcccacagtgccctcccatgagaacagtcgacaacttcatcagctgtaccctgcagatgacataattttttgttcttttagaaaaatatttgtgtacactatacacgtagctactcaatagtcattcttcatccaaaacatcataatcagaatatcaaaatagaaacagccatcaggcaacaattacaagtgtgacaatggatgaaagattataactgatcagtaaatacttttgttgttaacatacaaagttgaacaagaaaagggtaaaagaaggtcaggaaaagacaaaaaaaaaaaagaggttcatttcgaagtgcatattgaagtactccaggaaaatgatatagttgtcagatttaaaggcttcatgctaaaaatgatatgagaagaatactcacatggattactaaaacaggacatttgaccaatggaactttatcaatattctgcaaataaaaaagtgcatattagatctagcaaagttaagattgacataaacaaagaaatgttatcaccttgtatatgtcaaaccagtatgtatgctttacaggatacatcactcttaagccagataaaatagggctgtgtaaaacaacagccctcagatgaggcaaacgggatgccaaatctaaagtaggaccgctgccaactgattgaccatacagaatgatgttttcctctgtggctccataagtttctactagacacctatatgcagcctctatatcagaataagtgttctgctcacttggctgcaacaccaaagagaaataaatccatcagttatgcaaacttaggagggaaagaattcactaaaaggaaaacgaaatgggtaaaaaaggaaggaaaaacactttcctaagaaaggatgattttataccttccctgatgattgcccataaccggaataatcgtaactgtaaaaatataaatatgaagttactttatgttaagatatcagtgaggcttatcacattgaaacaatcatgactagagaaatatcaaatgaagcttatatcataatcatgattcagtgatttaagcaagctatgcggatactgaatgatcatcaaaatcaacaaactgtaattgccatcatgtcaaagtaaaagcataatagaccacaaccaggtccctaccaggataacaaaaaaacttggtgataaacttttcatattactaaaaacaaatgaccaatatgagtagttgaatgggaatgcagaacacagcaatcgatcaacatgataagatcagaaattggctataacgtatctgtgttagatccaggtaaccacccaatgactatccaacaaacagatcatctgccagcctatccattgaacgtagtcatgggatcaatgcctacttccttcactaaaaacctagtactgtattaaaatgtaagtatggaagggagctatagacaatatttccagtattttttattcactactacacctaaaccagaaataaaaacccagactttaattgagaagagccaaagggcaacagatttaatggaagcaggccaacagaacgttcatcaaagaaccctctcatagaacatgtatttctatcgaaaaactggtaaatagaagagttaagaatcaaactatgttctaccctccctctaaatgggtgcaaatagtcttaaaatgtcctgatttatgaccaacgttggcacacaacttgcaatacgataagatccataatttaaacttaatttatttaggcgattaacttctgtataaaaaaaacagaatggtatacagtatcggtgtccaataaaaatcatatacaaatatgcacatcaccaaatacaccacaaggcacatacatcaataaacaattctcaaaaaatatcagaatataaaaacaactcgtcatcttaccaatcctttgatataagccaatgaggtgttatttttatcaaatgtggcaactacattgggttccactatatctaaatatctaatctaccagttccataacacccattgccatttaacaccagatcacagggtactaacagcctagtactagtgatatgacgcaaacatccccacctattgctaggacagcacagtaacctccaaactttccagtcagctctaaagcttagtacataaactaatcatcaacttcaatcaaatctatcaattattcaccacaatagcctcacttttcttgagccacacagccggataacaactgccgtgtcagacattcccactgatgcaacaacacatgaatcttccaccacacttcataacccaatacacttcgagacaactatgaatagcaacagtagcaatcgccaccttctgcgaatacaaaaccaatcgcaatcacggccttgaacattatgaaatcttccatgattccatcaaattcgccaggcactcaaatcaaattagtaaaaagtaaagagcaccgcataacacatttttccctcgaactaaaataaggccaatggcactatacctgaaatataactcctaaactgaaatgcaaaactgagaacagtagtggagaccaaaacattgctacccatccatcacaagatcctaaacacgcacaatcaaatgatcatgaacttcctacaaactatacttcagagatccacactttcgcctgaattaagcaactagtatgcatcataacgcaaatgataaagaagagggtcacgttccaaagcaatccaatccgagagagagagagagagagagagagagagagagagagagagagagagagtgacgtggcgtaataccccatgaggttgacgttgaggtgggagctgagctcgacgaagagctcgtacatctggccgaggtcggcggcgttgccgtgggagtagagcagcgtgaggcgcgccccgggctggcgcacgtacatggccaccacctccgtgccccgccccgtcggcagccgccgcgcctccaccccggcccgccgcggcaccccgctgagctccaccaccgccccgtcctccgccgcggccgccggcgacggcgacggcggcggctccacgccgtacgacggcggggccggcgggaagaaggcgaagcgcgccgacaccgtagacgccaccgccccatccctccctccccccctccctcctcgccgccgggcacgggcagtgcagggaggaagagcgcgctgctgctgctgctcgctggagatggtgctgcgttcgccggggcgaggagagctcgggtttttttttttaatggcggattcttcgcggaagctgcggcgatcggagaagaaaagggagacggcgagaacggcagcagaggggtggcatagtataattagtcattaaaaggttaatgatgttgattaaaagagggattaagcttcaaaagaaaaaattactgtaactctttcctatcataaataagtggcattctcagataagtgtagttaggattagaatataagggttactgtgccactgacatatggatcatatcgaagtggaatatatatatacagagagagaggatataaccataagttgcacgacgttagaggattcactttcatgtattgtagttaatatgcttctaactttgaccatcagaaattctctctgaatattttgattcaacttttcaaaataatatggttagatttatcagcttcaaaatattgtgacattgatatattcttcatactaggttttactacttagtaattattaaataaattattggtgataatgttggtttccaaaatatcacttatttatgactggtgggagaatgagcaaacatgaggattagcgaaggcctacaaagcgtgttacaaaaaatgtatagaattctcatgtaaaattaatacgaaccactccctcaaacgttcacaaaaatcctttaaaattcacacgttcagagcaaaacctcaggctatttgtttgctatagaaagttggtcattctagttggatgattctctattgtgcaatcaacatacaccttttgaactttgaaggaaaaaaatgcccatacataagacttgggaattatttccaacaccgacaaaaaaaggaaaacaaatttgaactttgaaggcgagttgtaaaacaagagcaagttgggggcgccaatcttggcgacagccatgataaagatgcggaaagccagcatgtgaagcaactaagcttagcttagcttaagcctaatcttaggcttaggctgcggccggtgggggcgttacgccattgctttctgaaaaggacactgtcccctttggctaactgcaagctactactgcagcttaacatctctcactatcaggtggggcccacctttgacagatggctctgctgttcagtatagtagggtcccaatttggaagggttaaagagcttttgttgtttttttttaattattgaagcagattatttgcttcacatttaaagaaaaattcaagaaaactttatttggttgtattgtacggttataccctttatgttttgagctacttgtatttgttaagattatttttaaaatattaaatttatccatataattaagtaaaaaatttgtaacaacaacccacttaattatctattttaaactcagccttaaagctaaaccaagtaattgttcttcccttgtaaactctcagacagggtgtcattttcagctaagatatataaagaattcagttaagaaacagtcaggttttaaggagacttgtttacgctttaactggcaacgagatccggtaacgagattcgcatgttacgtaggcatctcatcctggaactgaaagcgtcgatctggaagctaatgcagtaattaagctttaggtttaggtataaacaaatgtgtaatgtgaagcataagccacggggatgcatgttactgccacgcgtctctcgttggagatatattcaggagcatttttaatggcaaacaacttcacatctcaacaaccagctcatcacccaaagcatcatcctgctagatgaaagggtttacaggtctattagttcttaatgtgatcttaaagacagtgtacactaacactacactatactcctactaaacttcaatcggaagccttgattagagcagtgaaacctggcctaatgtgtgaagctaaagaaaccggtaaataactaagcataaaacaaatatcccgtttcaaccatccagtaaataatctaaaaagaatttaggggctgtttagttggttgccacactttgccacgccacactttagtcatgccacagtttttttaggcatgtgtttggttcgctgccgcaattgtgttatgccatactttcttaactttgggacccacatgtcatgctctcaaatttagagctaagcatgccacacttgtgaccaactatttctaagtcacatttgtaccaccatgctacaactagtctaaacttaggtatggcaaggttaggcatcaaccaaacatccccttagacttcaacttctgttccttggaatgagacttcaaattcacatgttagtgacagcgcaaacgagggatgattgcacttgaaaatgtgtactccctttcaaccccatcgtttggttgtttggtggaataagccaaacaacatatttgcaaataaaaaataatttgtgaataaaatatttataaacatattctaaatgatctaaaaacaaaggctgaaaaataaattacaatgaaaaacccctaaaatcaactccaaatttagagttgaaaatttaaattttggttgataagcataagaaaaaagataaggttctttgttttataaaaaaatacaatcctgttctaggtttattttttttaagtacgaagggagtagtacagtccaattccagttgatctattgatgtaaatttatggaagtacaatgatggttcttgtcaacacataaatgtatagagtaattaggatcagtttacatctggtactactagacagaaattccctatcagtcaaggtaacagtagtacagacaagttggagatgtcacttgtttctccaaagtgaatgtaaggggttgtttagttcacgaaaagaaaatttttggatgtcacatcgaatgtttgaccggatgtcggaagggttttttggacacgaataaaaaaactaatttcataaatcacctggaaacagcgagacgaatcttttgagcctaattaacccgtcattagcacatgtgggttactgtagcacttatggctaatcatggactaattagactcaaaagattcgtctcgtgatttccttcctaactgtgcaattagttttttcatttatctatatttaatgctttatgcatatatccaaagattcgatataatgtttttaagaaaaaaatttggggaactaagttacttcttaactgaagtagtacacctcaactggcagcaacactgctaagcagtgacccactttctcaagaggcaataattgtgtcttaatccatgaaacgaaaggatacatgggcaaaaatcttgtcccggtaaacaagccttgtttgtttagataaaaaaaaattagccaaaaacatcacatcaaatgtttggacacatttatggagcattaaatgtgaggaaaaaaaccaattgcacagtttgcatgtaaattgcgagacggatcttttgagcctaattacgccatgatttgacaatgtgatgctacagtaaacatttgctaatgacggattaattaggcttaatgaattcgtcaagcagtttacaggcggaatctgtaatttgttttgttattagtctatgtttaatacttcaaatgttcgtccatatacttcaaaaactttacacccaaagaactaaacaaacttataattgattattgtcttgctgaatgcagatgagtgtatcattcggttgaatcatctgcatctgcatgtccaattaagcagaaactgcctattaccacattcagtgcactgatactagtctgttcagtgaggtcccatttctaatctgtcaactgttctgtacagtacttcttttttactaagtttgcttcttatgaaggacacagctcatactaactacagaatgatttaggtccaagcttttgccaaactatatagaagttacatctgcttcacccggttgttaatctgcattcagatgttagttgtgagttatggtagaatcaacttactaaatgccttacacagtcacattctaattgctcaaacaccctaaagtttttcttttactttctgacaagaccttcaacattgacaaggtgggcaactgggagcataattgtttttccaagtgacgtaatgaaaacaagatgattgttttcgccaactaagtgttttccaattctcagctagcttgcaaatcagagtaaattatttttcaacaaaatatcatttggggccctctatgaattgatctctgaatgattcctgaccaacatctaaacttgtggctctaaaccctccatctgcaatctgtctatcataatcatacataaattaattgccttcatgtcaagaatttcctctgattcaaactcatcaatcatatattatagtgtcaacataagaatgcaattttgctagtgccagaagtactttgccagtgactgaaaagataagcctatcacaactaggaggattctgtcattgtgcccaattggctggatgtgataccaagtatcctaacaagagaatattagcgaaaaatacgtcagacaaacttcaatgttcctttcaagggtccctcatatttggtagtgctcttatgcataatttgctctgttgattgcttggagccttgacctttcaagatgcaaagagtatcagctgagcttggtacctcctgttcaccagaaggcaaataagtagtgttatggatctttctttctgaactctatgtgcaattctaagattggcccagggtagacactctgatgcagtgtgatgaaaatttagcattgtacttttcaacatcattggaaaccagagtttttcaaaagtaaattaaattctcatattgccttaattcaaacatgcagagacttgacacacaagtgaaagtccgaaagatggcaacaacagccattccaattttaaatcgacactgagtccaggttcacatagacatttaactcatctgaagtatttttgaaactgtacattattgtaaaccaggcattttaaagccatacattgcttgtggatacaagaacactaacaatacagatatcgcgagcagctcaattcgaatttgagccggttcgcacagaagccacgcagattcaaccatccaattcattcgagtgactggaacctcgaccgctgaccaagaaatcttcgttcgctggattccaggaaataatttcccttcacagcatctgtgtctcataacatgaagccacgcttccttcatcactgatatttgatgacattcctttggagtctgacattcatgcctcctcttccttacggaagatattcattgcatcgctgtataaagcaacagaattggagaggacagcaagcacgatcatggttacagccaagatcttgtcacgcttggatgcgattccataaggatccctagaaaaaagaaagccaaaatgttatatgtcaatatgaaaatgcatgaacacagagggaatatataacacatcgagacataatttagttacctaagtataaccatggcagggaagatgaaaccaatcaggacagcagcagttgcaccagtaaactggaatgcatcccaaatgctcggtatgaaaatggcagcaagataaattactgtgaggagtgagatagtgattatggcaaatctcttgttgtcacgagaaatgtgccttgatgtggggaagagcagtccatccaagttgagcctaagggcaaagaagactatgggaaagacaagcataacgtgagcagcatagctcactcgcactatatcatcaaagacggaactaaatggaatcccaagatttgcatcgaagttagcgagaacatcatctagggtaccctcgccgaagaggagatatgcaaagaaacttgtagcaatgtaaacactggagcagaggaacagggatgttcgcacaataggtttaatttgtgttctgtcttcaagctcattgtcaatgctgtgaactgtgaatcatgagagcgtgcatttagacatcagattattgaacacttgaaaaaaaaaggtctgagcactgagagtgcataccattgtaatggcagatgtaggcagtgacaagaacagggacagctgtgaagagcttccagatggaactaagaccatctagttctggaaaaagtttgggcatcgctacagttccattgaagagtttgatgatagcaattccagcagtaatgacgacaaaaaccacagcaagagcaaccgatagggcagaggtgtatctcaatgaatctacaaggcatgacaattgacaaaatctataagtaacatcatgctgccaataacatcaaatacaatgaaggatattttttctttaccaatatgaaaacactaagacgtacccagacgcttaaagctcaccaatggagcaaacacgaaaagagtcgtcgcaagaagaacaatggcacgtgaattccagagatgagctccaaaccagccctcaagtataccacgatggtgaacaccggttgatgatgttccagataatacatcacctattttacaaatttaagaattaatatcgacttcagttaggaaaaacaaagttatctgtcaagacaggtgttgttaggaggaattatcctatgactccacatagcttagaatggataggtcattgtttcttttcagagaagcaaagattccagttggtagtaaaaacctgatcaaactagctgacagcgatgacaaattgtattggttttgcttgagaatgaagtgctaagaaatccaagcctacagctaagctctaaacctctaaataaaaatcacccaaaataatggggtttttttcacaacaaaatgtttggccctaagttaactacactagaataaaagatgttctacccaatctgtagattatttgcacaaagtccagctcagcaatttttggttgcacatctaaaaaagtcaaatgttcaaatgtaacagcagagcatagaagggataccaatgataatcatgtaacaatcatcacgccaatgttgtttatgacgacagaggcctgcagtgcaattcttccccactgtccgtaagcctcacccattagccaaccataagatgtaatcttgccctggtggctgcacctgacaagcatgtcaattgatgcctctgtgagcaacgccacaacgatgatcatcagaatccctgggatgatgcccaacatcttgatactggctggcaaggccataattccagccccaacaatagtggtcgataaattgaaaaccgccccggaaaatgaagctccattgaactcatgaaacccctcctcctccaccttgaccggcagaagtggtgttgtctcatctcgtgtttccttttgtacaatctgctggctcccattcggcgattcgctgctgatccccattatgtctttcactctcctggatagcaaggattcagtcagatttttatctggaaaaccaagtatgcttattatcatgcatctaactttctttgaatcagacagttttaacttggtttccatttcttatgctgttcagctttaatattccccaaaatgaatgtatcacatttttaattaatgcaagtatggacttatggagagaagaaatttctgatactaggtactcccttgaagcaagaagttcattctctcttctaccaaaagactttaagaatttagaaacgcaactctctaagtcaaaacataaagtaaataaaattatatccagaatatgagacaaaacgcacaaagaaacaagctgcaagatcatgttagaccaactaaagctcagcccaaaaaatccaacctttccaccacaattcacaaccacgggcataagcctacgaggctacgacacggttgtacgaatgatacttcaagtccatcctaatcagcatacatatccaaaatttatccccaaaatcactgcgacccacgaaccagctactcagaaccagtcttctcctagaattgatcaggaatcccaccaccgacacaaagccccccaagaaaagcaacgatcttcccaatccaagcaagaatcctcaccaagaactcaaaactgaagcaaaagaaaaggggatacctgataacttcggaggctcagtcccctcccggatctgaaaccagcaagagcaggcagaaccagacaaatcgccaagaaatctgtggagggcggcctcgccgcagcccggctgcggccccgctcgttttatagccaggggagacgaagagcaatcaatcaaccagcttggatccaaaaccactcgctttcacaagctacagtacttctccttgcccccacctccacactgtgatttccgtcgacatcaacggcaagagagggaacaaaaaaaatatttccgaatcgagaacgcgcgatccctcccctcccgtcgctgtctttgctgtcgtcggaatcttgtggggggcgcagggcagcgagaggtggtatccgatgattgattgatggggtcttgcttgctctggtcctgttgctgctttcttgccgtcttgatgttcctctctcttggctgtttttcctcgcttgctgcttcgatcgatggcggcgcctaaccgcgcccgccgtgacaaatgtaaaaacgggggagcatttaactatttgcaaacgtgacaataaaaaatttaccacggtctataacaacacgtgacccttacatgtgtatatatggtttcatttatagatccttaattatcgcttataagattgacaaatagttaaatatctcatagaatggtaaggtctaaaagctcacgctcacataaaaatagcgaggtataacagttgcaccatccgttccaaaaacaatcgaacttctgaagataaatttggatatatagattcatcctagagattggttctttttaagaactaacccctcattaaaaaaaagcccaatcttaatgagaatgggacatcactgcaacaatgaatttaggcaacccgctgtccaaattcgttgtcatagatagtgtgatatctcatcctcattaaggttgggatttttaaaacggagagagtaagctaatataaccaagacaagtagaaagtttttttcggcatgtacttccttcgttttatattataagccttgctagtatttcccaaattcatataaaatgttaatgaatctagacatatatgtgtatagatttagatgaatgtgacaaagaaagtattataatatgaagtgnatgaggtacgtcccacttgtgtcaaagctactttaaaaaaaatgnggatgttatttttttttcttccaaaattaccactacaaaaattggcaaggtaataaaataaaatattaccaaattttgtcttcactgtgtttggtaacaaaccaaatacaacctacatttcttaaccataccaaatattaataccaaaatttgacaggtagcaggatggtcgtaaaatgagttggtcaaccaaacaaccagcagcagcagtagcaggatggtcgtaaaaagtaacacatctcaccgaagtctttacccacggtgaaccactatttagggcttattcactttgctaccattttcaaacttaccaagttttagtattgccaaattttggtaaggttgccaaaatttggcaagatttcatacgtactcactaaaatttggcaacaaaataaacgtagccaaaattttggtaactttaccaaaaaatggtatggttgaaaatgtaatcaaagtgaacagacccttggatgcgtatgatattaaaatggcggacaattgtcatctatcgaaaaagttaaactatttcataaccaattttctttgattaaaaatcaactatcgaccaaaaacataaaacaataatgatttttaaaaaagggggcaattgcttatttaaccctgttttgaactgtaagtgccaatttgtccctactttttgaactttgcttatttgaccctcctttttgagtacgaaggtccggtctgaccctattccgtttggatgaggtgacggtgttaattttgtggtaaatagtccattttgcccttgcttatttgaccctattttatcttgtttgcttgcttgtttgatcctattttgttttaccgtgtatatattcaagaatgttgaaatatttgtaataatttttgctcaagaacagatttggcattaatttggcaaatttgaatcattttgtcaaatttgacttaaatttgacagaattttgtgaaaataaattaaataaaatatgtcacaattatgacagatttgccataaatttgaaaattttgattcattttgacagatttgactaaaaagttgtcagaattttgacaaaatgaattaaacaaaattttgacagcataacttctcattttgtggattccaaagtgtattcaatatagcataaacatatagccaaatccaacaagttcatatccaagcatgtgacaacatacatcagt

SEQ ID NO: 79173 - DNA, 877 bp, Oryza sativa
tatatatatatatatatatatatatatatatatatatatatatatatatatatatatatatatatatatatatatatatatataattctactacgacggaaatacaattcatagttccttagcttctgagataacgactactactacgtcgaaatcgtagctagctaggacatcataatggattgtaattaatacatgtctatttttctatatgcatgtacacattttctttaaagataaaaaattttttggtcatatatatatatatatatatatatatatatatatatatatatatatatatatatatatatatatatatatatatatatatacacatatgcatttgcataacatatatatatatatatgtataaatacatatatattatgcatgtatatgtattgaaacatatatatgcatggtttttatatatatatatatatatatatatatatatatatatatatatatataaaccatgcagcaacagggccatgcaaaaaaaaaaggtcagctcgatctttagtcctggattggtagtcccggtttgaaaaccgggattaaaggggggttacgaaccgggactacaaacgctttctccaccagtgtcccttaacaacaaaaccagaaatgtgtacccctaaactcactcaaaccgttcaaaggaggtcccatggcagtatatatgggtggttttcattgacgtggcatccaaatcagcaaaaaaaggggtccacattgtcggtgacatgggaccgggggtatcgtgactagaggcttgggcagccgcggtcacccacatggcctgaccccctcgggggggtcgggcccgagggtgacgtggccacccctccctctgtctccccgaggggt

SEQ ID NO: 79174 - DNA, 1077 bp, Oryza sativa
gttgcttaccatgcactttgcattgcagagctctatttcacccacttcacgtctttgatgcttgttaggctgtaaaactggtttagcttacatatcaacggcatttaatagtactagatagaaggatcatgtcttaacagtactggttaatagtactggtttagctttgtaatcctaaataaatgttctgatattcaaaatttcaaaagttaacttcagatttgcatcaagatactattgtttacgttgtttaggatcaacatcagaaggagagtagaaaagtcgttttgaaggcacaggcagatttggtattcaagcagaagaattacgccgctgcagcaaaaatatatgatctggtaatttcttgcaccttatttctgattgttaacgctaatcaattattgttgttataaagtttttgtatgttattcttaagcttgggaatgatttgtttatctgatgcttgagcataggcaatagctcatggaccgactgcagttttgtacgcaaacaggagcatctgtagattgctcatgggtgatggtgaaggtgctctttctgatgcttacagatgccgaatgatgcggcctaactgggcaaaagcttgctaccgtcagggtgcagctcacatgctactcaaggtaagactcactgcagttaacgttttgtgatcctggtattatggtcggtgtcctgaactcctgatttactctaaaaccaggagtacaaacatgcgtgtgatgctctcatggatgcacaaaaattagattctgggaatgtcgagattgagagggaactaaggtaatcttctgtttcgctcgagtatgccttccaaataaaaatgtggttgcgcagggaacatgaccattagtactggcattccgttgtgattatgcccacatttactgcaactgaagcaactcaacactcaactgttcttttcggttttatatgccattcttccatctttgggtcaattttacgctttgggttgttataactgacatttttttggtccaaatcttttgtaggaaagctagggaattaatggcgaaacctccagatgagcagtgaggc

SEQ ID NO: 79175 - DNA, 1144 bp, Oryza sativa
caatgcagttattctataatttgagccaagaagtttcagggaatgtttctgcatgcgcacaaaaattcaaaagtacattttattcctataaactatttttgccacaacattgttgatttgttgtactaccctaaacttcgctcaacaaactctatatacctttattcaaaccctgattctaagaggcaccgaaatataatttcctcatgaaaaaagggcgaagcctgttttgcccgtaaactctactcagtccattttacacctggcctaaacataaattcagttctcttttacctcttatttttaaccaaccgttacaggatgtgtcaatttcattgaatatagtagtagtaaaagttacatatacatgtatgaaagaactataaaaagggacaactcctaagatattaagttcacgaggtgttttgctcatgcctaagcccaaattttggcttcgattgtctttcagagggaccttttttttttctatcggagattgcgtagacttttggcgccacgtttcttggacttcttccttgcatccatgctgagtttcaaaagagaatagttttcccatctccagttgttattgctgtcgttgccgtaaagagtagcttgtcggatttgtcgcatatccagccctacttatgtctttttcgttgccttccactggtgcgctatagccatcttacccttagcgctctcgagaactttttcaggttaagcaccccagccctctataagctattggtatacaagttcttgttcagttgactttacatttttcgctcatgatgttatcagctcttgtccagaggaaccgtttgtttgccaagcacttcttttgagagaattgtttgagcccgaaatgctttgtttgagagagtttatcgttgggttataggacaattacccactatcaattgtttatacacactacctcttttgagtatttttcttgtttccaaaaacaaaattggtgctatgtatgcagttttttatgagctaaaagattcccttcgaatcatgtatatatcacatctggtatgatgagacatatatatatatatatatatatatatatatatatatatatatatatatatatatatatatatatatatatatatatatataaaaatat

SEQ ID NO: 79176 - DNA, 1241 bp, Oryza sativa
tttttccacgtttaatactatatgtatgtgtctaaacatttgatgtgatagatgaaaaagtttttgttttgggaactaaacagggcccaagtcgtgtgcagtgcaccggtccgcttccgtgcgtgtgtgagatgggcgttccagatcagctccaagtttgcttgaaagcgtcgcttctcgttgcgttgccacttgccaagcagcagcacgtgaattcgttgctgttatcttatctatcctggaaagcgacatcgccccctgtggcttggagttgcacgtattccattccatctctctctcacacacacggatcgacgatccacgatccactgtaccaaccgcggcatatgcttaccttaccggctcctacccccaccagcatataccacggttctaccgtagttgtacggttcagacagcgtgtgatcggcccacccacatgcatgaaccagaagcattcaatcaatcaaacaaacaaacaaacaagatcttccgcgcaggtgcaccagttttggctccaaacggggacgacgacgcgacccacttgagcctcgccctccagcccatcgatcgatccccctttagctgagcgaattattccacaagttccacgacgacgacgacacggccgggcgaggcaggcgtacatatgaacagcgcgacgcggccggaaacggtcgcgtacgtggaaacggccggtgcgtgccgatcgatccgtgagccaccttccaggcgcgcgggagcagaagtgtactatgccattggcagcgacggcgagcgaagaccgcgagcgagctagtggacacgggaggttgctctcgcggcgcgcgggaggggaggagaggagagggagaccggtggcgcgggtgcgctggaccggttcacgccccgcgtgcgcgccggggaccgaaatatctgtccgcgtcgtcgatggccggtgtcgccgtcgagcgagctacggaccaaaacgccgggatctcgaaggggcgcggcgctgcttacttggttgcttgattagttaagtttatccgccctccgttttacgcttttctgtttcccccggttatttaagccagactcaagtttctcgaaatagaatttaaggaagggtgtgtttcacgtcaaaattgaaagtttggttgaaattgaaacgattcgacagaaaagttgaaagtttgagtgtgtagaaaagttttgatgtaatggaatactttggatctaaactcggccatgggatgcat

SEQ ID NO: 79177 - DNA, 6113 bp, Oryza sativa
gtcacggggaatgtcaccggagcaatgtcaccgaatcccaatccatatctaagataccaaattctttagtataaaactttggtatattttcttatggaccgtaaaatttcttcaataagggtacctaccttgacggtgatccattaatactagatgatagaacattatgagccagaaaaatgtatatgtgtacaaattgtttttttaatttgttctaaagataactagatgaattatattatcatgatctacgtattttacatcacgggccacattaaaactaaccgattagtataggagtatgaatttaggaactatcaaatcatgaaaagctgcaggtaagactccaccatattgagtaaattttgcaattattgattctgaattttataaaatagtgaaaacatgaaaaatattataattgagaccccaaattaaccggatacaactcgttattattaattaagaattttgaaatttattaaatcatgtcaaatctaccaattcgaatagaacttagtttttattgattttgaatcttaaccttataaattaatacatgaaaaagctagcactaagactcaaccctaatacaactcgatattattaatttcaaatgtaccatatcagaaaaatccctttaattatcctaaaaaaaagacttagtatataaatattaatataatagctttgcagtgcgcggtttagagactagtttgttgataatccaacatggattgtattctttagttatctctctgttttttattacttgattgaaaattttctaaaaaaaatatgttggattttctttttccacttagttttgaaatagagaggaaaacaaacaatacagaatagttagttgaatggattcaaaaagaaaggagtttcatagctaagaaaatagatgttagaaccgaggttattttgcaaccacgtttatacgaaaaggtgccaaatgcaacgatgattgagtgttgagctccagttttcttttggtttcagccagaacattgtggaaactttgggggggaaaaccgtgcttcttgaatgagagcttcccaaagtttgattggaaattactgaaagattgttcacaaatatcctcggtcggtttgagacccccctatttgaactcctacttcatatttcaagcttttggacctgtttggcatagctccagctccagctccaccccttctgaagctggagcacagccaaacagtttcagctccactaaaactaggagtggagttgggtggagctctctcacaaaatgtactagagttgtggagctgggtttaggtagctccacaactccactccaaactcaatttctgaagttatatttagaagctagagctataccaaacaggccctttgagcattttcaaaaatgcatagcttatacaagtgcatttggttcaacattgttttttttcaataaaatgggaacgcgcactcgagttatactaatatgtacttcctccgttttttaatagattacgccgttgactttttctcacatatttgaccattcgtctttttcaaaaaattacgtaattataatttattttgttatgagttgttttatcacttatagtactttaagtgtgatttatatcttatacatttgcataaaatttttaaataagatgaatggtcaaacatgtgagaaaaagttaatgacgtcatctattaaaagaggtagtatttagctgttacacgcatacacacacgtacacaaacacgtgcgacgctagactttgacttaccgagcttacccttttttttttggcagcgactagctaactgtagctatatactccctccatccaaaatgtttaacgccgttgattttttaaaaatatttgaccgttcgtcttatttaaaaaatttaagtaattattaattttttttatcatttgatttattgttaaatatacttttatgtatacatatagttttacacatttcacaaaagttttagaataagacgaacggtcaaacatgtttaaaaaaatcaacggtgtcaaacatttagagatggagggagtatgtctttcgctagatctttacctgtgctacacttacgtgtttaataattaatcagtcgattgatgcatgtcatctagatgagccaggtgtcgatatatccttaattaacgtgttacgcattctggagtagtatgtttgaatattcaagggctctaccacatgcgtgccaatatatatgttcatttacatgtttaaataagaattatgttgtgccatcttgaccaagtcttgcacgctacacgtacaacgtgtgttaagtcaaactagctaagaaatagcagagaaagctagatgttgtgcacgtgcgaagctagttagcagattaatcatgctgattatctgggaacaatcgatttcagaaaaaaatatttcaatagatcactagtattagtaagtggcataaaaaagaattgaaaaaaagattgaatttacgtgtagatttggacctaaacagaaagaaagaaatgttttgtgagaaaagggaaatagctgagtgggcttaaaagtccatcaagattcagcccatccagctcattttaggaggacaaatggggaagatgtttttatagatgcctttcctcgtgttcactctactcgtctattcgccacagtatcaaccttttttaattttctgttagcatgttttttaactattaaatgatgtgcttttaaaataaatttattttttaaagtttataatagttaatatttaactaaacatgtgctaatgaattctcttattccacttgtcctgaaaaatctccaatagaagagaaacgaacgggtgggacctataaatattttgtattttagccccttctattgcactagtactccgaaacattgcactcaacaccctcaaaactacaaaataatataaaatattactcctcttaccatcaccatcctccacccgtagttggcgccggcaccatgccaccatctcggtgcggaagaagccaataaggatggtggtcaatgagctccccataatatggggtagattgggtcatcacctctccgtcattcccttctggcccctactcccgtcatcgatgacgacaccacccgccgccaccaccccttcctaccccgctttgaccacacgctccccgtcaccaagttgtggtcttctcagccactgcgatctccttacccatccatcgtggcatgacagagttgtctcggtgacaacgcacctcgagctgacgatgatatgcttatggcagttgatgtatggtagtcctctatggcttggttgcgcgagcatatcacatattttggggatggtgatggatggggatgtcctgaaatttctcagccgcgtgaacgttgccctacgctaggacacttcactagcagcatggcatccatgccttcgccaagatacaagtggcttcgtgggagcacgatagtggcttacgtagacgagaatcttctagctggatggacactcgtttctatgcatcctcgtcatctatccgtgaacagtgtaatcacacgctagcacagtgacataaaacccacctgatgatgttctcaatacatccctctcgctgcatgtgattcctatgaggaaaagggattaccgttgcttcaacaattttacccgccgtatttgtagacaatgtagattgtaacggttgcctggcaggctgccaccatgtaaaaaaggattattattcttatttatttagagtgtcagttctacggtaagagatggtttgctatttgctaagacttgatactactacttgtaatatactccctccatccctaaatatttgacgccgttgacttttttaaatatgtttgaccgttcatcttattcaaaaacttttgtgacatgtgtaaaattatatgtatacataaaagcatatttaacaataaattaaatgataggaaaagaattaataattacttaattttttttaataagacgaacagtcaaacatttttaaaaaaagtcaatggcgtcaaacattttgggatggagggagtaatacacagtagaacctatacttcaataaaaagattatctttagtaccctctactttaattcacacattttagatcctctctcattttacatcgctgtcgctgctgcctgtgattcctgcgaggaaagggtgggggacagggggagtgactagcgtggttgctacagcgctacacgttcgcgttttgcacgcggaaccgcccccacctttctccctttccccttcctccatcagcagcagcagcacgggcctgaccgtgaccgtcccccacgtcgtcctccccacacacgcgacgccagtacgccactgccagcgcgaaacaagcaacacacgcattcctcctcccgattcgctcgcggccgcaccgcaccgcagctctcctcctcctcctcccccacccaaacccacggcggcagattcgatctcgaattctcgaactctctcgatcgaaccctgtgccctctgctccccgcaaaatcctccgcatttgatgagtagtcctatcactcttcttcctccccgcgcaaatcctcgccgccacttggatgccagggagctccacctcgccgccgaccaccaccaccacccttctctcctccgctccccgccgcggcgcctaggccgctgccgccgccgatgggctaggagaggagagggatcgccgcctccctgcgatcgccaccgggggagccggaccctctccgcgagatctggttaattgatttgcctactaccagtattccgctagattctggaccgattcctctctgttgatgcaaccactgtacagttgttgctttccttgatgatcagaaggagctggcgatttcggaggtgaatgcgttgtttcatatgggtttgcagcttatgctacaacagctatctccgatttagtttattacctttggggagcgtagagattggattccgctttgcgttttcctctttcctgcgagattctagcttatccttcgattaaacctattcgcgcggctattagcgcaagtggttaggacggacgcagactaaaaaaggttaggttattagggatttggttttccatttggattgccgattgcgggagcatatcctattgggagattccggcactgtaaagatatccttggcaactgagttgatttaatgttaatgttagtggtggtggggagggcagataatacgcattctgatctgcctgtcaagttgggggagaagagatgggttcctcacaggaatccactttttcctccgcctcaacggccgcgcaggtgaatgcctgcgcgctggacttgctcccggtatacgccaaggagcttatcgccgggggtgcagccggtgcattcgcaaagactgcggtagcgccgctggagagggtcaagatcttactgcaggtttgaactgctcagagttccatttcattattatgtggtagctgaatgacatctcagcttatgccaatttctgagtgtacgtatgctgttgctttctagaccagaactcatgggtttcaatcccttggtatcctccaatcattgaggaagctgtggcagtatgagggaattcgaggcttctacaagtaagttacatggagaaaataccttacctcaggctctggctgctcaatttagtatcttaatttttatttcgtgttacttactgttcatgaagggggaatggcgccagtgtgcttcggattgttccatatgcggcattgcattacatgacttatgagcagtatcggtgctggatattgaataattttgctccatcagtgggtacagggcctgtggttgatctattggctggctcagccgcaggtgggactgcagttctatgtacctacccattagaccttgctaggacaaagctggcatatcaggtattgcatgcccatcctaatgctttgttgattgtcatctttagtagtcaagaatctctctcagtagaactatcactgaaattattcgacaatcagcattagtagttcgctagtattttccagcaaatattagtagtttctgtgatgccatccttgctaagggctgcaggaa

SEQ ID NO: 79178 - DNA, 602 bp, Oryza sativa
  unsure (1)..(602): unsure at all n locations
gggaagaggttcggcgtgctgacggaggagaaggcgcggcagctgcgcgcacggatgatggagacggagagcttccacgnctgcatgtaccactccgccatggcctccngcntngcntcgcccgcccccccccgacgacggcaagcactgagccgccgccgccatccatggctccccgcctctgcccataccgcgccgccatccaacgccgatgatgatgatgatgttgttgtgtcgttttggtatcaataacgtcgccgccgccgacgccgtcaatggccggagaagtattagtatgaggcctcgacggcggcgtgcttgtcggattgattccatggagatgggatgatttcatcctaatatctccatttctgtaactcatagtatagcagctaatgcatctaaacgttgttgtaacaagaaatttaatctggtttcttcaaccatggcttcttctgtactatacatcacaatcactctgaaattttcagaaatttcagtgttcattttttatctctgaaagtttcgagaattcaatgtttttttattcctttttcttctccaagatatgtgcagcatctaagatcgaagaacttgatcat

SEQ ID NO: 79179 - DNA, 658 bp, Oryza sativa
ttgttgtagacgcttatatttatcataaatactgcaaatctcgtatttgtttgtggcactaatcttgcagagcaatgtccctaaggtcgagcttgtgacaataaacaaagcactgctaggagataccccggattatcatggtaagctttctgtcacaccccaatccggcaccgccgtacaacagcacctgactggagcgtgtcgtaggaaaaacggcgcgaaccgcttcctacgaaaccgcgatctcagtaccagtcccaggacatagcgctggtacccacggtgacaaatatgaatcattgcaatccttaaaataaatagaggacttatttaccttaacataggttgcagctcaaaacagcctgataatgcaactgacgacccggacgaggaaacaccaacaatagcagcagcagaggaaccaatggtctaacacccaacaccacaggcgacggctgggaaccaggacgaaaccctaatcttcacttcacttcaacttcagggcggaggaactatatatatttatatagagcaagggtgagtacttccgtactcagcaagtcacggaaatttaggtgtttaatgcaagcttggaagagtggcaagattgttttgcaaatcttttgtctgagatcattatgaaatcactaagttattt

SEQ ID NO: 79180 - DNA, 7621 bp, Oryza sativa
ttcctgcagccccgggccgaaaagagacttgagtctcgattcgactttaagagatgcttttcaacaactcaaatggtaatgtaccgacctcccgggttagatcattacttatcggctcccagagccatttcacttgattaggtggctcccagagcctttttcatttttgcggactcccagagtccagctgccaagcagcaagcaatccgcttccactcgggaagcctagtctatgatgcccacagacatcccgaatcacacagattcgtttctgaccactcaggtcatccatctgccacataggttgattctggttacgattcccattccacaacaacttttcgcaaagcacaggcaatcaaatctacgcaacgggaaccacctcacatccgcccatgaccgtgggcacggctgttcgaacagttagttaacctctgcagaggggtacactttacccacaagacacgaacttactctagacactggccggtgtgagaggtttgtgacaaagcctttctcaagccgacttagggtcacctcatgccacatagaagaatcaaatcctcacataaatataggccattttagttttcacaaatcaaactccaaccacctcgatcggtaattctgcaagcttctctttcttgcttaccaggaacccagtttggctccaaccgaccctgccccggtgttcccaactattggcatgcgaggtttccctgaaccgactagttacttagccagggtgtcccattccaccttgtggttgcactgtgattatgctcgatgagtttcccataggaatcggtccttatatgcgaatacgggacagcgccacgtagacacggctcccacatcgtgagttttcacaattcattttattttcaaacacaccgacaccacatgtcgggttttcaaggcttcacaaacccatttcccaagttttcgacaaacaacggtgtatgtgggatatttggtatacacgctcagagagcacggatactgaagtaccacaagggtggagcgacaaggaatcagggtagtacagcctacatgaatttgtgcaactactaggtaggtccgtcggtttggcacacaaaccgaggccaagcatgttaagtgtgtgattctaataatgcaaattgcaaacaaaataataatgattttccaattataggagcaattgatcaaagggtgacttgcgttgctcaaggtcttcacgaagcttcacgaatctttgagaggcccaagactgatgataatccggcaaccgcgactaaacgcaaacaataaaaacctaaacaaaagaccaaataaagatcctatttagactaataattagtgccattaaatagatctgaattttacggaattattggaagtggaacggagtcaatcggagctacggattggaagatatgatttttggaagattaaaggattttctgtctaaaggaaaaaggatttattaaatccttctgaaaagaaataaaggagagacgtgaatcagacttccttgggcggcttagggcgcggcccgatggcttgcgcggctcggccgagcctttttgggcctggcgagcgcgggggtcggcccattagggcacgggagaggggggggggggtccggtggaccgagtgcaccgagcggggtcccaggtggggcccgcttgtcggtgacacggcccacggtttgatgggcgcacgcgagggcggcgctagggttcggtggggatggcgcacgggcggtgcgctggatggaccgagacgcgtcgggcccacgcgcagcctcacggctcgcggtggaccgcacgcgcgagcgggagacggagggagcggctgaccggggtcagcttgactcggtccggtcgagctggcgccgacgtggtgccttcgtggcagccacgcgggccggctggcggaggaagaagggggatgccgagatagacggcggacggcggcggtttcaccgggacaccttgcgacggtgagaggcaacagggagcacaccggaatgacgaggaagacaagagagagtgagccaacggctcggatttctttgggagaggtcaatggcgatggattgcgatggcggcggctggcggcgagcaaaaggggaaaatccaccggagcaatgggagttcgattcggcggagtgggagcatctctaggactcaggggacccgtttctagcgtcggatgggatggggaggtgccgtggaggtccggcgacgagaggcggcctccgggagcgagcgccgatggcagcaaggctatggcgagcggcggcggggcttggggcggcgcctaagaaccaccggaaggctaaccgagctaccaagcgagttaaaggagggggagagcaagcgaggaagaggaacggagggctaccgcatgtaggatcgagatgtcgactagagggggtgtgaataggcgatttaaaactaaatgacacctaatcaaaactaacctaaattgctaggcttggtgagggtcaactctaactaagcaactaagttatgtttttcaaacctagggtgatagtggctcaattatatctctaggaaagtaaatcacactcctatgtcaatgtttagcaatcctagggtgatatgatctcaagtttgtctctagaaatgtaaattgcacaaatataaatacgacaatcaaatgagacaaggagacaagagattttgcaccgaggttcggaaactcgccggtttcctactcctcgttgaggcgagcccaactctaccgctcaaccacgaagccaccgcatgcccccttcgtcaaggggtgggcaaggcgggagccggcccacggagaggactacccaagcctcgatcactagggtagttcttccttcactccgaaggtggtgaactccaaaccactcacaaaccggcgccgggcctcctccacaatcttctcggagaggtcaccgggcaactcctccacaagccgtctaggaggcggcaacctccaagagtaacaagcaatgacccggcgtggagatgatcaatcaagtgccacactagctctacaatggaagcaatgcacttgactcttggctagatcaaacctctaacacactaaatggatgaacacaaagctcaagtgggtgtgagagaggtgcaaggggtgtatgcaattgaattgggtgccaagagagctcccttgctgctggagggggagtatttatactcccaccaaccaaaactagccgttgggggcgaaatccccaaactttgtgctctgccggtctgaccggaggtatgcggccggtcagaccgtgctactctacaacggctagaaaactagccattgtagcgctgtcagagggccccatcggcttggcctgtcagaccggtgttgagtgggtggttagaccggcctcggctcggtctgaccgaatacggctccatcggctctgtatcggccaccccgagcagcaccatcccggcctttagggggccggtctgactgcgcatgtgccgccggtcagaccggccttatgcgccggtcagaccgcagttgtggcgccggtcagactggccatgccgcgccggtcagaccgccacaatgtggccggtctgaccacccctggtcaggccgagcccagtaaaagggcaaatgattgtgtgtgtgtgtgatgaaaaagagagcaaagtgaaaatgcaatgacctaatgtggcaatttaatcatctctttgctaggtcattaccccccttgatagtacggtgaaactaacaaataaactagcaaatttgatcgccctacacctcgatcagttctaaattaaagcactagttttaccgtcttctttctctttgctttgcgccgtcaattttaatccatcgataatcatccatgcgcacatatgacttggtcctaacttaaaatatatagctcaaagacaatagttagtccacaattagtgcttgtcattaattaccaaaattaataacgggggcctagatgcttcaccgcgtcgggacagggcgccgtgacgagcggcggcggcgcgggagcaagctctctaggagcggctggggaaggggaagaagaggtgcccggagctcctcgtcgcacgtccacgcacgcaccggcctccccggtgcttgacgacgaacgacgacggtgcaagcagagcagggcgacaatgcgcggcaggcgaaaacgagagggatagagaggaggaggagctcggcttgggttttataggcggatggggcttcgaggggaaggaaccgacattggggcggtcaaggggagtgagctggcagtcgcgctagctcggctggcatcggtccaagcggccaagcggcggcagaggaggtgcggtggctgaggttgggaaaaagagaaaaagaagggggaaaaggagctcgcttctttgccgatttggggagggagagggatgggagtgggagctcgacctcatggttttggcaggacgcgcgtggagcggcttgggcacgcgcgcggggccgagcggctgcgtggcgcagcgcggcagggcagcggggccaggcggctgcgcggcgcaggagcgacagggctgacggtggcggcgaccggccagtcggccaccacgacgcgcggtcacgggccaaaatcgaacagcggcggaggtttggatggtggcggcgggatttcaaaggcggtggcgaaaatcgaatcacggcgacggcgcatagcgcggcgagaggagagagagaaaggaaacggagggagcgtctctcgctcagcgcacgggcgacacacgtgaggagagaaacgaccgggggagaagataggccgagagagaatcggtccacaaggatttgagggaggcaaagtagactcttgtccaggaaatcggtttggagggaaaggagatttggaatttgaatttgggtttcgaacttgatacttggtcttaggaaaacagggaggagtcaaggaatggattcaaagtggactcggataattttggaatcgggacaagtatttggcgaggattcaatggagacaattaagtttcggagacttgaatcggaattgaaatcttgaggtgggggattttgatatcaacgagatggaacaacgggagattgaattgagatccatggcacaacttagactcgcacacaaagaacgaaattttcgcatataagattttgccgaattagtttttaacgtctcatgaaaagcggagcgttacactttctttccaataaaagcaagaaccggtttttaggataatatgcaccttcgggtattcttggtcactaaccattgcaggttgagattaagaacgagggtcatgcgatgtctaagaacactagctacatcaactgtacactttggtgatccttggtattggaacacactctataggagaatccgacatcacacacttggtttttgatgtcttgcgacacaaaagtccaagtgtggggggaaggtcgacgagcttttcatgatgagttccatcaaccaaggccatcttgggttgaagttggtgttagtcctagcttgctgaaaaaagaaaaaaaagaagataaaaaagaggagaaaagagagatagaagaaaaggagaaaaaaatgggagaagaagaaaagagcaagagagctgacgagctatatttagatcaaagactgcattatgtgcgtgtctttgaaatgtggctatacacctcgctagtagcaatcatgctgcccggcaacacctagtgcctctctcgagctcatgtgccgccttggctcagcctttatctacttctagctgtgcacaacttatcgctcccgtagcacctacgcgcatacaagcaagaggagttgccctcttcatttctaagtgttggctactccactccagttgacacttgcacatttgctcgaaaagagatgcatcctacgtattgtgccaacggatcacgccttcaaggcacaaggatcttgcacctgaggtgtgtgcatgaccaacttgcttgcctgagttagcatggtcaaagcgccttcctccggtacaatctgcataaagatggaggagaaatcgacaaccatatgtgaccataccactgccccagagatttcaaaatatacatcatgctggcggtaagtacactcaggtatgcgaaagataaaacaaggttcaccattccttttactcatacttattttcatttgaatgagacttgatcttacatggttatgtttcttgtgtctatttgcatatgctttgttttgggtgttcgcgcaagacatctataggctttttaaattaagcatggtgcttaggttaaaatagtctattttaatcaaattggacatggagtttagtttgattaatgaatttcagagttaatatgttcatagacattggatatatatcttatgtggactaacccctgcaggaaaattttcaaattgacgggtgagtcctcaagttcaattcacaatggaggtaggccagggccaggaacaaatcaattgctaacatgaaaaggagaaacatatcacctatgaaggtgcacggtgcgtatattactaattgctcctttagcatgttcatgcaaatttacctcatcactgtataagttgtgcttaaacgaaaatctggtgaataataaaaatttgaaaaaaaatgtttcagaataaaaggactgtctctcgaaaaataaaataaaatattagcaaacttatgggatccacgcttctcatgttttgaatccaatttcattttggcgtggatgtgaacaactaatttcaaggctacgataaaatcttttcaaatctttatagtcccttgggtatttgttgtccactaaccttttgcaggaaataaaaagacaatcaaggagcagtgtacaataacttcaaacacttatatcatgctccttggtccatgggaaagagatgcacaaggaatcaagcagaacaaatgcaaaactttgttacattcgatccagttctaagcctggtaagatctatctggtaagaatctcatacaccatgtgcatcctcatctcatttctccattctgccaggatacccaccatatccattgttgccataaaataaaaagaaaaaaagattcaataaaataaaataaaataaaataaagttggctccttggtcttccaaccaagtgagttctttttgcttcacttttgtctttatttttctttttgtgtccaataaagcctcccagatacaaagacaagtgtgggggtgatcttgcacatcaacgccataaccaaagtaagatcacccagaagtgatgagccatgacgaaccacacgaggaaaattgatgcagccagacccaatgaggggtcagtcgaacctccagtttgactgaaccacctctaccatgaatcgtcctctgttttatacagagcgtaggtttgcacaatttttactttggacatccattctatcttgagtttaatttgactatcaattctaaaatatcgaagataattgaacccaagctagggatggtacaattagagtctatggtctccctgaaaatgacatgcatgcctattattctttgctcattacttgttacttgtggtgatatatccaatagggaccccatgctatctaggtaattgatgaatgagttata

SEQ ID NO: 79181 - DNA, 870 bp, Oryza sativa
aaaaattgtgatggcaacagacctgagtgttgtcatcagggttttttaggatagccctgacaacctgcagcattggtgttatgccagtcccaccagcgatctgaaagcatatacatacattttgttaaaattttttaaaaaaaaagaccagcttgataacttcagaatttttctagctttgggcttgctaaattgaattggcaaacatagacacttggctaaggttgaagtcatgtcttaccatgccaatttgtttcttcatatttgggctatatctgagcttttcaatgggcctggaaaaaaaaaagagaaagacatcaattacagatagccaataacatgcatagaaaactcaacggattttcatttcacattaccctttgacctcaacaacatctcctggtttcagacttgcgaaatactgactcattttcccatcaggataaacctgcaacatacatatagcacaaaaataactctcctttcagtactaccttacactggactacaagaactgctgatctaaaagcaactagcatgttctgaacttcagacattaaactttgtgttaccttgattagcaggtcaaaatatcctttagaatctggatcagagataggtgtgtacctgcagaaaacatgttagattccaataaaaatctaatcgaacagtcgtactaacatatgttatgtatgcaataatggataactgtttttgtctctgcttacgggcgaatgacaaattttcttcctccctccacttcctctcctattggagccctgagatgaattaatggttttagagtctccaaggtaagaaataaatataaaaaatactagctcatactatcagaaaagtagatgcaaaatg

SEQ ID NO: 79182 - DNA, 13174 bp, Oryza sativa
gggagagcgcgcgcgagagagagagagagagagagagagagagcgcccggggagagagggggccggggaagaggggaagatgggccgagcgagattcggcccatcgacctcgggggaggcaaaatagacttttgcggaggaatttgattggaaggatttggattcggaattgaactcgacgatagatcgggtattgagatcttgagatggcacggacactagacaacaagcaaagaaacaaatttcgcaattagggtttttaagagatgattttcccgctaggcgccatgacggaacgggcgctacagaccaacccccctaacaagaatctcgaccccgagattcagcacctaagggagcaggtccgggaactcggcgcggagaagatcttctcgctcccaggttgcctcgtcttcggaatgattgctccattggactttgtagaacttgatggtcttccttcgagtctgacgttctgcctcttcaagaaccttgatcggtctttccttgtaggtcagattcttttctagctcgatattacccaggggaacttgctcttctggaactcgaagacatttctttaactgggatacgtggaacacgttgtgcacgtctgcgagaccttcaggtagctcaagctgataagccacttcgccacgtctggcggttatgaggtaggggccgatgtagcggggtgctaacttgccggacatcccaaaccttctcataccacggaggggtgatacccgcaggtacacatgatctcctttttcgaactcaaggtcacgcctccgattgtcagcgtaattcttctgacggttctgtgctgtcttcaaacgttctcgtatcagcttaacttgttcttctgctgacttgagtatgtcaggaccgaataccagtgctttgcccacctcattccagcacaagggggtgcggcactttcttccgaacattgcctcattcggcgacatctgaatgctggcctgataactgttgttgtatgagaactcggcatacggcaaacaacgatcccaagtgccttcgaaatccaaggcatacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgttccgccttgactctttggcaaatgtcagacagggctacgtattctgcgacgtctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaatttgtgtctttcttctcctgtattctttttattaattcttttatcccttcgtcgtctttctgagcctcccggattcgcgactctagggtaggctgtactgtcaagctggcagggacacctgactgtaccacggtcagtcttaacttctccaattctccgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcacatctgttcccgattaaatagtgcctccagatcttaagagcatgaaccacggctgccaactcgagatcatgggtgggataattggcttcatgaggcctgagctgcctggatgcataggccacaaccttttgttcttgcattaggacacatcctaagccttgtcttgatgcgtcacagaagatctcgaaatctttttggatatctagcaaggtgagaactggggcagtggtcaaccttttcttcaattcttggaagctgtcttcacaggctgcagaccattgaaatttcttttccttctttaacagctcggtcataggtctggctagcttagagaatccttcaatgaatcttcgataatatccagctaagccaaggaagctgcggatctctgacacgttcttgggcgggttccaagcaagtacagcttcaaccttgctgggatctacttcgacaccgttggaggaaatcacgtgtccaagaaatgctactctgtccaaccagaattcgcatttcgagaatttagcgaatagttgatgatctctgagcttttccattatcagcctcaggtgttcagcatgttcttcctcgttcttggagtatatcaggatgtcatcgatgaacaccacgacaaactggtctaggtattccatgaagattttgttcattaagttcatgaagaatgctggagcattggtgagtccgaaggacataactgtgaactcatatagaccataacgcgttgagaaagcggtcttcgggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcgattaccattctctccgagccatcctttttcttaaccagaagcactggggctccccaaggggatgagctaggtcgcacataacctttactttccagttcttcgatttgtcttttaacttctgctaactcattagctgccattcggtagggtctttttgcaattggagctgtgcctggtgccagttctatggcgaactcgatctctcggtctggtggcattcttgttaattcttccggaaatacgtcgggatattcacagactatgggcaccgactccaaggaggtgacttgtaaacaggttaggatagaccgacttgcggtaggggtgttaggggtaaagcggacttgctttcctctaggtccttgcaaggtgatggacttttcggcacattctatctgtcctttgtgcttagccaaccaatccatccctagaatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttcagcttgaatgtgattcacacggcctcgaccaaagttgttggaagcacgtgaaccttgtccacttgcctgagagctaggacgagactgagttgccgctggagtaggagttctggcagtgctgccattagcatgccctgagttggtgttggtaggattctgaggacactgtctagcatagtgacccatctggttgcaccggaaacactgaactgctgacggtccctacggtgacttgaaagaggtaacgctgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgcgttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttgttgaactgacttaggtactcattgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcgtcttctcaacaggagtacactgcactaagttgagttttctatcaacatctttcaaccaatcgtcagcctcgacgggctcgacggtctgagagaactctggcggacgagacctcaaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatcctcaacaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaatcagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagttggctcctcagtcgaagaaacgtcgatcggctgacgcgaagggaccggcggaacctgtcgagggccggcagcagcacgggccgctggcggtgggggagctgggtagtggaaacggaacacggtggcagaaccaacaacacgcttccgcgcagtgcggataaagcgtgggccacggcgggaggaagcaactggggtgtgtcctggggtgtaggaagggctaactgggtgtgggtagggcgagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacaccgagagctcacagtgagggggaacacggtccacggagtaccccgtgtactcgggacacgagaagccaaggaaacgggagaggtcacgaagctgagcgacgtggtgaccctcaccaaaaccgtgggaactgaagctggcgttcactgccatctacaattttgaaagagggagaaagatcagtaaccgttttagaaacaaactattgaaaataaagaaaacaaaagaaaccttagcttttcgcaagtagttttgaacttagtatccttagggtcgtcctaagcgtcgggtttcgccctagggccaagcctgtgctctgataccacctcttgtcacgccccgaactagtcccgaccggatctagcccgtgacgctccaaattaacctgttaatcgataccagtcccaggaaatagtgctggtatcacaaggagacagagtatcacagcaacagaggtctctttattatagagtagaagtacagtcatgttgggctgcggacagatcccgagctcacaactgcattacaaaaggaaagcggaagccagtacttggaccaatcatcacaggcgcgacttgggaactaggccgaaaccctaaaactcatcgtagccgacttgctcctggaagaactcctcgtcagcaggatccacttcatcttcttcagcaactaggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgagcagtttgttaacctctgtagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaacctgccttgcagacgggacaacagattaagtgtgatcctatcaatgcataatatttcgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagattattggatttttggtctaaaggaaaaaggatttatttaaatcctttttggaaaagaaaaagaaaagaagggagggagggaatatagacttttctcggacggctagggcgcggcccaagagaaatggagcggtctggccgagctaaatgggccggccggcccaaggtggcccaaactcgcgcgcgcgcgggagggaggagagagagagccggtggaccaggctcaacacgcgcggtcccgggtgggacccgcttgtcagcggctcggctcaccgtgcggagggagcacgcgacgcacgcacgcgggcggggaagggacgcggtgcacgcgcgcggttcgcggtggacgcggatgcggcgggcccacgcgcagcctcacggctcgcggtggaacgcgcgcacggggagggactgaccggggtcggctcgacccggtctaggctgagctggcgccgacgtggcacctacgtggctgccacgcgggccggcgggaggtagacgacgacccggccgcgaatggacggcgggcggcggcggcgagcggcggagcgaaccacggcgatacgggcaacagcgagcacaccgggcggttgcacgtgacaagggggggcgagccaacggctcggattcgccggaggttgctcgacggcggcggattgcggcggcgacaaccggcggcgggagaagagggaaacggcgacgaggtcacgagaggtcgattcccggcggtgagagcatctacgcggcgtcgggaactcgacgctagcgtcggattggacggaactacgccgagcgaggccggcgacgagcgggtgctacggagctcgggcggcgacggcggcgagcacacggcgagcgacggcaacggtcggggcggcgccggctagctacggggaggctactcgtgctaccaccgaaaactaaggggggggagatggagcgaggaggaagaacggagagaggcactaccgtgcgggtcggggcgctgtgacgagaggccgacggcgcgggagtaatctctccggcctcgggccggggaagaggaaggagagggcgcggccggagtcctcttccgcgtccttgctcgtgccggctcctccgacacatgcaacgacgatcggcgacggcgaaacagagggcggcaatggcgcggaggcgaaaatgagggagtttggagggggagggcttgggcttaaatggacggcaatgtcggtttgggagaggggaaccgacattggacggttaaggcgcgagctggcgctcggcgcttgtagccaaagcggcggcaggaggatgacgccggcgaggaggaaaaaggggaaaaggagggggagaaaggggcttgcccctttgccgattcgggaaaaagagggggaggggaacgggagcatcgcggcagagggaggaggggcgcggctccgtcccttggcggcttgcgcgcggaggggcgggggccgggcgatgacgacggcgatgacggcggggcgatttggagcggagcggcgacactggcgacaggcgcgtgcagaggctgacggcggcggcgaccgggcggtcggccaccacggcacgcgcgcgcgggaagcaacgggcggcgtccgcgcgggcgcgcacacgctggctcgcgaggacgagcggctgcgcggctgcaggcgcggcagagcgaggggaaagggagggggcgctcggcgcggcggcttacgcgcacgcgcgcgcggcgtgcgggcgaggctgagcgggggaggagagatgggagagcgcgcgagagagagagagagagagagagagagagagagcgcccggggagagagggggccggggaagaggggaagatgggtcgagcgagattcggcccatcgacctcgggggaggcaaaatagacttttgcggaggaatttgattggaaggatttggattcggaattgaactcgatgatagatcggggattgagatcttgagatggcacggacactagacaacaagcaaagaaacaaatttcgcaattagggtttttaagagatgattttcccgctaggcgccacgacggaacgggcgctacaatacacctctccgtgggtggttgatcttgacggtggagatcaaccttattcctgcaagcaaatcgaagaaacaagtaagaacaagataaaagcaatttgaattacagataggaattgaatacaaatgataagttggggctccgtaacgagtaaaccggcaatctaaccgatcacgggattacacggcaaagtagcaaagctaaactttaatctaaacaaaacccaagaaaccctgaaggggtacctaactatttaaagaggtgggaggacgaccaaggggaccctagggtcgtgctccatctggttgggtcgcaccccacataggccccacttgggccggggtcccaaacgaagttacaagcccataggcccattacaggtgacgcaacaccttgtttcttcaattgcggatgattgggatggaatttgacgatgaggctggatccgttggaaagaggactccgagagctttctatcaagtactaggatgtgtcagatccctccgaaatcccgtatattatgggataaatggaatagtatctaagtcacatcttactactcacttggtgaatatatattgtgaatggcctaatgcggctatactggtgtcattgtgtatgtagatccctttctcctactaaggccattcacagtgctccgacatgctgttaggccaaccctcgacgcgtcagagatttgcggctagctaggtgtcgcgcgtgaccaaatgaggtccacggagtctagattgggcattcgttcttctgacaacccaaaggagcacggtgtgggggagaatggcgtggccgcgttgtggaggtcatggccttgccgcttcgagcctccgtgcgtgtgttcccctccccatccctcgagccggcggcagaagaaaaggaagacacaacggtggaggaagaggaggcggtagatcttgtgcctaccttgttgatatcccccctcccaccgtgccgccgctcgtcgtcgtgcctcgctctaagccgccgagcttgtcgtcatcctctgatgtgcgccgctgctcgttgtcgtcgtccactccaagcatggcagcctcctcgacccctccgtagcctcggtggcctccatgacccgtccagatcgaggcgccaccgaggagagtgtaaaggtcgtgccaccactcgttattgttgctctaaactacgggcaccggcgaggagaggggagaagggatttggcgccggcgaggagagtagagaagggagatccggcgagccccgggttggatttggccacgccactactctgcctggtgccgtcgctgcttgggtcatcgctccccgtcgcggcgcggtggactgaggagagcacaagcaacaagcaaggcaacaagcaaccaagaagtcacacatggagaaaatatgaggaaaagtcacaaaagcttgctgcaagcaaccaagaagtcacacccacgtggagaatatcaggtactaccgcacagtagcgtgctacatattaccaacctaaaaaaaatacatcaaaaaagtcaaaaacaatatgaaaaaaaattcgagatgtgaaacactatgacatttgccatcacacaaaacatcaactcaaaatacaatgtgcacaatgagaaaaagaaacaattttgttctccaatagtatttaaacaaatcagttttctattccactgagatttgtcattttttctatgtgtatatgttgtattttgagctgatttttttacatgtcataggtggtgtttggatacagggactgatcctgtcatatcagatgtttgaatactaatttaaaagattaaatataaactaataataaaactaattgcataaataagagctaattcgtgagataatttttttaagcctaattaattcataattagcacatgtttactgtggtatcacatggactaatcatggataaattatgctcaatatattcgtctcgcgaattagttcaggttatggattgtgttttttcattaatctacattttctacttctaatgaatcaaacatccgacggtaactaaaatttagtcctcccatcaaacagccttgcgcttgcacctctcaaaatttttctattctttttttttttgactttttcggtgtatttttcgataaggggactcatctctcaagtgcactgcttctcttcgtctcttcccccatctccggcgagccgtactggtccaactccggcggccaacgacccctcaactaccagctgccccaaaactggatccgtcactgagttagttaccaaggtatatctccccctcattcatatcggcggccggcgacggcgagggtgagaaactgaatctgtacaccctgttcttgcccagcggcggcggtgaagagaaggggcagatggacggagcagcagtgagcgtcgccactggggtgatgggatccctccttgccaagctctctgcattgctgggagaagaacgcgggcttctgaaaggtgtcaagggtgacatcaggttcttgagagatgagctgagcaccatgaacgtctttctgatgaatatggccagtgtggaggagaacatggatgtgcaggtgaaggactggaggaacaaggtccgggaactgagctatgatatcgaggattgcatcgatttattcatgcacaaattgaatcgcggggatgataaggtcaacattgttctcaagatggcaaagaagattagaatgttatggtcaaggcatcagattgctaaccagatccaagaacttaaggctcgtgtcaaggaagagagtgatcgccgtttgaggtactacttcagcgagtgcaatgcacatgtcgacgggactaaaattgatccccgcctaccggcgctttatgttgaagaagag

SEQ ID NO: 79183 - DNA, 6984 bp, Oryza sativa
gcagtatggcacacttttataagtctagtgaacggaatctgcattttgcaagtttgtcgacctagacgactcatgcttatacttacaaatttaaagactgctagtttattttgctctacggaaaacataaatttagtgaagcaaccaaaatatataaaatttgtttttcgaagcttacattgcccaatagtacttgcaactttgctcttggctgaataacccaatgacatgcactgccgcattttgtctgggtccattccaccaccatcatctatataaaacaatataacaagaaaaagaattataagtatttgagaaattctaccactgtggttccatttataaggtaagatctaaaagttccatcatagtttcataaacatgctgcactatctgatagcacttaaatgtgttaaccactccagaggcctcagtaaaagacctataatatttctgaggttgtccaaccttaaaccaatcttccattttgctttgtgcatccctaaactcctaaattttctttatgccaaattgaatctgtacatcaattaattgcgtataacataaaacagggacaagcttaaaagatcttgaatattccatgtaccacatcatgttaatactataagtcaagtcgaaacctatcaggttccagagtgaaatatatgttcactacttcacttagtttgctataacagatagaaaggggcatgttttatgttgttaatttgctatggacacagaagtttcttgtcatcaaagaaacttttgataatataaacagaaatagaggtaccaattcaagtcactataaaaaatgaattttaccaaagatttttgccaacaattaaaggtaaaaggtaaaaaggttgtgcaccttcaacaaggagcattcttgttttgtctttattattctccaacatatcaatgttcacataggtagctccatttatgaccttcggagaaaacagagctcagtaaacatacaaggattcaatgctacaaactagtgcacttaatatttcacaatacttacttcatcaagagagttatccagcagctcagccaatgctgtaacgtggataaaaatatgttagccaactggtgtgaccaaacattgattgagttgtgtgagcaaataacatggcaccgttgttgtgtctgctatagcattcatgggaagaaatggtagtgcaaaggtaaaatgaagatgaagaccataccccccagagcccacttgtggcttgttgcatttgagtgcaaaaatttaggatgtacacgaacatgatccaatccggatactgaaaagagaaagtgaatgtgaaattagaatacagaaagaaaatcacagatacttgtgtatctaatccagaccgattaagaaagaaatattacacacatacagacttccataaagaacatgtctgttgacaaattcgttgtatgagtgaaaaagagaacttccaatggaagagacggaaatacatcttcctaaatctctaccacttcatttagtttcattcctattcaacattgtacaaaggcacaaccctacttacattggcagctattttcctaaaaagtgtaatcaggtctaaaacataaaataaatagaaagaagggactaaaacaactaagggcatgtacaaagatatgtacaaagatagagtcaggtatgagctctacgctatctagagactagcatcctacaatagttggagacaatatggtctctaatcattaatgtatcgaaatattttttcttactattctttcctttctttcaccaccattcaacaaaatctgctctaataaatgctaaaatctgctctaataaatgctaagagtcgactctgagaagttgtcatgcataacaaccatatttctctttcctcctttctctttcttccatgtcatcaaatttacttgcattgcaatagagagagaccactaataaagaccattgtacatgccctaacaagcacccaagtccaagtggcacccattcctaacatataacctttcttgtttgttcatatcaatgttccaatcctcaagctctgcagttcacaggtgaagtattaactattttactctatctccagaaactccccccattgaatgctactagtcacattttcagtgctgcaaaaccttaaatgccgcatggcatgaatcgtctaaggaaagaaccaaaacatctcaactccatcaaatgacaacgagcatagagatattaaaacgatatttatgatatgacaacaagaacaggattacagaagggttacgcgaccagaaaaaaaaaataaggttacctgacgactgcggcgctccatccccaagcggcttcccgtcgtagtccccggccttccagaactgcttcgtcgcgctcttcgacggccccgccgatgcctccgcccccgccgccgccgacgccgcatgtggtagaggatcaaggaaacccgggggcagatccacggccacgcccgccgcggaaaccctagcgcgcttccccgccgatccacccgccctcacaccccgcgacctcttcgcgctgccgtccccgacgcccttcccggcggaatttgagtcgctgctactcagctcgatgaaatcctcctcgacggggcgcccccttctgccgccgccgccggcggccgccatcgccaacggcggcggccgctccaccgccgcagccgccgccgcctcggttttcaccgcccgaggattcctgcgcgaaatcgagaaattccggggatcaatctgtaaaatccaaccctatttttctcttctactatctgcgaaatatttccttatctcgccgagggatcaccttatatatagcctcggcaaaatgcccacgagagctttcctaaccggcatgtactcagacccaatgacatgtgggcccacgtaacccctgctcccacttgggcccacctgtcagtgggtagagggtagccgtgtggggagaggggctttgagggcggttattacggggagctggaaattttttcggttgcctttctttgggctctcgagcgcgtcgctcggcctttttccgcgtgtaacgcctgtgggcccggcgtgtcatagagacatcatctgaggtggatcgaggacggacgcgtgtgacagttcattagtgtatgccagtgtggcacgtactcctagcttgggtggactggtgttgccatgtggcgtgcacactaggagcagtaggagcgccactttgcagttgcatgacacgtggctcccatgcacatggatcacacaagtagcaataaatatgctacaactacaaaacaactactcaatcattattactccctccatcgcattaaagcatatacaataatactccctccattctataatataaggcacaaccacttttcttaaatattccataatataaggcatgcatgcaagcatgcaattaactatgacatcttcttcattaaattattaattttttaaattctctactctcatgttatctaatcctattggatgcttgcatatttattaggatgatccaaactacaagatgataataattatttcttggtctttgagtcgagggtggctgtgccttatattttggaatggagagagtaggtggtaagagatccacgtaggattttttttactgagctggatgagagaggggaggagagagaacaagagggcgactaatcagtcacccggctcgaggttgtagggcccgtagcgatgggcgatgagaaggaataagcgctagtcgtcctcttcctccacggctgtcgctgtcacccgcgttcatctcgtcgtcctcactcgcatccgctgcagccgccatcctcgtcctccacggcggccgccgtcgcccacatccgtcttgtcgtccacgttccccatagcattccccactgcccgtgtttgaccatttggcttatcctacagtcgagatggctctgataccaacttgtcacgcccagaaattcactaataatttccgaactaatttgtgcattaaatcctcgtccaggaatcagccgaggtacacaaactgacaatttaatatacagattcatcaatataataacgttacatacattcaaaagaaaagaaaacttcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacagcaaatatgcaagtgcacaaggataccaaaggatggcataatatagggctcatttgcaaaagcagcacatagcaaacatttaaaagtagtaaaacagtagagtaattaatcatcaatattaatcaatcactgaacagcacatccatgctgcacaagctcaaccatcctgaacaaccatacccggctgtacagatctatctccaaaccaggaatgtaccattccaaaccaggagctaatcaaattatttccagttatagcatcatttattatggtgagaagtgtgagactaatcatgaaagacattgttagacccgcccataaccgcgggcacggctattcgaatagttttatctggtcagagatgtaccactgtacccacaagacacaactccacaatatgtcaccatatcatcatgtgcccatgctgaacatgtcaccatttgtgtagttgtgacaagaccccttgcataactcaacccaaagcagtgcaccgttcctggatcgtagtcaccccctcaaaaccagaggcatggactccctagcgacccccgtgggcttatctccgccacttctcagtctggtgctccacaatgagccttgctatacaaagtgtccagccgttgctcattctggcttgtggttggcacgattaatgtttcacaaccgaaactcgtgaactggtccttaattgtcatgagcacgaccatcaaaaccatatgctcacaacccaccattatcaagttttagtaggcacattaattaattaaccaatcacgatagaccatcgtgagctttcattaaatatccatcattaagtaatagtgaaacattagttatcccaattgtgtgctaatgtttctaagcatggctaagcaattatgtctaacatctagctgaaccaatatataaagctcaactagtcaaattataatagccaaggtatcaaggaatagagtaatcgatgcaaacaggcaataacaaaggaataagttcacaccacccagtgacattcgaaaataaatgcacagttgaaataaatagagaatttaaatataggatcaacatgctcaaaggaattgtgtttgggatctgtgtgacttgccttgcaatattaggtcttcaattaatcttcttgaatacttccgatgcacttacgatccttcgaaacgacggaaacgccaagctaacacgtaaaacgaggaaaaagactagtaaaaaccaaataaacagcacatgtagagtaaacaaacatgtagatcatgattttagatgaatttagagacttgaacgtcctcattccgatttcatatgaattaattacgaattttacaagatttaattccaattaaacctattaaagaaaaagactattccacattaattaaaccgtttacaaatgatttataactgagagaaaagattaaagcaaagtacagaaaagattagattatattggtagatgacatatgataaaaagaaccaatatgccattggaaagagaggaaaggatttatattgattttgggtggttgagattaatctcgaccaagagttgaccaagatcggatggcttagattgatctggtaagcgggcctcacgagataccgactcaacgagtcaattctacgtgacacgggatcacccaaataatcaaccgaaaccggcgaacggaaccggcggctctgaactaaaggacgactcaacacggacgaacgaacgaagcacggggaacatctcattcgaacgaatgagcgaacgactcaacaatggctgtgactaaaccagtgagctagacacgattcacggtaaagccccggtacggcaaagataggccggtaggaacctagggatgcacctacggctagacaacttggctaccgagcaacggctaaaacggcggctagattaaagcggcacacggctgcgacacggcggcactagggcgacttggctcggctaggtggcggcggctcggcggagacacgcggctagggttagggtgacggcacagccgatagcgatgcacgacagcggcgcggcgactgcagtacgtgcactagggcagcggctacgcggcggctagcagcggacaacagcgggtgcggtgcatagcaatgaccggctcgacgctagggcggcgacgcagcggtagcaagcggctgtggcaaagcgacggcaacgctgcacggcgtgcaggcgcagcagtggtgacgcagcaaaggcgacgcagcagcagcggcaacagcaagcgacacggccgacgtggcagcatgcagcagtgacacggcacgcggtatagcagcagcttggcagagccagcgcagcaagcagcggcgtgatggcagcaagcgacggcgcaaggcggcggcttggacagcagcggcgatgcaactagggcagcgatggcgcatgggtcgactgcggtggctaggcacacacggctacgcacgggctaaggctgcacaacagcgactacacgaagacacgattgcagctacacaaagattaaacctaaggaacggaaaggaggcctcaccggggaagaccgaagaggaagaggcaacggcgacgccagcgacaacacacggagatgacgacgacgctagggccaaacaagattagattaaattaaggccctagggaaaaacctacgccggtgaacggcatgggagcggcggttgccggcgaaccacggcacaaatatgcaaa

SEQ ID NO: 79184 - DNA, 722 bp, Oryza sativa
ggttgatattaaatcgagtagtgcagttgtgcaatcctaggatccaacaaaattccgtaacaccagaccccgcatagacccatgactccgcacgtatattttgtgaccgttggatctttcgatctaacgtcccatccctgacctccccactcggctctgcctatcacgcttctccctccctgattcctctcggaaaccgcatctcctccccgagtctccaggcaggcaggctcccagcaaccgcatgcgtcggcacttcatcgccaccgctctgccatcgccgcccaccctagcacccagccaacgtcgtcgccgcctaacgcgcccaatgtcgtcgcagccatcgtgcacgctataagagcaaggttaatagtatagccaactactagctctaattcatctatagctaatctaatagccaatttatacaatagttgtttactatactaatagtatatggtcccactgtcatacatacattgcatcttggagtccgtgctgcagctagctacagatctgtatcccgctgctcttctctctcatcttttatctcattaaaatatatttgtagctggctaatattctgctattgtacctgctctaattgtcgcctcccccgcttctgcttgcctcgccgccaacctcgcccgtcgcacctcttttctcctcaccttcacatacaatcgtgtgaagatttgtcttttagttaacattttgagggt

SEQ ID NO: 79185 - DNA, 7764 bp, Oryza sativa
ggggaagtggaggccggtcttcttctcctcctcgcgaacccaacggcggcagcggcgaccgaaggcgacgaccacagcgactgcgcggggctgctggagcggcggccggaggtagagagagaaggagctcgcggggagagcgtttccggcgacggcagcggacgggacttgaggggatgggtagaggacgactagggggtcctttatataggcacgggagctcggttccgggcccaaatcgacggcaaaaactcgggaaagtctagtgctctcgccggagtaaggaaatattaaaccgcgaaattggaaaggatttccatagaaacttttggggatttcttggggaaaaggaagaggagattgagaggattccattcccgcaactaattttgaaataggagcaacgggaaagccggatttgggaggagaggcggcggcaactgtgcacgagcacggctggctcgggctctgactgctcaggaagatgaacagtagcgcagggagaatatttagactttttgctgggcctcaaaaacacagcctaaggaggaatgcaaattggacttcgggaaagagaggcagagggctgcaggccgaaaagaaggaagaatgggccgagaattaaaggtgaacttttcctgtttcggcccgaaaaggaaaaggggattttaattacttttcccaattaaattaatcactgaaatgatctttgaattgttaaaaatacttccaatgctcaaataatttcaagaaaaatcatgaaaatacttggacacccaaagtacttaacaagattataataagaccatttaatgattaatttaatatgtggataattactgaaatgttctttgtattattaaaattaagaattgagctccgaaaaatccgagaaaatttcagagagtataattaatcatggagaatttaataaaaattaaatccagccatgctttaaattaatgaaattttatttcccacatttaacttcacttgtaaattaatgaacagttaatataaattcgattaataatttattaaataatttataaatcctgaaacgaaattcaggctgtgacagtttcccaattatacagtatgctgatgataccttgatccttttgaaagcttctcggtttgagcttttttctttaaggctctcctgaattcttttggtcagtccactggcctaaaagtgaactatcacaaattaagtctctatcccatcaatgtagctgaagataaggtagagttaattgctggactacttggttgcaaggttggatctatgccattcaattatttgggtttacctatggggacaaccatacctaaggtaattcattttgctcctttagtggatagagttgagagaaggctaacaataagctcagcctttttaccccagggtggtaggctgacacttatcaactatgttctttctataatcctcacatactatatgtgttctcttgaactgtctttaactgtcatcaaagccattgatacagcaagaaagaacggtttgtagagaggaaataacccaaattccaccagaaaatatttagcttcctgggagctagtgtgcaggctaaaggacaagggtggtttaggggtgataaatctaagaaaccagaatgttgttcttttattgaaacacttagataagttctatagaaatgttgatcttccttgggtggatctcatatggaaatcttattgcacttcaaagtctcttcacttagtttcaaatagaggctccttttggtggaaaaatattgtttccctggtagatgtttttagagggatgctcattgcacagtgcaaacaggaacctcactgctcttttggggatctgtgtaatggggaactaagtttcctaatcttttttgggcagcttataacaaagatgaatttgttaagatggcttgctccaagcctttggaagatgctttatgctaccaatgaatgctgaagcttatggggaatttttagttttgcaatctgaacttgacaatgtccatttaagtgaggggttgggtgatcattggagctatatttggaatgttgataagtattctgctcaaagattttaaaaaatgaattattcatgcttacagcctccaaggccgcttgtttggatctggaagacaaagcgtgtgatgaaaatcaaagtgtttgcttggctcctctctttagacagaattaatacaagggacatggtggattgcaggcactatgctaaggaaaatgatgatctcacctgtgttctttgctctgggggtataagagagataaggctacatctcttctttacctacccttttagtctccgatgttgacagtatttgggttttgattggtctccttatttaaatttcttccagatgattgttctagtgagaattcgttttggtacgaaggtttcctggagatcttctttacaactcctggtatatttggaagcaaagaaatggcttgatttttcataatgtacctccaacttttcatggatggaaagttcagttcaggaaagagcttcttctacatatgtgtagaatgaaggagcctctcaagcaattagtttttgattagttacaaattttgtaattattttgtgggtttctgtttttcctagtaagatgtaaatatttctttttatacaagctatactggtaggcaaatgcctggcagtaatttgtcaaaaaaaaatgaactttgtatttatcgtattatgttgttaatctagtatttaagtatcaaatgcaaattgcagttggggtgtcaaggatatgtgtgttagtgtgtgtattagtgtgctaaggacattttagtcttttcccatatctttgtatacaatatattcccctctagggcaaaatcaatggatcaacgatttatccccaaatccccaaaattataacatctgacatgtgaaccgtatgcacctacacttatccgctactacggtctgttaatattcaggcacaacacaacttacacgatatacaaaatgcatcaagaaaatcatcgtaagatcgattattattatgcatcaagaaaatcatcgtaagatcgattattattattaactgtttatagttaacaacagctactacgatcctctccatttctaccagcattcgaagattcacactctttgcaagccaaaaggccatgacccaaccaaacctcacctacaccccactagtcatggtaacacacaagaaccgtgtcatcctcgccacgaccaccaccaccaccatgtcgtcgccttcctctcgccacccctcgtcaccacgctctctacaaatgccagagctccggccacccccaccaccacccaagaagcctgcgccgccgaccggcatcgcgacatgggcgacgccgcggtacccgccatggtggtggaggaggaggaacaggagcacgtgttccggagcaggttcccgccggtggccgtgccggacggcgtcaccgtgccggagttcgtgctggacggcgccgaggcctacgccgacagggtggcgctcgtggaggccgcggcgggcgggcggtcgtacacgtacggcgaggtggcgcgcgacacggcgcggttcgccagggcgctccggtcggtgggcgtccggaaggggcacgtcgtcgtcgtcgcgctcccaaacctcgccgtgtaccccgtcgtgtcgctcgggatcatgtcggcgggggccgtgttctccggcgtgaacccgcgcgcgctcgccgcggagatcaagaagcaggtggaggactccgaggcgaagctggtcgttgccaacgaggtcgcgttcgacaaggtgaaggacgccggcgtgccggtgatcggcgtcggcgacagggagcggatgcctggggcgatcagctgggacgggctcctcgccgcggcggaccgcaccggcgccggggtggtgccggtggacgcggcgcagcagtccgacctgtgcgcgctcccctactcctccggcaccaccggcgtgtccaagggcgtgatgctgagccaccgcaacctggtgtccaacctctgctcgtccatgttcgccgtggcgccggagacggccgggcaggtggtgacgctggggctcatgccgttcttccacatctacggcatcaccggcatctgctgcgccacgctccggcacaagggcacggtggtggtgatggaccgcttcgacctccgcacgttcctccgtgcgctcgtcgaccaccgcgtcatgttcgcgccgctggttccccccgtgatgctcgccatggtcaagagccccgtcgccgacgagttcgacctctccgacctcgccctcaagtccgtcatgaccgccgccgcgccgctcgcccccgacctcctcgccgcgttccagcgcaagttccccggcgtgcaggtggaggaagcctacggcctcaccgagcacagctgcatcaccctcacgcacgccgccggcgacggccacggccacgtcgccaagaagagctcggtggggttcatcctgccgaacctggaggtgaagttcgtggacccggacaccgggaggtcgctgccggcgaacacgccgggggagctgtgcgtgcggagccagagcgtgatgcaggggtactacaagaggaaggaggagacggagcgcacggtggacggcaaggggtggctgcacaccggcgacgttgggtacatcgacggcgacggcgacgtgttcatcgtggacaggatcaaggagctgatcaagtacaaggggtttcaggtcgcccccgccgagctcgaggccgtcctcctctcccacccctccgttgaggacgccgccgtcttcgggtaacacccttcttcttcttcttctctgaccgtcgaaacttcaagagttgattctggagtaaagttatggagcaatcaaaaccaagctttatatttctagtttattttgtgagatcatttcagccagcttcattctaattttgtatggagtttaaactttttagttggattttaattttaaaaagatggaattgtagatggagcttttgccatgtcctaaagccatgcatgcatggatatgcagggtgccggacgaggaggccggcgaggtgccggtggcgtgcgtggtgcggcggcacggtgcggaggagggggaggaggagatagtggcgtacgtggcggagagggtggcgtcgtacaagcgggtccgggtgctgcacatcgtcgacgccatccccaagtcggtgtccgggaagatcctgaggaggcagcttagggacgagttcatcaagaggatgaaaccgtcagcttgattaattaacagacataaatcattgtgattgatatcaagaaccgaaagcatgcaaggtgttaaattgcataaaaatggagttggataagtgtttcatcatcaccgagtatatgtacgtacatgttagtgattatcgtgtgaaattaccatggaaatgaattctaagtctttaatttaagtacatttatcttcgtttcttttttacaaatagccatgcttatttttttttaaaaaaaactaggaagatagtccgcgcatatgcgcgagcatcttatttaatattgtttgaatttttattatggaagcttatatgtgggtgattttttctttaaatattctgactctattctaaatctatttccgtcgataatttatttaagattgcttatgatttttttctaattacccttgcaacgtataaatcacttttattaggtcaattcttacgataaagtatattttcattacatggattctcatatatatataagtttaacatggtatgcttctcctagttaaccgaatttatagtggaatatccatgtaccaattatatttaatactggatggataccccacgtattgctgcggaatttttatatccttcggagcattcccctattgtcatgcataaagcaatattcctcattcgagtataaaaagataacatgaaaaattatatgaaaaattataggaaccaaaaactgaaaacaaataaccaagtatctgtaattctgagctggaattgcatagcatgaaaaaaaattatgcgaggttaacgtcaagaagattaaatataacacgtaatatgggacaaaataaaatggattactcttgaagtataaaattggatgcaaaagcatatacctaacaaaaaaaactaataaatttaatttggcattcagtttagagggttaaaaatgtacgatgcaaaatatttttcagcatgaggtcccaacgaactgaaatatgagcgggtgactgataactcgtacttcagatccacatgattgttttttcctcatagtccatcttaatacccatttgcagctaagtgtagagtattgaatgggagattctgatattccagagaaaaatataaaccatcagtgcacggtaatatgagaaaacaaaagtacaaactgacatgaagatgccacattaacggtaatatgagcaaacaaaagtacaaactgacacggagatgccgcaggaatttagagaggaatgggagggagaagagatcaagtaattacatgtgcttgtcggagtgattaaataattacacaatgatgttttaaccttttttattctagtaggattggaccatgacccttatagcagattttaccaatagtcgacgaatggatggaactatttatatacatgaggaggctatgcagcatgaacaccgatgaaatgatgagggaaccgttggtttttaggcgatatgggaggtgattggacgaatcgatcgataaacgtgcagacggacacgtgcgcaatattgaagtgaacttttacgtggtgtcgcatggcatccatcagggatggcaaaccgatcatatgggttgggccagttggctatgccctatgctgggctaggattaaatatcaatcgacatggatgaacagtcagatgagaagcaaagaagcggatagataaaaatcgaacagctatgctgctattagtaatgatgtggctcactctcaagatagcaaattagtattaattatactaagtgcgatcaattatatagttatactaaaaaatcggcatgcttagtcagcctatatatacttattatcactaaaaaatattacatggtaaaattggtgtgctcactaatatttaaaatatgtatatacttcattttcttatttgaatttttagagttttcataaaatattttaaaaagaaaattgtgaaccactcttttagttttaacaaatgaatatatgatattaaaaacatttatggacgtatatataaatgatttatttattatgtataagtgaaaaacatatgtgtcataaaaaatatagaactttatatcatgtcaaccaaaagtataaaatttaatgtgtcattttatacataaattttgatgaaatccaaaaaatttaatgtgtcattttatacataaattttgataaaatccaaacaagtaaagttatttttaagatttatcaaaattaattggttaaaatatatgatttgaatatttgaaagatcaattatttagtatattcagagttataggagtagtaccgagtaggcgtagtatatttaaagaaggaaaatgaatgtaaattcgttgttttagatttgtttttttcttaataatgttgggtttactatatattctagagttataggagtagtaccgagtgtggtatatttatagaaggcaaagaagtaaaagtttttgtgattgaaaaagggagatagttttggaagcctctggaatccata

SEQ ID NO: 79186 - DNA, 1009 bp, Oryza sativa
tttgctgttatgactgaaccccacgcatgacggcatgagaggagaggaagtgttggacacttgccgcggttacctgacgacaattttttagtgcttttatttttgaaagaacccagcaagctggttttattttagtgcttttatgcatgatgtttagctcagcaagtgaccaagtaatttgtatagtataaacttcctagaaattgtatgcagaaatgcaaatttgtctcctcgtcatgcagaagttcgaattacaaattacaaatgctaattatggtacaccaaatatgttgcaatgcagtaagcgcaaattaattacgtatactgcaaactttgcatacgtattagcaccaagcgtgcattttgtgatgattgcaagtttggtccgtggtttctctccatttgactcatctgggtagcttgacaccttaacctgagtttgtaaattttgtaacatgggggcttctaggatgtgtgtatgccaatatgtgtgtcttcaaaatactacgtatgtaatatatatgtaccatttctgaattgtaagtactgttgcagcttctggttagtattgagtggaattcagctgatggaactactaaagattccctttaagggtgtcgtcgctgatatcgaaggccgagcagcttggtacaagcatgattggcttgagggattccactctggcttcaggttaattttgtttcgaacaattaattttgcagtagatcactgtgtgtgttttcactcctcttgttgctgtcagtttcattccttaattattcatgttgcctctggatgtatcgtcaggatattggcacctactatgtatatattttttgcctctgccctcccagtcatagccttcggaacgcaactgagcagagaaacaagtaaatacctaccctcttgccactatgagccatactacagttgtgctctttttggaattgctgtccttaggctttaattacatctctaacaaagggaaagtggttcatttcagatggta

SEQ ID NO: 79187 - DNA, 1302 bp, Oryza sativa
ctagcaaaagagccagataggataaatcaaaaagggaaaatacatgcatgaagtatactaactccaatcttttagtacttattatttagggtattgatacaaggggttaactggatacataccattacaacttttataattttgtgatatgtcattactattcacctgtatcaagtcataccattacaatttcaccattatttgacatatgcaatacttacccgttgaacttattttctaaattttttttaccaaattaccccttctcctcttcatcccttctctttccactccccttcctcctatctctgtggatctggttctaaatgcatgggcagtggacaaggtgcgtggaggcggaggcgtaaacaagccacggcgtacacggagctggtggtggagacgacacacagactcaaggcaaagtttgtttgcagtgttgggcctcgagctcctagtggttacgcgtgcctgggccgcacgatgttgggaggctcggtgactatgtgtcagggctcaaaaccgggagcagtgctactgcgacgactcaggaggttatgcactatgccaagatcgtgcgtggcagcccacaaccaccatcgtcgctatcagatttcatgcacgccatcgtcctgggtgttgtcgtcgctgctgacaaggtcgtcgtgctactcagtcctcataggcacattgcttcgtcgcggccgccggaagaagggaagaggacatcgatttcagctactctgctggtttgtgctaccgctggatccaaagcctgtacaatgaccatggatgctgttggcttgagctcaactcaagtagtgtgctagtggtgtgaggactaaggattggggagtagtaacaagctgaccttagcaccgcctacccctgcgtgctcattatcgatccactaatacctaagctgccagattcattgggggaagatgatgaacaggagagaggaggggaagaaggaggaagggggtattttggtccaaatattttagaaaatgtggggtatcaaatatcaatacagttgtaatggtatggcttcaaatagagaaatagtaatggtatattttaaaatcgtaaaagttgtaatggcgtagatccaattaacccttaataaaatatcacttaacccataaaatataattaggagaacgctacacatcagacatttgatattttgcaaaaaaaatcagacggtgtttcaccacatataaaaaaaatatttcagatgtttcatcaccgttgaacaatgcttcactagaaaatgtttcggatgtttcattactcgat

SEQ ID NO: 79188 - DNA, 2407 bp, Oryza sativa
cctaaaactccaacaaaacaaacctagctacctccatcttcttcaactccggtcgtcggcccccgaggaaacccacctccgtcgacttcttcttcaactccggttgccggccctcttcttcttcaactccggccgccaccccccgacacctacatcttcttcttcagctccggctgccatcccctgacatctccatcttcttcttcaacttcggtaagccgtgcctccgcctctccgatggacggcgccatggtgcgacctcaccgctgtcgtcctctgcctcgtccacgaacgcctcccatgcctcgtcgattggcgccgcatggcccgcgtatgccacacctggcgcactgccgtcaagggggagcagagcagaaactgccggagcgctggctcccatggattctcatatcgtcttgccctccgtcgctgccgttgtgtggccaacactggtgaaatagcaagagagaagaaattaaagagagagaaaagaaggaatgtgtggtggagatgtagctgtgtgtgtggataaggacgacgttcgtccgtccggaagcatttttcagataaatatctttacaccaccatgaattgtatgggacaatcgggcgataaattaagatggtgaaaggaaaatactctgtttgcttacagaccaaaccctaatgaccccacaatcgtcccacaccaagctcacaagtcccaaccgtcgcttggcgatcggacggcgtggatccaatccaacgagaccctcccccaacccttgtccgccgcgtctctcgccgtcggtcgcatcgcacccccgcgaatccccccccacaggccaacagcaaagcagaggcgaagggaagaagaagaagaagaagcggcggcggcggcggccatggcgtggcgtgcgaacctctcccggggcgtgaaggagatccgcttcctcttctgccaatcctcccccgccagcgcccccgcgaggtaccgtccgctcccccgtctcccctttctctctctagggtcctagacccgatctgaagaagaaccgcggcgattccttcctttcgcagggagttcgtgaagaagaactacggcgacatcaaggcgcgcaacccgtccctccccgtcctcatccgcgagtgctccggcgtcgagccccagctgtgggcgcgctacggtacgcgttctttttttttttcctctcttctccatggaatccgagatcctctgagccggttcttgaactttttgttcttatatcttttgcggcgtgaaatgttaggttaggataccggatcgtgttgtcttttagagttgggcatcataggttacattgcttatgtaaaatactagaatgtgtgaatgcttgagaaggaatggcacattaggttgattgcgatctgaatgctttctttaaggaaaaatatttatagagaagcattaggtttgtccaatgatataatgctaacacaatgttgttaaaaaatggccaagatttggagaaggagaaaaacaggggacgacaatgtggactagctgtagagttattgttgtgatagtaagatcatctgttcaagtccacactttcctgtgggttctactaattaaaaacctaagatacatggtttctctcatatgttcttggtatttttagacaagaaaaacattccatgacaattgtgagtgttacttctattctgcttgatctgccacagacagccaaatggtattgtgcgtgcagatgttcaaatgaactactacatgcactggatctggatttggtataacttactacaaattacagacatagtgacaacttctaactcaaggcataaacacaaaaaaaaactgaatagtctacatgactgtgaagaaaatctagagaagcttaggggatgtttggccaactttgggttaagaccagctcacaggattgacggcttaaaagcccaaagctcgctttattttgaaaatcacacacacacacacaaactctttgttgggacttgggatcttacttatggtccatatggattcttccaatattattacgatgatactctgggtatattaaggttccctcttaaacaccggcatttgtttggatgaatataaataaaagattgggatagatggaagagtacccatatggagttgtctatgtgagcaggttgaattggttgaacataatgtgacaatacctagggaactaggaaacactcagttgtaggcacctacaggtggtggaggtgaggagaggtaagatagggaggttgccttatagtttatagcccaaagctagtctaacctagcaaacaaggagaaaataaatattttctgtgaggataaatttccttttacgcattgggatcgctaagatggttaggattataaacttatcatccatcttacccaacca

SEQ ID NO: 79189 - DNA, 2176 bp, Oryza sativa
tattatggagttcttgatagctatttagattgaaggatctgatttctttctctctctgatatgctgcatttgggatcaaatgtatgcaagcaaagagatggggtaaaaggggacaagtttcagtgcgtgacaggggaggggctacagaactccaatccaccgtaggtttgtttacaagattagtcatagcgagggatgcacataaataagatctgtactggtatactccatcccttctaaacaaaaagagactaacctaagagagtccgacatagacaacccgcttctctctcttatgttactgtcaggggagtccgtctttcccgaaactaaggccctatttagttgggaaaagtttttgggtttggttatcacattggatatatggacacacatctgaagtattaaacgtagtataatgacaaaataaattacagattccgtcagaaaaactgcgggatgaatttattaagcctaattaatccgtcatcagcaaatgtttattgtagcaccacttatcaaatcatggcgcaattaggcttaaaagattcgtctcgcaatttacatgtaatatgtgtaattgattttttttttgcctacatttaatgttttatacatatgtccaaacattcaatgtaacagcgcgattttttttccagaaactaaacagggcctagacccctgcatgggccacccatgtcatactcatagaccatctatctgcgagacagcgagaggtagtgtagcaaaacggctccgtgcaccttgtcccgaggtcccacgagtgcaccgggtccagtgcaccaaaaccaaaccaaaaccccccacccccacccactccgctcctcgtcctcctcctcctgcaagcttcctccctcctcgcggccatggcggcgccgttcgtctactgccgccccaccgacgacggcaccagttcgtccagcctccccccacctctccgcatctcctcctagctcgatcggcttgctagctcctcggccatgtggtctaatggcgatttctcggtttgttcgcaggtgagagcgctctcctgagggcggccttcgacgggaacctcggacgcctcaaaggtaggtttgcttcctctcctcctcctcctcctcctcctctccttcttctccgccgcgtcgatcccccccgatcgatgcgtgtatgcattgccccccctttgcatgcgcctgtgttgcgtgcttttcctcccttaggtttgggtgatgcatgtgtgtccttgtgtggagcgcttggcgatggctgtactgttaattgatttggccatggaattttggaatgcaaattctgtatctagcactcgttgcctttgggaatttcccacaatttattttcggtaatgtttatatgttgcatggatttttgaccctgcgtgaaggaattaacagccaggtctatggattactggagatgcatgccatcttatctagaaattgcaagatctgaggcttttatcgtagcaagtccttgcgttggataaatgcgacaacgttgtgatcatctttctattacagttacctctccaagtgctaatgtgtgatgagtagcaggtagtactctacaaaaatgtttttcaagtcgcaagtatgaagtataggttcacatgactcagtgaggttcttgcacgttgcacgtattcgtcgctttttcgagttctacctagttaatctgttcattcgcagattatcttcctcactgtgatgacttctttttgttcttatttgcgagaaggtattttaaagagccttgggatcgagaaaggaaagacccagtatgcagtcttagctcttaacaagcatgggattgggatgctgcacgccgtggcatgccagggccatctgaatgtttgcaagttcttggtggaggaattggggggtgacgtgaatattgctggaaaagaaggttattatctaactctaccatcctttcatgaaattggcggctgccatgtctatgttttggcagtataatgtgccaagtgtactgatgtgctgtttattacagatataacaccgtttatggccgctgctgagtctggtgatgttcctacggtgcagtattttcttgatcatggtggtgatgtaacaaaagcagatgttagaggatgcacagttctccaccatgctgctggcacaggtctcccttg

SEQ ID NO: 79190 - DNA, 931 bp, Oryza sativa
aactgcttgtctctaaattacatggctcagcttccatgctctgaatatcttggggtggttctcactaaattaagtgtgtcaatttttcactatagtggcagaacagagaaatttaaccaccagataatcacaggaataaatattcgaggaattaaattaagttaaccaactgaaagtctgaaacttcttatgcatgggtagtctcctagtcaatacaagccccaaagctggagctaagcaaagacttaacaaataaaattcaaatgttataattaatcattggcgaaattgtcaaacaaaaacagaaaacctcatgatattggaacttggtagagtaggagtagtaccagcatcactaaacaaaatatattctacaagggttctatcttcttaatgaagatggtcctcattatgcgtttacaataacaaagggacagtaaaacttctttccgaatgcttccattcccaataacttatactataacaaatagtctaatatatatcagtgaagtaacagatctagctggtttttttttaagaatgaaaaatctgcaatatttatatcactaatacatgtgattgccattcactgaactcgcgaacgtcgtcctcgcggtgcaggacgtgctcgccgtagagataccggccgaaggccaccgcctcctcctcgtggtgttgtctctgtgcaggacatgcttgccgcagaggtaccggccggaggtcgctacctctttctcccggtggatcagacaagatggagaatgaatgtgaaacaatgacaagagaaaagaggaacgattatagaagatgaagagtgaatcaagattatagaagaccaagagtcgtgacccttccggaaatatcaggtggctttgcactttttgattttactccaacgtaagattgttttttatattttagtccttctcaa

SEQ ID NO: 79191 - DNA, 2495 bp, Oryza sativa
atgaacttgatcatcagtttactcgacagtactatcaacaccatcacccttcttgttacgtatactcaatggtgcaatcatcctagggaaatctgattggtcgtaactgtccattgtacaaggaagtatcatggcttgtcaaagccacacttttttttagaacacgcaggagatctgcgtatcatttcattgagatagaggaaaaaaggtggatggcgttagagataaactccgacacccacccacccggaagtacaacaccaacaaaacacacccacaagaagcaaaacgaacctagtgcactagtacgacagccctagacaaaagatcacgaagcttagaagctcctggtaggcaccaaagggcgccctcacttgcaatggcttgaaggacatcagccatgcttggggtagtgccattaaaaacacagttgtttctatgcttccaaatctcccaagcgaccaagataataaaggagttgagccccttcttctcactagcaggcaatccccttattgtccttaccaccaactggcgaacctagtagtgccctggcttggaaagttagagtagccaagccgttggagaaccaaacaccacacttgctgactaaacacacaagtgactagaatgtaattaatagtttgctgaagcggaacctggttagtaaggccgcaatgtttttaaacatagaaacatcccaagtatatactcaaatatatacatatggactctattctgatagaaatataaaacaatatttaatttggtgatgacaactataatatggagtgttattgatcaatttgtaaaaaccagatataatcatccaagtacttgtaacaggtcctagtcacctataagttgcaaaaaagctggtattttccgaggttaatgggtgttaaaactaggtagttaatacttgtttcaactcttgcttcttattgctcctttattgttttgccgtggggctccagtgctaagctgatttctctgtctttctgcacaaagatcatcatcttctcttattggcaaattttcatagccactttatagtatgtagataggccgttcatttgagtttacatacataaaacgaaaatgtatgaaacaaaaagttacaagttcactgtgaagtgactgagcgatactattgatgagactttcttgtatgtaatccatgcgcataattcatgtgttgttgatctcctaagtgcttatgcatgttttttcacgcttttcagaggttcattgtttccaagtattccactggctcaattgctgtgcaagcctcatttttcttattattcttgagtgccagtggatcaaaactttggctcatactgtttacattgcataatgacagtggccgatttcatttttgcactgatgtagtgaatttcatgttgcaccatattagctgtcaccctactactacatcattactacccatactccattatggttacagtgaccttgatacaatataatgtgtttgaagatttgattccaacagagttgacttttcggtagcaaatagaggaataacaaattgccattcacgttgcttattgttgtagctcattgtgcttggtattatattagttaggggccaagcgatataggatagtttgcctcatcatttataacttcatatgttgattataaaattaagatttgagttacttttcccaagcacataatggtccaaaaagttgtagcgtctaaacttgtaatttaatcgactaatactcaaatactccatacacccaaaaatgtaagttgtttgtgcctttacagtctcaaaagcaagactttgagtattgattctaataataataatataaaaataaaatataatgaataactaatgtatgttgcctgaaaaaataaataatactagttttctcatagtcaattgatatgatttgcaagtattaattgtttgcatgcttcctaggatgacttccattgtgggacagtgggagcactatatattggtctaatttatcttcataaatttgtagcaatttactctatgtcaattgttagaagcttagagcaagggacacctcaaatatgtctagtgtatgctacgtcctgcaatataaatacaacctgtgcgaatattttgatattttatttgtacaaatgggaactgagaaatttgttggggagaaaatccgatgcgtccacacttatcatccttttagaaccttgattggaatactgtggcaggcccagaatttgtctaattaaaacaacctgtacatgtcactaaatggaagcaggctaggctaccctctggattcgagcaatgatctgtttctatgtaagaaatcttttctggatggatttgtgcatgactgatgactatgtatattgtatgttatctttgaatcttatatataggattatgttatctatgaatcttatgtataggattgtgccttttcatatttatatattattaatagtgcacattgcttttctaa

SEQ ID NO: 79192 - DNA, 846 bp, Oryza sativa
caaaaggtgagccatatgaaccaacatcatctattcccatgaatttcaaagaaagtatgaatttttaattaacattggaaaatgtaatgaaatattttttttatttttttgcaacgcgtgagcatttagctaatagtagtagtatagatacagagtattcaaaactaatctcaaaagaaaatcaagttcaatgtggcatttcgttcattgttctgcgagctttacagccaggccatggaactgcctgccatttccgtggaatctggccatctgggcctatctatgtgggctgatgacagttcgtgagccaggccagaacggactccataggctaaatgggctgggctttgcaaaggccgcgcgaggcagcccacatcaaacagggccgtctttgatgcacacagtacgaatctgggccgcagaggctaatcgaacggctggtagcgacccaccagagggggtcatctttccagtgatgacggcagcagcaaccttgatgctggttgctcatctttccagtgatgatatatatacagattttccagtaaaatcaaagcacgcaattagtgatcatgatcgaaaaatcgattgcatgcaagccatcagcagcctgaaaataaaggatgtagattcagttatgcaatcgatcggcctaatcatgcagtagtttcgcctgaaaaaggatattagattcagttatgcatgcagcttcgaaaataaaggcagtgtaacgtactcccacttcagataaacttgttcaagatacaggtcagcttgaacatacagggatagcagatagctagctgggtttcagaatttcgttcagctggttaataggcaaaaacc

SEQ ID NO: 79193 - DNA, 698 bp, Oryza sativa
atcaaaattgaaagtttggttgaaattggaacgatgtgacggaaaagttgtaaatttatgtgtgtaagaaagttttgatgtgatggaaaagttgaaagtttgaataaaaagtttggaactaatcaagggcctaatgtcgctgtcagatgagactcgaagtcagtcaatgccatagcgcgtttttcttctaatgtcactctcggatgagactcgaggtcagtcaacgccatagcgtttttctcctaacgtcatggtcaggtgagactcgagtcagtcaatgccatactgatggcttgtttaaggtccgtttagatcccaccccaaaattttacaccctgtcacatcgaacgtttgaatacctgcatgaagtattaaatataggcttaaaaaataactaattgcacagatgcgacaaatttgcgagatgaatctattgctccatgatttgacaatgtggtgctacagtaaatatttactaatgacggattaattaggcttagtaaattcgtctctctgtaattagttttttattagtgcctgaacatcccatgcgacactgtcacgcccgggcaacggccgaagattatacggatggaacgaaggaggccgcggcctccgctggcatagttggcgaggtatggtgatgaactggtatagaagaaagaaagaaacgtgcattagagaagggctgcaggaat

SEQ ID NO: 79194 - DNA, 3221 bp, Oryza sativa
aactttgcttccgacatggttggttccattccaccaagtttcgacgtcaggggaatgggacgaggttaaaggagtcaggttttggaactgacagattagactccaagtttgtctagtaaaaacgcattcactgaacagatgattcgtgtcttcaaaggcgcaagtgcacaggcagcaaatctaattacatggccaatgtcttcgaagtaaattttgtgcagtgagagttttttgatgaaggactagccatccgaagaatctcattttgggttctgccggggccttccaaagtgaaaggtagtcgaactaagcaaaggaccctacaaactggtaaagatacgcacttttggctgtgtaggtacctgaatcagtccaattccaggtaatgttatccggttcttgggaaagcgtaaccagatgaagtaaactggtaaagatacgcacttttggctcctagctgcaataactcgtgaatttcctccactgaagtaaattgtctgaaagaggttagccatttattatttgtgagttcaacttgcaccgatctttgttttctgtttgccagactaaaacatcttggtgcaatgtcttttggacagcgattttgaagccagttgtcatgccaaaatcttgtttttgcgccatttccaaccgaaatagtcgttgcagcttggaaaagtctatggtcagattcatcacaaggcaggctcatgcccacccatggcttttcttcctccttccaattaaaccataaccaacgaaggcgcaatgccctggaaaaacgctctagttccaggacaccagcacctcccaaggcctttggtttacagacggtttaccagttgatcagactatctcccgggtttgaatggtcgggatcttcacccttccataggaaagatcttctgaaacgatcgattcttttgaaaacccactttggagcttgtaggacagtaagatgatgagttggcatagcacttagaacagatgatactagggcttgacgtcccgcagaagtgaaaaaacgccctttccaacctggtagcctagacccaatcttgtctattaaaggaaggaagtcaattttccttagttttctgaaatgaagaggtagtccaagatatttgcaggggaaatattttgtttggcccggccatccagcaagaagattttgcagatcgatgccttcgcatctgatggggtagatttcagttttgttgatatttgtgtgtagcccagaagcttgtgcaaagcatgccagtatatgagaaagagctgtcaactcttcttgtttcgggtttgcaaaaaccgcaacatcgtcagcatatagcgagcacctgaatctcccatttcttaccccaaggggagcaaggacattgacattttctgcttcttttaggattcgatgaaaaggcttcatagccaggatgaaaagcattggggatagtggatcaccttgtcgtaggcccctagcatggttgattttttgccccggggacccatttaagagcacctgggatgaggaggtggagaaaagattagtgatccaatttaaccatcggtttccaaaaccaaattgtcgaagaatctctaggaggtaggaccaattcacggtgtcaaagccttcgcaatgtctatcttgatgaacaggctttgtttttttgtcctgtggagcagctttaccatgttttgcacataaaggaagttgtcgtgaattgcccttttgcggacaaaagcgctttgattttgagaaatgtaattgcaaatttgcctatttacaaaattaccattacaattcatctattcgtagccgtgtcattgtaattttacaaaattagaatcgtgccattgccgtcatgtttaacattcatctccttccttttccgtcttcttctttctttctcccatcttcttctcgaagggcttacatagtgccgaaaggcttacatagcaaatatgtacatttttataagttggcgatttgggtgccacccgtttagacatagaaacgcttgagggaagcagcgttccaggagtggtcgaactcttcgccttccagcgttgctaggctaaccactacaatcaagcatcagttggcgcagcgtgcacttcgtggcgttggctatgacctatggtgtatatgctagaaaataaacagcaagcaaggacatttgattctacacgtcaacacaaggatgaaagatcctttctttctctctccttgcttgaacagtgcaagagagctctccagttctttctttcctttgctcatcggaccctttgtcctctctgtctccgaagtcaccatcaccagttaggggatgggggtccgacgagtggtcgggcttgtcccactgtcaagttttacccacagtttgtgcaattcagtagaagaagttgtgtcatgctccttcgtcctagaggtgcttagccatggatggagttgctgaaacctgtttcagtactccctattccaccagtactcatcaggtaagtactagacaccctactcaagtttcagtactccctattccaccagtactcatcgggaaagtactagacgccctactctttagtgtgtttagcttccaattctccaaatttgcatgcgaagaggttgtgccggcttgtccaactcttcttgggcaactacattcagaatgatgcgaacccgctagggtttgtggcccgatctttcgatgagaggtaagggataactcaattagatgaagtcgacgttcacggcccgactacaactgtccaaagacgctgcgccttagcaaccgatacaccgtctccaatggtcgccgcgaatttgtggtgcgcgtcaacccggccacgagggcactcgtcctgcaagcaatcgaagaacaagcaagaacaagtaggacaagcactgaaattgctagataaagatgaaagtttcactatcaaacacaatatggtggggttccgattacaggcagacgggcggtttagccaacacgcgcgctgcgagccggtagcaagaagctatctctatcatcaaaacccgcctgttcttggcggcgactagaggtataagaagaggggaagaacgaccatagggtcgtgctccaaccctaagacgcgcccctaatgggcccaacttggatacacagcccattgggccaaaagaggtgacgcagcaccatggacagaatatagtcgggagtaaaatgacaattgcggccgctccagaa

SEQ ID NO: 79195 - DNA, 1186 bp, Oryza sativa
ggaaggggaagggtttccagtagttgagaccagctgcaaatatatccattatttatatcagtatctcccaaattttaacttgcaatgatgcagtagagtttttttttttttcgaacgcacaaaagctttgcatgtcgcaatcagagttattgttatctacgcgtggtttcatacaatctacctctttcgccaatactaataaattgtgtgcgtgttaaaaagttcattgtacagtggtggtggaatttgggaagaaaccatcagaaaaatcactacaacataaacagagcaggatatttgtgtacacggtacactacaccaatcagattacttgagcaatcagcttgcaataacccggggctataagaaaggaaattgacaatgagaaactgccatcgttggcatttggcagtaagctaaccggatgcccggatgtcaataaattgacagttatttgttgacagttgggaaaaaaaagtgcattggcgctattgttcatctacgcatccggtaagcacatcaatcacaacgagaggatcgatcgcgacgagagagagaggatggacggcggcggaattggggaggagagggtgggcgtacctggctccgttgtccccgaggccgtggagccagacgatggtggccttgtgcgcgcccttgggcctcacgacatgcgtccgcccgtactcgagcctcttcccacctgcatccaaccatccaatcccacccccattttacgattcgatcccaaatcccccaacgcattcgaatcaaaatcaggagcatcacgaacgcaatcaaatcacagcatcaatcccatcccatttcacgaatcaatccccccctcctcaacgcattcaacaccgatcaatggaacgaaacgtaccaccggaggcgacggagctggtgccgccgaagctgctcatcccgcgaacaatcgccgccgccgccgcccctccgcgtcccctcgcggccacgctcgctccaccacccaactctgcaaacaaaaaaaaaatccaatccaaaccaaggtaaacaacccaaacatcaccaccaccaccaccagataaaggagaggcgcgcgcgcccgtgggtaaaggggggagaagtgaaagtggaagtggcagtggcgacccaacccgacccgacgggacgcgacgcaatacaaagggaaagggcgatttgg

SEQ ID NO: 79196 - DNA, 1622 bp, Oryza sativa
ctgcacccctgtgctcttccggtggctcattatctgcatggtcagccgcaagcaaagcaagtgtatcatcatcgaaatcaatagcagaggagtactcaccatcgtttttgactaccaaaactcgcttgctagggcagtcacgctgcacatgcccaaagcccttgcaacggtggcactgaacatctctcattcggcctgtggatgccattgaagaagcactcggtgctggctgagcagcctttgtcgctgacttgtcactagatggaggaggtgctgctcgactggttgtgggtgtggaagatggagaaacagtacggccggccggaggagtggtgcgtgtctgccatgatgaagttttacctgcagaaaaattagccttggcactagcacgtcgtccctgcacttccctttcagccttacaagcaagatgaaacaatcgggtcatattagtgtaatctttatagtctacgatgtcataaatctcgcggtttaacccacccaaaaatctagccatggcagtgtcctcagtttcctctaaattacaacgaagcaagcccatttgtaactcctaataatattcctctacacttttcgcaccctgtctcaattgttgcaacctattcagcaagtcacgtgcatagtaagaaggaacaaatctagcccgcatgacccgtttcaaagcatcccaagtttgtggcatgttattaggatttttcttgccatgttctatccaccataccgaagcaaaatcggtgaactcactcgtagcagctctaactctagtgctctcaggaaactcatggcatgcaaatttttggtcaacagcaatctcccaagagaggtacgcatcaggatcatattttccatcaaaaggaggaatcttaaatttaattttagaaaaagcatcatcattattgcgtacctcgcgtcggcggcgaccacccatacctcgtcgattgttgtgtagccgtcgacgatctcgagcatctcgatcatcttgttcagtgtcagcaatatattcatcctccaaattatcctcgacgtactctccgtcaatgtcatcgtcattacccccaccattgcctccagcattgagagcatcaaaatgcctcacaagagcagcaaggctagtgtcaatgcgggcgaccgctgtctccagccctgtaagcttagtgttggtggagatctgcgtggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctggacctgccatggtttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagggggacagcaacccacaagttagcaaccgtggaacgaggtgtatcggtgctgtagcaacaagacctgtcaagctgtagtcgggtttgtggtggagctgttggtgggctgaaagcaatgctcaaga

SEQ ID NO: 79197 - DNA, 3015 bp, Oryza sativa
gcgtctggcgccaacttccataagcggacggtgagcacgccgttgtcgagggaggcggcaatggagtcgaggtcggccgccgcccacatgacaaaaagggaagggagagaggacaaaggagtagagagcggttgccgccgctccacccgtcccgctccgcaccgccggcctactctgcccgccgtcgctgcttcggcctcacgccccgctccgctgccagccgtccagccccgccgctccgtccttcgccgcccacatgccgaaaaggggaagggagcgatgagtcgggagcggtcgccggtcgccgccgctcaacccgtcgcccgctccggccaccccgctccgctttgtagcttgctctggcggtcggagctgccgtccgctcagctccggtcgccgcctgcctttgctgtgagcctctgactccagcgagaggagaaagagagatattgaggatgacgtatggggccaatgggccccaccatttattattattgttgtgcgtagctgacatgtgggccgtatgagctttttctagatctaattgccacgtaagcgccacgtcaatgccacgtcagtcaaaaccagagaccaatactgccgagggatctcatttgcatggttttgtaagttgagggatgttttgtatctggttttgcggactgaggacgaaaatcagattgggcgacaaattgagggacctagagtgaacttattccacgacggggcactggtagttccgaccgtttagcaaaaagttcactttgtgtccttcgacgggttgggttttgtccacgtacctcaaccgtaaaaccaaatatacaaatcccaacttgatgcacatgcacgtggagtgggtcggggtcgacccatctaccaattgacccagctcatataacatatggggccaaaacaggactgcttaggaatcttcacaggaaccgtacagtaacaaatgatcatcgtgtaataacaggatcaattccttgcagtaacgtcattagaatatagtgataacgaatttagttttgtaaagttcttttttaaaagcattatgatgcgtatggttcgaaaatttaatatgtgatgtgagagatatcattatttaaatatttgaattccaaacggatctacttagcttgctaccatgtatatttgtgtgtgcaaagagaagtacttttagcacttgtgtcaatttgtggccatgcatctctaatagtactataatatcacaagtacatgattaccatttttaaaatttaattcttgacaaacgatagttttatagcagtaccgttactaataatactacgatttcacgacgatgttactgccaaaaatatgttctgcagtaacatgacatgttaccgcacttctatgatgttaataaatattgtaacgacgttaaaatatattcatgatagatctagttttgttatatttttttttacgaacattgtggtgcgaatggtcaagaaaaacaatatataatgatagttttctcttaagattgcaaatttcaaatttttagctctccataagcagaagtacaatagcagtattatttccaccatatgttgtctgctactgccatttctatcctgatgttactaaaaaactgcagtaagaacgtattttctatagttactacacttccgtgatatatatgttctcagtgttactgcactccctcatcgccatccttcatatccgtcggacctgcatattctcagtgtcctcgtcgccgccgtccagccctcatgtagccggaggagcttgtggtcgctttctcccgtagcctcaccaatttatgccggaaatctcctcgattattgatgctactgcgcatccggaaaaaactgagtaaggaagagaggaatggtgggatacggtcagacgaatgcttatggacggtataaacactcacaccaaggctctgttcacaagtttaggttcccaatccaatcagcatttacggaaaatggatagtgctcgtatagcagtaaaaaaaaaagttactacagtagcacgctggactatagatgctacttaactaggtgacatgcagggtgtcatgtaacaattatatatataacttaaccgctcccctcatgtaacctcctccccccaccccatcccacccccaagtttttccttttttttcttcaaccgtccgtgctccttccgttccctcttttttttttttctcgtgcactcgtgttgtcttgcttccctcacataaccattgataaaacaaatatattaacagtttactttcgtgttgttttgcttcgctcacataaccattgataaaaaaattattaacagattacttctgcacccaaccaaccttcatttagtaaatgaattattggattttagttacgttggaggctctgtcagaaaatcagttacttgcaaatatatcatttgattagttccttaatattagtaatgattttactatttagttaaataaacccttctactattagtaatatttttattacctagtcacctgtaataatatctttatttttttaagttattttcagtagctcggtgccttatttgtcgtagtactaccaagtgttctttttatttttaatgctatgtatcgatctattagtatttttttcacgaacgcttattagcgcatagtaaatgttttattggacgatgacatgagaagagtatttttctttttccaaattagcctccacagcatgaatacaatattacagtgtgagtaaacattttactccatgaaaattgtaggctggttatatcacatgaccaataaaatttggcaaattttgctacaggacactgctattgtgtggttttagccctaggatattgcccaaacttatttttaagggaaaacactccataaacatggtaatttgccagtggagaccgtgtcgattaaaataataattttcggttgaagaggagagagaaatcatataaaagttctaaaggcccttgggcccacatatcatatcttccatc

SEQ ID NO: 79198 - DNA, 1157 bp, Oryza sativa
acatcggatatcacatcggatgtttggatactaattataaatattaaatatagattattaataaaactcatccataatcttggattaattcaagagacgaatctttttagcctaattaatccatgattagcctatgtgatgctacactaaacattctctaattatggattaattaggcttaaaaaatttgtctcgcgaattagctttcatttatgtaattagttttgtaagtagtctatatttaatactctaaattagtgtctaaatatagggactaaagttaagtccctggatccaaacaccaccttaatctcaagttggagtgttccactagcctttgcttgatgtcggtttcagtgtctctttgcttaattgagtgagttgagccatagcttgacaagtaataaatgattagttaaatggagtagtataccactatgatgtgtgacgtgtcttaggcttcgtttagattcaaaatttttttacaaaaacgtcacatcaaatatttagacatatgtatcgagcattaaatatggagaaaaaaatcaattgcatagtttacatgtaaattgcgagacgaatattttgagcctaattacaccatgattttaacaatatgatgctacagtaaatatttgctaatgatagattaattagacttaatagattcgtcttgcagtttacaggcggaatctgtgatttgttttgttattaatctacgtttaatacttcaaatgtgtatccgtatatcttaaaaaaattgaaaattgaaaaggaactaaacacggcctatgacgtgtgcgtccggtgataaatttttaattgtaactagttaaatatatctcttgattttaccgtggagataaaattaaaaaaatatataattagtgcgggagacgacgtggggtgggttctcgatcgaaggtttagtaaatgtaaatctgggggttctgattgtgtttatgcacgtcgttcggagaagaccgagacgtagatgcgagattagttagataaattcaggttttgttttgtttgttcctagtatgtttttgattttattattattattattattattattattattattattattattattattattattacaaaaggaagggcaactttcggtttgtgcgcgacttaaaaatgca

SEQ ID NO: 79199 - DNA, 4204 bp, Oryza sativa
ggtccatcttttattccgctgaggacgcagaaatcaagtgggtgcgtacctctcgtcaccgtcaggtattgtagatcgtatctgtcccgcaccttgtgctcaagtgtatccgcttccttgctgcgaccatgtcggcgagaaggtgctgcagagaggcgtgagtcgtgacacagggcacaacagggtattttgcgcatttcaccatcgtacagtaaaaatattagaaaaagacaatcacaaataaaaagacaatggaaaaaaatctactgatatgagcccagccccttgcacaggctaattacataattgctgttagttcctttaactaactagagtgcatcgccactggaaaagcatctgaatcagaccgcctacctacagttcagttcatgcatttcaggccagattaaggacggcgaacaagacagcattcctgtggcgccatcaccactggcatccattaggacctcgatcacttaactgtatgcaatatatcctcctgttccttttcccagcttcctgaacataataaagtgaattcacgaatcaaaagaaaattcagatgggagcaaagaagggggtgctgattgcatcgtgaaaacaacactatcaatagacctgatcatgcaaccatggttttgatcactgcgaaaaccatgggcgtgaaagaagtgtagaaaagaaagaagaacaggagaaagggagcagaacatatcgaagctggaggtgatgctgggcgaatggaatcgctcatggtgttgtttgtctagaacctgcacacaagcaactacacagcaccaacaagcgttatcaaaatgaggaaaaagggcttgagcaaggtgaccttgtcctcggtgaacatggaacggggaaggagtatcttgaaggattcggcatccaccaagaaccgacatggcgctgcatcaataaaacgagaacctcccaggcggccattagttcagatctgaggaaggaaggaggtgcaagctgaccacatgattaagatctagtccaccaccatcgataccaagaacgcctcgctgcctcgaccatgccggcggcgacgcctggatccggcggcgggggatcacaggcacgcgatgaggtggtcgcccccctgccgcgccgccgcctaggctgccgcctcctgttcgacgaagctgatgccgaaggtggacggccgggcggacgatggagaggcctcctgatccagttgttgccgctatcgcttagagaggagctgcattgatgtgcgctcgatccgccgccgaggatgtagcccaatccacgttgccgtcgaggtcgatgccgccgctcgatctgttgaggcagacctccgcgtcggcactgccgaggtcctcgtcacatccggcgatgaggacaggaagggggcaagggtggcgcctgatggttggatggcggccaccgtcctattgccaactcacaactggacgacgcgccgccacacctccaacgccgacaaccagcccggatctcgcccgccattcgccgatcctaaaaaaaaggggtggacagcgacgggagtagggggcgatggtggcggcgctgcgtggacgggggaggtggcggcacaagggggacgccgatgtggacggggagggtcatctcggcggcgtcgaagccagctctacctcaaacccccgccgctggatccaggcggaggacgaccgccgtcgccggatcgggcgagggacagccccgccgagcccgtcgcccgccgttggcgcaggccatcgtcgtcgctcgctgctggcgcaggccgtcgccgtcgcccgtcgttggaggaagctggagggaccccgccgcctgccgcccggcacaccgaggaggcccaagccggcgaccgcccgccgccgacctgcaatcgccgctcaaccgcctgtcgcacccgcaggccttcatcgtcgctgccgatccgtaaaaagtggagatggaggggaaagtgggtgaacggtttctacgagggagagggagggagtaaatataggcctgtttggatactccggctattaactaatccataattagcggctccgggctattaactaatccataattaacggctgattactatagaatcactgtagcaaatcatggattaatatacctcgttagattcgtctcataaaatagcctagaagttatggaataggttttatcagtaattatgtttaatactcttaaatagcaagattccggagcgctatttaatagccctccgaaaccaaacatggccatagttagcagatagagttgatagtaaaaaatttactccgttaagcgtgggaggaggggatgcggggggatgggtgcacgggagggggggtggggtgtatgggggtgggtgtgagggggagcattttagctattacacaacctaagtctatgtgagtttagtatgtatgtgtatgtatatatatatagagagagaagagagagagagagagagtatatagaggtgtatatactccccccgattatccattagcatctgatagggccacggtgagtcagatttttttaaagaatgtattttccttgttttttgttttagttttgttttagtacacatctgacggagtgcatgtgtttcaaattttaaatgcacgtaactgatcgatctaaacacgtggaggcggtggagcgcacgcttctctggttcaaaatgattataccatatacttatttttcttcttcagaaagtagtactagtactagtatgtacttactttttgaatatcacgtcctttgctagggaatggtatatgcttctttatcttgtagaagtatatactatttcttaagaatggtatctctccttttttttacacgggtatttactgccttttctctaattgtatatactaaatccatagttgaaggagtatgtactgttttttaagtatccgataggtaaggattttttagtattcagtatattagtcgatatactatttttcatccggtatatatatactaaatctcatctctagccgtatatactaaatccatcgttgaaggagtatgtactgttttttaagtatccgataggtaaggattttttagtattcagtatattagtcgatatactatttttcatccggtatatatatatatatactaaatctcatctctagccatatatactaaatccatcgttgaaggagtatgtactggtttggttttttaagcatccggtatgtaaggatttttttagtattcggtatattagtcgatatactatttttcatccagtatatactaaatatcatctatagccgtatatactaaattcatcgttaaaggagtatgtactgtttttttaagtatccggtatgtaaggattttttagtattcagtatattagtcgatatactatttttcatccgagaactgctacaaaacgggatctcgttgcaacgggatagacatattaactgttctcttgcacgagtatcacaggtatcaggtcctaggtatcacagataccaggtaacaggtatcacaagtatcatagaagggtatcccgttccaacggaatcgattggttaaggaatatgtactgaattttcaagtaccagtatatattaattctctcggttaggtagtatttactgcatttttcaagtatatcgatccagtatactgaatcacttgttgaagcagtatatactacttttcttatgggattcggtatgtagtatagccataattgatattcaagctatctcagaggtcgcccaagtccccagagccatcgtcctatccaaattttacattggttttccaattttgttaacaacgcataatcgtactaagtcaaaagatactacatcgtcctcagggaccttgctccgtccagtccagtgcaaaaagaaaagctatagttttcaaggaattcaaagggtagggaacacaggtagctcaagctagctaggtcacattattttccgaaaaaaaaagttgcaagttcacgaagggtggaagaaaggaatcttacagtggtatgatggtgttcatgcctttcttgccttccatgtttcttaagcataacttctccctggcaaatgttctttctcctctattttccatctccaactatgtcagcaaaagaaatctttgtccgtggaggcaagcttatgttctcatctataaattcatgttcatcaacacccagccaggg

SEQ ID NO: 79200 - DNA, 1557 bp, Oryza sativa
aataatatgaaggaaagtggattacctctcacggcggtggattgacatagatccacccatgatagcatcaaagacaaggaaggtggcgacgaccggtagagatagatggcggcggataatcaactaaaggattaggttagatctgtgttcctctccgtttcaattggtagcatggcacgaggcgtacgacccatggcggcggtgggcggaaggatggagatggagatgtgagagaggaggggcggcggtagtcggatggagcgtagatggagatgtgatagacgagtggcagcggcgatcttggggggggggagatggagatggagagaggattggcgacggcaatagatggaggggatcgagggacgaagagataatgacacgagaatagaaaagtggtggtacaatggctattgaaaggggaaagatggagatgcaagagaggagcggtggtgccgtggcggcggtaggtggaggggaggggataataacaagaggaaaagtagcctattagggttaggttgacacatcatgaatttcatacgctaggggataatctgacggttgaaaaaacaacccgctttttgaataaataatttattaattgtggcatcatttcttccttgaaaatgtatttaacatttcaccgttgtattgtaatgattatggtttctaaaaaatatgctaatatgaaaagagtttatcccttatcagacattgtcataccgattcatagttgatcgacttgcccttcctataccgcggatgtagcagttactttcatttttctgaagaagtgttctaatgacttataactctcgactagaaacttgaaacttgaaattccaactgatttaaactcccaattgaaagatcttaaaacttccatattatatgaaaaaaaatcataactttatctactccctccgtcccacaaaggaagtcgctttgctcagtagaaaatgccccaaaatactcgacgctgaactttcccatcagctagtagtagcgcataaaagtgacagtagctaatgaagttttttaaatgatgggaccggttggattactataatccataaagttggtaccaatgtgtaccgctgctgcaagcaccaactattaattttatcatgatttaaatgttcttttttaagtagatgtggcagtataactgattattgcagtgttgtagcgtgctactctcaagcctccgcatgattagctgcaatcctataaaacatgagcaatatgtcattttcacctaactctaatttggctgacaatacctagaacgacatacttcgtgggacagagtaagtagttggtttgaaagtttgaatcaaaccttggactttcaaccaacagatttgatataatctgaagatacattatttggaataatgaaaaagagaatatgaaattccactctcaagtctcaagttgtgatttttcaaccatcacttgcggtaataacggcggaggcagtgaagagtgaagaccgaagaacaggactagaggagtcgcttttgttgcgagatcactgcgccgtgggcccac

SEQ ID NO: 79201 - DNA, 725 bp, Oryza sativa
cacgacgctggcccgtcgccttccccttctctcgtgtctcagcagccacgttgtcgctgccgcatcgcccgccggccgacggacctctcacccgggcaaccccctccccaccgccgaccggcctgccgatgacgttgcatcctaattcctaaccagacgagacgaaaggaggggagaggaaaggaagggagaggctggccgacgtggcatcctgacatgtggggcccacatgggtcccacactgagtcagccatcatgtcagctaaaaccggggtcaaaaccaccaagggatctaaggggatgcgttgtatccggttttgcgattgggggacgattttgtaactcgatgacaagttgagggaccttcggtgtactttttcctttaaatatccgaatccccggttgcaggaacggcccgttctttggtgggccgcacggaaaaaaaatagaatgggccacacgtgagcttcattcccttttcggcccaaacaatatggcccacactatcccacaaactcattctagcccaaaatcaatagcccgcacggtgcgtcggtgccacataaaaaaaccgagatttggagtgagagacatccctccaaatatatttttaagggaaaattaagagtttgctagtgattgaacatgtgacctcgaggctgaaatcatacaccctttgacactgcagtatcaagtataactcatgcgtcggtgccacattaccg

SEQ ID NO: 79202 - DNA, 3811 bp, Oryza sativa
cacattattattccaaactcagtaggtgcagttggctagttgttaattaatttctgcatcaagattatatatatttcagctcccagtcagtttagcagattatatatattccagctcccagtcagtttagcacaactaacaattgatgttcatataataccacaacattgcaattaccgctaccatgactcgtggatacattctttaatttggagatatgaattgaaatcggtcgaaatgatatataacgtgtaatcgtctatactcctttaaaagataccagtggtaataacagtgaatatgttactaccacagtgccaccccaccactccttaagcagtttttataaatcatctcttggtattttctgatattatggaatagtccatttgattcaaatgagtgaataccatatattttaataaaaaaacaagtaaaaaaatatattttgtgtaaaacatatcataatatattttcttttacacctagcaaaacacgagcatttttactagtacgcataaaaatatgaatgtgtggcatggcagtgcgagagcatggaggcggtgcagcggcggctgaaggagatgggcgtccggtacgtgcagcggcgggtggaggaaggcggcgtgtacgtggaccagatcttcttccacgaccccgacggcttcatgatcgagatctgcacctgcgacaagctccccgtcgtccccctcgacgccgccgccgcccactccatcttcgccggccgctcgccgccgccgcccgtcgcctgcaagatcaggcccgtcaagcagccgtcggcgacgaagctgggcagcgtcgccgccggcggctgtgttggggaggtcatcgtcgtcgacgcgatcaacggcgccgccgccgccggcggcggcggcgcgatgagctgaggagacttgtggcattgctgatccaacgaggaatcattgatttgatgaattgttgttcaactttaattttggtcgtgatgatgattaaggtgtatgtaattcgatccggtgattaatttgtctctcgctgcccaataatatttgcgtaaattaattaattacctgtggtcgtcactagctaattcatcaacgtacgttgagtgaccagagattagcaggacaaactgaaactagcgcgcgtacgtaatatttgattccctccgttcaaaaatatatgacgtattttttaccagtctaaaaacacaaaactttgaccgtaaatttcttttgtactatttcgtctatggttacaaatcatgaatccaccaatatttttttaggtaaaaatctaaatattattaaattaatagcttgtcaaagcttaaaattgggcggtcgaaatacatgcatcttatataaggacggagagagtatacgagtacgcagcagctctgctagcaattactgtctttgaattcattcacgagatgtaatgtttcctttgctgctttgcacacgtagtaggccgcactgagtgagcaagataagataagataagaaaattcctcatttttgcgtgcgcttcgcgaggtgcaaagctatgtgttttctaagaaaaaattgtagaaaagttacataaaaaatatattaatctattttttaaatttaaagtaattaatatttaattaatcatgtgctagtggctcatcttactttgcatgcatatacatatcttcttcaatttcctatcctcaagtacagctgtagtatgtgttatatgcgtggtatttatacattgttcttgtaataatcagtgctgtcagcacattgtattacgttgttgaattcacagacaagtagcacctggagatcagttgcgttcaaaatgtgtaaatccagtaatatattgtgcaatgaagttagcagaaatgacatgcatgcacgcatcactaacatgccacagaactgataaaatttactattgggatggaggcatgtgacaagctaatataataggaacagtaccacgcatgatccacactgctcatgctccaccattcttaatttcaggttgacgatatattggtatgcatgtgatcggatgacagcttgtacgtagtattagtcatgttgcttcaggcagataacaaatgtattttaattcgattggtcaaagccgaatttaaaatttcccagcccaaccagcctgaccgaggtttttaattttgggcttcccaaaaaagaagtgaagattggagccgacgcgctgtacactttacacgagggaaaagtgcaatttgcatttcttaattattaatggtggagctataaatttacgtccctcaaccgtaaacgggatatatatagcctcctccaattcttttttttttcttttttttacgaacggccggtcagaattgactggcgttatattgatagaaggagaaaaagtacagatagccaaagggctaagaaagagaaaaactgtacatgacaacatgcaaacaagcttgcacgtagccttcctagctcctcatggcaacattctcccaatgtgtttagcgctggtcatacttcaccaacctaattcctcttggatgcgactaatcatctggtgtgctgtcgcctcctttgctctgaagattcttgcatttcgttccttccagatttcccgagcaatgagcaagaagagagttctgagtcctttctattttgttgcttccgggtcgcttgttccttgtgtccaccaatttaagaggtttctacttatgttccatttcgggatgatgtgcccttggtgtagccatgtgagaatcccaaaccagatttgctttgagaccggcattcaaacagaagatggtcgattgtttcgagatttcgaaagcatagctggcagaaataattatttggccatcccttatctgtaaccggtcagatgtccacacccggttttgaagaaccaaccaaaaaaagattttgcactttgccggagcccatgcctcccaagacaactttgttgatggcgagagtaccattccattgaattggaattggtacgtggattttgcactgtattccccattagttgtccattgccaaacaatcgagtcttgtaccccctctgttagttgtggggtgtcacgggctaaaatttcccaaacatggaaagaattcatcaagaaggggaatggtgaggctgtggcggatgtcgttaatccatcttccttgttgcagggcgtcctggacggtgcggggttcctctttgaatgcctataaagattcggtgcttgactttttaggctttggccaccgatccaatttgattcccaaaagctcgccttttgtccgtcaccaatttggactctcgttgatgccgcgaaaagatccttatccaattcatcacagggtgtttcagtccctatccaaggcttctctggcgtcctccattcgaaccataaccatctcagtcgaagagctctggcaaacttttctaagttcggaacccccaaaccaccgtaccggacatgtgagcaaactttaagccaattgaccttgcattttccgccatgcatattctcgttacctgcccacaggaaccgccttcttgctttgtcaatttcttgaagagattgtttcgacggtttcagcaccttgagggtgtaagttgggatggcacttagaactgagttcaccataattcggcgcccccccccaatgtacaacaatgatggtttccatcccgagagccgacctttgatcttatcctggagaggctggaaatgcaccttacgtaggcggccaggagtgagtggtagccctaggtaagtcagtgggaagctggctcttgcccccgaaaaactacg

SEQ ID NO: 79203 - DNA, 1666 bp, Oryza sativa
tgctgatattttcaccaaacaattggattcttctcgctttgcttttcttgagagttcggaatattcctccttttagcatgatttgagggggagttttgtactcttgattttatcgagcaacatttgacaattaaaaaaattgagaaaagagagctttgtttaatacatatggtatattcttgtgcatgctagcaatactatgaaagtttctttatctctaacatagcttgtatgtattctagtccttttatgaggcttaatattgcttttaatggagatgatacatgacacttcaaattatgtacttgaattaagcaaatgcagtattgatgctagcgcatggtttgattgataaatgcttatgtatatgatttattgaattgttattcctcaaatagctttttaattgctcattgtacatgagaataaaaaatatctaggagagaaaaaaaatgaatactaaatccttgaaaacagtcttgacgacaaggacgtattcgatgtgagcaaaagtaatgggtgacttatccttgaaaacagtctttgacgacaaggacatacccggaataattgagggaaaaaatgagcaaagaggctcaaataaaatttaaaaattctctcaattattttgtgttagagctaatttgagaaagagtgataaatgcatttaatgatatatatatatatatatatatatatatatatatatatatatatatatatagtttatttttcaacctatgtgcttgaaaggatgttgcattgtaaatcaataaacaatcgtatgtacatattgccaatcaataataaacacaccatatatatgattacacattgtacacaaatctcacgcaagtagtagttagtatttcatacatcggtatcaatggaataaattgagctgcgatgtgggctggtttcggtgttgtcttggtcggaagatgctctctactcagaaactggaggcttctgcccggctaacctggttaagatcctgagcacacacggagcagagcattcaagtggattagttattttgttcatttcttcacagctaattaattaagtactaaatcgatagagatattgcgaaaaataagaagacgcatgcattcacctttgcatccgagtctgcggctttctgcagcatccaaattccaaacaacaaattaacgggtcagtcagttgcttgcccggtctttcttcagtaaatttcgtaatagcgggcacacttgcctttctttgggtctaactacgatctcactaggcgccacgcctgttgtggtttgccgagcctgttgatcccctgctcttgccatagcctttgcctgtgatattagacattgtacacttgatcagactgacatcccttcgataaagaatatactatactactcagattgatgcatgtatatattcatactaaccaggttcctatactgaacattgtagagatctgcaggtaacgttgtttggcttgtctttcctccttgtttagtgtcttccagaaggaatatgtagatcccatgtttagcactctagttgcataaatcttccatgtgtagctgccatcatggatttagttagtgccatatatataggaggattgatctaagttgtgcacaaaaacaaaaacaaaaaaaaaaagaacaggacgcatgcaagg

SEQ ID NO: 79204 - DNA, 39365 bp, Oryza sativa
  unsure (1)..(39365): unsure at all n locations
cagatttggcaggataacgatcaaacaataagaagtccagcagtaaagccgtttgggaagacgtcaaagcatgtcaagtgggataagttggttcggttgagaaacataattcaaaggcaaagttatcgaccctcgcatggaatagcagaagtagctagcacccggagagcaggaaagctaatatgatgcagttagtgacaagttgtcaaacatggtatgctggataagcgtgatatcatagtccaaagcattcagtggtaagttagaagtaaatgacaagcatgatattctcatgatgacaagcatggtatcctagtaatgacgagctgatctcgacgcatgacatgaagtgggtaacttgtatgaggttgactccgaagatatgaatcatgagaagttctggaacggaagcatcattaaactaccgcaacctagtctgagtcagctaaaaggtgcaccctggttcaagtcaggtgaagagaagattccatccgcaacaggaggtcaagccaagcagttccgagtcgtgaagttttgctgaaagtttgtgaagacggagcggaagaagtcaaacaagaagagaagaccacccaacctatcttcttgctagcctcctcgaatctcggggacgagattcttgtaaggggggtggatttgtcacgtcctgataaattcatcccgaattaaaaatcattttccaaaaggaataatagaattaattaaaattcgaaaagaaattggcaaacactaaaatacgtacaagaaaaattcaaatgtggcccggagaatttttgttaaattctccttagtctaaaaagagccctcaaattttagtggaattttcagagcacaaataataattattaagaaataaacaaagttaaaaaggttttataaaaagaaaagccctaaaaagtcttttttccccccccctccccctcttgggccggctcggcccagcttcctctctctcctctcccccgcggcccatccggccttcccccgcgcgcgcgccgctgacgggcgggcccgcccgccaccctcgctgacgggtggggcccacccgtcatcccctacctcgcgccgcacccgccgcccgcccgtgccctagcgccgccgccgccgcggattccgccgcatcccgccgtccccgcgcgcattaaagagggggaaatcactccccgtgattccctccctctttccccccacttttccctctctctctccctcggattcgttcggatttactcccgcgaacttcgccggcgcatcaatggaaaagagatagccgcgccggtttccttcctctccggccgccctctctcactcccaacactatataatcgctccccgtgcctccctcctccgtttccgccgttcgccgctcgctctccccgtcggaatcgagctcgcgccgtcgtcctctctctccgccgtcgccgccgagcttcggttcgccgccgtcgtcgccctggtacctcctgccgcttcggcatcgcctccttcggcttcgccgcgtccccgtcgacctcgtccacccctccgtttcgcccgccgcccgccggaacgccgccgtcctcgtcgacccgaaccgcgccgccgcctctctccgcttcggccgccgtttccgtcgtcgccgtcgacccggggtgagccttggaccgccatttcgcttcccccttccctcccctctctcgggcgccgctccgtcgcgccggaggtcgccgccggcgaccatcggggcgcgggcgcgccgcctcccgtcggccgtgccggcgaggccgccttcgggcgcgccccgcggctgccatgtggggcccggccgtcagccgcccgcgccctcgggtgcggctgacgcgtgggacccacggcatcggccagcgcaagccgcgtgcgcccggtccaccgtggaccgagaggctgccgcgtgggccccactcccgtggacccggtccgcgcgcccctcccctcggctgacgcaataaatccgattttaaattaaaatttaaatgaagaaattcgtaaatatccatttaaagagcatataaacttcaaatggccatatcttggccatttgaactcgggattggaccgttcaagtctctaatttttccttaagaagtcaagaacccatttttgtgctttgtttctgcttgttatatggggtttagtagagtaaaagccttttcttttccgtcggtcgtgtagacgctgcagcttcggaagatccgctcttcgtggaagttgaagccgacgtttaggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgctattgttattattaccttgttcaccctagaataaacaaaaccccaactagtgggtactctattcgtggttccactagtataaatttaggtagatgcttcgctgactaattaggcaacattaggtggttttataactttagactttgggaattctcatatcatttggacactatggaatagttggcttatgttggaattggacacacacctcccccctctattcaaaaacccccaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccatggaaaatgaaggctacacgagctgcggcccggtagtcgagatgtcatggcacagggctggtgtcctgctgctagggggctcaattctgcctgcctgtcccgggggttccggccgtaggtgggattgggtcggtactcttgtggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtgtagctctaggatcgtctttataaaatagctttgggcaactaagtgacttttaaatgctgtttactgcaaaacttaacccctatattattatccccttgtaccccccttgcattaattatgcatctccgttgtggcttgctgagtactgtggttgtactcattcttgctctatctttctccccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgttccccggcttttcctgggacgggggttaatacactagcgttcgggaaaaggcaattttcccggtcgcgacaggaggccaattcatgagcacttaccttcaccaaacaaaagccgattttatggtaaaaatcgggttaatgaagaaaaaagggaaggaaagcgcaccaaggtggaggaaaggacttcggaggtgattactatcaaaataggatctcatgatgtgcctataccttctggagatggagttggaaagtccccaagcaaaaaatccgaagccggtaccagctcctcgcagtcggccagtctgaccaggccctctggccggtctgaccgcagccatgttgccggtctgaccgggccatcaggccggtctgaccgccgacctgacgacggtctgaccgacgcctcaggccggtctggccggtctgaccggtggcctacagccggtctgaccgggctccggtgtcggtttgatgagagggctgcaaagggcgatgtgggggcttcatcgtcttcaagcaaagttaatagaggacattatttgcctcctagaacagagccgaatcctaggtggatgcctaaggatttgacggctacacaaaagagaaggttgcaatgtcttcgggcccaagaattaagggagaaaaaggccgaagaacaaagagataaaaggttcaatgagttacgaccaccaccggtatggaggcctaaatccatagagaaggcaaaaccgattgatgtagaggagaaggaagaacaatcggttgacaaagataaatcgtctccaaaggaggacatggatatcaacatggtgtgtatgttgcctatggagttttgtgctatggatgaagccgaggttgcccaattctcattaggtcctaaagatgcggtttttgagaagcccgatgagtcaaaccgtcacatgaagcctctctatctcaaaggccatgttgatgggaaaccggtctctaggatgctagtggatggaggtgccgccgtgaatttgatgccgtattcgctattcaagaagttggggcatgaggatgatgagttgaagaagaccaacatgatcctcaatggcttcaatggtgaaccaatggaggcgaggggtatcttttcggcggagctcaccgtgggaaacaagacgctaccaaccgctttcttcatcgtcgatgtgcaaggtaactataatgttattttgggtcgttgttggattcatgcaaattgttgtgtgccttctaccttgcatcaatgtttaatccaatgggacggcgatgatgttgaaattgttcaagcggatacatcggccgaggttgcaatggccgatgctacttttgagtggcgttatgggaatatccaatgcttatcggggagggatctttctagctatgattttattagtatctccgatggcaaatttgtacctatctctgtaaagctggctagtgtagcacggctaagccatataaacttgtataatgaataaagaggctagtttagagtggttacaaaaaagggtgcaagaatatcggtctacaaagaacgatattggagagaccgttgaagattttgatgaagtagagaagcttgggcaagggtttacatcggccgatccattagaagaagtagacataggtgatggaattaaaccaaggccgacttttgtaaacaaaaacatgagagccgattataaggttaagataatcgagctacttaaagaatatgttgattgctttgcatgggagtaccatgagatgccgggtcttagccgtgagcttgttgagcatcggcttccaattaaaccgggttttaggccttataagcaaccacctcgtcgttttaatcctttattatatgaccgagtcaaagaggagattgatcggttgttgaaggcggggtttattaggccatgtcgttatgcggagtgggtttctagcatagtcccggtggagaagaaggggagtggtaagattagagtttgcttagattttagagatttaaataaagctactcctaaagatgagtatcctatgcctatagccgacatgatgattaatgatgccttgggtcataaggtgattagcttcttagatggtaatgccggctacaatcaaatttttatgacagaagaggatatgtacaagacggcttttaggtgtccggggtttgttggtttatttgagtgggttgtcatgacctttggtttaaagagtgccggcgcaacgtatcaaagggcaatgaatttgattttccatgatttgctaggtattatcttagagatctacattgatgatattgttgtcaaatcggatggtatggaaggacatatagccgatttgatattagcttttgagaggatgcgccggtatggtttgaagatgaacctacttaaatgtgcttttggtgtgtcggcggggaagttcttaggattcatggtgcatgagagaggagttgagattgatcctaagaagatagaaaaaattcgtgatttcaaagcgccgacatgcaagaaagaggtccaaaagttgctaggtaaggtgaattatttgaggaggtttatttctaacctagcgggtaaaatcgatgcttttgttcctattcttcgcttgaagaaagaagccgattttacttggggggcaaaacaacaagaggcgtttgaagagttgaagaggtatttatctactccacccgttgtgcgagcgcctaaagccgaaaagccttttcggttatatattgcctccgaggacaaagtcattggtgccgttttgacgcaagaggaagatggcaaggaatatatcattacatatttgagccgccgtcttttagatgccgaatcgaggtatgttcttatagagagactttgtctatgcttatactatgcttgtaccaaattgaggcattatttgttatctagtacatgcatagttacttgtcaagccgatgttattaaacacatgttgcaaaggccaattctaagtgggagaattggcaagtgggcatatgctttgatagaatatgatttggcttatgaaccattgaaaactataaaaggccaaattgtatgtgattttatagtagaccatcatatagatgttgcttatgagggagagatttgcttagttgaagttataccttggaaaatttattttgatggttcttcttgcaaagaaggtcaaggcataggggtagttttgttttcacctaatggcatgtgttatgaggcatcggttcgctaagaatattattgcacaaataatcaagccgaatacaatgctttattgttcggcttacaagttatggagatggttggagctaaatatgtggaggcctttggtgattcggaattggtggtgcaacaagtcgccggagtctacacatgcttggatggatcactaaataggtacctcgattcatgtttagatattattgccaattttgataattttgctattagacatattgctaggcatgataattctagagcaaatgacttagcacaacaagcatctggttataatgtgaagaagggattatttctgatattagaagaaccggtgcttgattttaaatctttgtgcgaaattagcaaaattggagaccagggcggtctgaccggcgttgcacggccggtctgaccggtgaccaggggcggtctgaccggccacatgccgccggtctgatcagcgaccccgagcggtctgaccggccctgtgtggccggtctgaccggttttgggcaggatgctgggggcacacttcaatcaatttggaggccggattaattgaaaattcggacatttgtgcccaggatacagaagaggattggagaattcctttgattcaatatctaaaagatcccacacttaaggttgatcgaaaaattcggcggcaagcattcaaatatacattgcttgatgaagatttatatcgccgaaacgtagacggtgtcttgttgaagtgcttggatgaagatcaatctaaagtggctattggagaagtgcatgaaggaatttgtggaactcatcaatcggcccataagatgaattggttgcttagaagagcgggattctattagccgaggatgattgatgattgcttcaaatattataggggatgtgaggcttgtcaatggttcggcaatgttcaattggcacccgccgccgtgttgaaccctataatcaaaccatggccgttccggggatgggctttggatttcattggtcaaatttatccttcgtcatcaaaggggcataggttcgtgctagttgctacggactacttcaccaagtgggccgaagccgtgccttcgaggaatatgactcatacggaggtaattgattttattttgaagcatattattcatagattcggtgttcggcaaacattgactacggaccaaggtgcttcttttatgtctaaagaagtgaatagttttaccgaatcttatggtattaaattgttgagttcttctccttactacgctcaggctaatggtcaagccgagtcgagtaataagacattgctaaaactagtgaaaaagaagattgaggagcacccaaagaggtggcatgaggtgctttccgaagcattgtgggcgcataggatatctaaacatggtgccactaaagtcactccttttgagttggtttatggtcaagaagccattttaccggtagaggtaaatcttggttctcttcgttatatcaagcaagatgatttgtcaagtgaagattacaagacgttgatgggagacaaccttgatgaagtcgtcgacaagcgcttgaaggcattggaagagatagagaaagagaagaagagggtggccaaggcatacaacaagagggtgaaagcaaaattgtttcaagttggagacttggtttggaagacaattttgcctttgggtactcgatccaaggagttcggtaagtgatctcctagttgggaaggtccttatcgaatatgcggcattgttcgggggaacgcatactttttggagacactttaaggggagcgttttcagcgagcaatcaacgggaaatacttgaagaaatacttcccgagtgtttggcaagatgcttaggaggtactatggccggtaattggattatcgtcctaaggccaaaaacatgctctatgcttttagattcacgttgttcaccaaaaaggtaggggggcatgtgtttacacccaaatttggcacctaggattaaaataggaaagattaccaaaatttggaaatctaccggtttcctccgagtgggccggtctgaccgccatgtgttgggcggtcagaccgccgattgtaggccggtcagaccgacggtatgtggccggtctgaccggcaggtccgagttcgaccctgtttcgtcgggtttcgaggtttccttgctcgggaaggcatgtttcggatttcctttggattctaccccaagttggacgtggaggatggcctgtagagggcaagaccaacccctatataagggacaaggccggttcattgtaaaaatcaatctactatcaatcaatcgaatcgctcttttcatattgcttttagttttctcttagtttgtccatctttgtcggtttgcgccgtaaaccgtccaccgccgctgcgagagtgcgacatctctttgtaggtttgtcctgaaaaccttctgtttgcccacgagacgggtagttatctaaaaatcggctccgctagccggtttagttatcgaaacccatctaggtttagctcttcgctagatcgaggtggttggcgactctaggatcaccgcaaggcttgaggtgctgcgatcatgcttgtcaacttgtcacaaaaagttaccaacaataaccagaggaaaaaaatacttctcctttaggtatatttttactcttacatataccatatatttttaaaaactttttccttttgttttttattttcctatgatacatgtaagggtaaattggacaaatcatatagattttgcataggaaggtgacatggcatgtcaatgtggcaattttggtgggaccaaggactatatcagcccacatgacaaatttaaagaacttttttggacaatatgaaagattaaggactaaaataatccaggagcgaaactttagggaccatattggctgttctccctaaaatctttgtcagctcacaatttccaaatgtcataccaaatttaaaatccgtttgaatttatggcctcctctcaagatgtaaaacaaaactattccaatattgattttattcggacatcgtgtgatattggaaatttcgggacccacccattatagggacattcctaatgtatttagtaaatctaggctgcaaataatattctcatataaattaacacccaataatatattatttccacaactatttttcaaaaagctacagccccgtggaggtacgctgtcctaccgtcaaggcgtactggagttttatgtaaacattttaaaccagtggtgtctacatgtgagagagatgaactcctctaatctttcagccaagcactaaagttttcagaaattacgtatagatcctagtgctccttgtcagtgattgatcttgtttttgtaacatactaacatgtacctcagcttttccactaattactgtttgaggcggcgtggcgacgggctaccgaggcggcagagagcggtgccggcggcggcagcgctccggcgagggtggccctgaaattggttgagggaatgagtttgggggcttctaggagctcgctggcgcgagggctaggtccgggactcaccgaggcggcgactcgatgttgaggatatggcggccgcgtcctggccgacgcgggcggcggtgatggcgcggcgttccacggcaaaccacaggtgttcggacttcggatttgggtatggaggtcgagtgggttgtggggagttagctggcgcgaaggctcgattcataggcgagggaggagcgaaaggcgggcgcgtcgagcacctgtcgcgacacgttcggcaggagcacggcggcagcggggaatcacgtcagctttgtaggcgtgctctcagcgtgggacacggtatcagcagggcagcgagaaggctggcgcggggagctgcaggtggcaggcatggtcgggcggagcggtgtcgtgttcgtgtccagccgcggggcggcttcgattggctgaggccggcgcccggcgccgcggcgacgttagccttgcagtttcagcgtcagctttgcagagcggagacagaggcggtcgggctagtcgcgtctcgtcgtttcgggtagaggggcagtgttggttcgccacggcgaacggcgaggtcagcggcgatctcgacagggcatcgggcacggcggcgtcggctttacaggcgcgggtcagtggctttgcaggattggcgcgcagcgggggacaaggcttttggccgcgacgcgtcgtcaatggttcgttgtgctcatcgcgcagtttgcacgccaagtgcttgttaaaatgcctgcaaggagggagagagaaaggaaggtgggggagggatggggcactggtgcggctggcatgtggggtccagggctcctgggctcaccgctcagagaggaggagaagaaagagaggagaggcgattttcctgaaaattttggtgaaaactgagagtgtgatcgaattttcaggatatgctacagtgtagcaaacacctgtgcatagataactgggaataaatgcgatcatgaacttcttttggtgaatttttgagacttttgtcatgtgtacttctgtgaaaattcagagaagttcactgtttcatttcaatttgaactggtttcgattgttttgacatatttaattgacgtgcaaaactaaggtacaaagttgtcaaacttttccagaacattattgaaggtgtctactgtttataaaaaacccatatttttactcctcttagatttaatactttcacttttctgtttttcaatgcaagttcattttctgcagccgtaacaggatgcccagcttgctggcgctgcagcagccagcagaaacgatcaagcccatggagcacagagaaaacgctttggaaataaaagtagtgcatataatacttgcagagaagcagccgtagaataactgatggcattagatgaagcacccgatattcttatacggatcaggtgaccgattacgagcaatctccaaaactaatcctacctggatgggacaaccagcgtttcactactctgcagaggccacaaaccacatccagtccaatgaaccaagaacatcttcagggatacaaaactaacagccagcctaatagcagaggcaagaaacaaattatagacctgatgtcgactggtctcagactctcggtcgttcgagaacccttttgctccatgtatccaggcacctcctctcatcagcaatttgctccatctctgcaggaaagaaaccttattagttggtgatattatttggtaccacttaaattttggtgacaggaatgtagttttctgacaaagtcaattactgaatataaaaaatatttgcacagctctgcatcaacagttgtccaagggatgcctcaaaaatctgtgcagattatcagtcgtcacgcagaagcagaacatcgtggtgtgctaggtctgcttcttgcactgggccatgaatccggtgggttgttaggtggtgtttaggaaggagggactaaactttagtcccttttacaaaagcaagtctttatgggagggactaaaatctctcctctcttagggcatcagcaatttatgctatcgacatgggtattagcgtgggcccagatgacaggtggtaatagagggagacgcgctccacattgcttatttccgtgagttggcggtaaggtggggttcatggggtaaaaaaatcgcagcaaggacagagcatgcatgcgacggttgggagaagcaatggtagcctgttttttttttttcttttgctatcagaaaacactgtatacatacatattctatttccttgcttccggcggtaggggtatgacccggttgtagttatgtactactcccacaatgcttaataccacgtagtaattaagaatgtatttattgcttactatccggtttgtgagcgtattgctgatgcccttattctcttattaagatgcacaactcttttgtattccaaaaaaaatcctgttgatagtagccacggtgccattaggtaccgttgaacctaacagatatttatgcatgtgtatatatattgctatatagataaaattggtgccgattatagacccaaaagcaagaggtgtataatataatacagaccacacgaccaaactaagaatcgatcaaatagacaaggcatgtctccaaattgtcttatactatttccgtaggttcagccgttcaggagtcgaatcagcctctgccggcgttttctttgcacgtacgacggacacacatgggcataccatatagctggtccatgacattaggagagagaacgtacgtgttgacctgtagctgagatataacaaggttgattataatatcaccaaacatgaaatcatccaaggatgacccataactatcactactatagtactgcatctggtaatagaaattgtatagactctatttcgagcactaccacataacgcctgcaatgtgacaccctacctgttcactaatgtgcctcttcccacacgctttccacccgtactgctcacagctttaagaaccagaacaaatgagtaatattagtgtcggttcatggctaaaaccagcactgatgtacatgaccacatatgtcaaatgctgcttctaggcatgacccgctcttactaatacctactcatcgctagaagaattttcggctgataaattttcaatttaagcaagagttatccgcattggttcataactcaaactgatggccccaaccatattagtgcaaatttcacatatgatcataaccttttcatatgaaatcgggtcgaggtgaactttatataaaaactgtagctgtagatgatacctacaattttatagttcacaacctttttatttcaagtcatttaaatgcccaaataggtgtttcaaatatcagatagaaatgttcaaaagtaaaaaaggtccatattatagcataattaatatgtaagtgagttggaaaaaagataagtacgctgagagaggtcggggatcgaattctggtgtaaaaataaaaaatgtatgtatttcactcataaaaattggtagcagctagtagttgggactctgtatataccggtaaggatgggatggtagtagaataattccttttttgtttttagttttttctggtcccaaatttaaaatttggatcccttacttgtaccaactaatattaatgagtgttgagggtagtagagatgcaactttaccatactccctttgtttcagattataatatgttttgactttggttaatatcaaactactttaaatttgactgagtttaagcgcaaatatagtaatatttataataccaaattagttttattaaataaataattgaatatattttcataataaatttgtgttgtgttgaaaatattattaactttttctacaaacttggttaaacttgaagcagtttgactttgaccaaagtcaaaacgtcttataacctcaaacggagggagtactttttttgtgggaacaagtttacaatgtttaataaaagcacaatccatcttaatgttttcaagctgaatattgtaaaattcatggataaaccagcttctaaatgtttaattgggaaaatgtcgaatgacaaattaatatttttaagtggagggaagtattaatatttcaatatcgtactaaactgtgggatttattttctaaaattttataccctgccaattcacgtgttgtagatctttttttttcactaaccgacaccaggtatatcaattttattgaatatagcagcaaaaagaatgtgttgcacttgtaaacaaaaagcaaactgtacataaaaaaatgtactaatgaagttcataaagatgctttgcttaatgagggcccaaagttttgatgaccttttgcttgatctcgaaattaaaattcaagtactgttaagggaggtcacaccaccatcaattttcagcctgaagaaacagttaaacaacgaccccgatgaccagtctactgctctccacatactagcagcattattgatcacaaaagaaaccaaaataaaaatcagcaccgagtgtgcagagggagacaaaggtgatctggcagtggatatctccccatccatcctcacccgcgctgcccatcactcgccgccgcatactacatcatgtggagagaggaagacgaggaccacagccagagcccgggtcgagatgccaccacggccacaatccacgagcccggcgcgacaccaccgcgcgcgcgtgagccagccacaaacgcccgcggataggcgcgcgcacgccggccaatcctaccacatccccggcctccgcggctcgcgagcgccgctgccatccgatccgctgagttttggctatttatacgtaccgcgggagcctgtgtgcagagcagtgcatctcaagaagtactcgagcaaagaaggagagagcttggtgagctgcagagatggccccctccgtgatggcgtcgtcggccaccaccgtcgctcccttccaggggctcaagtccaccgccggcatgcccgtcgcccgccgctccggcaactccagcttcggcaacgtcagcaatggcggcaggatcaggtgcatgcaggtaataacctactgacccaacacacattattcttcttcttcttcttcttcttcttcttcttcttcttcaacattaaccaataattcaattatcgtttatttaggtgtggccgattgagggcatcaagaagttcgagaccctctcctacctgccaccgctcaccgtggaggacctcctgaagcagatcgagtacctgctccgttccaagtgggtgccctgcctcgagttcagcaaggtcggattcgtctaccgtgagaaccacagatcccccggatactacgatggcaggtactggaccatgtggaagctgcccatgttcgggtgcactgacgccacccaggtgctcaaggagctcgaggaggccaagaaggcgtaccctgatgcattcgtccgtatcatcggcttcgacaacgtcaggcaggtgcagctcatcagcttcatcgcctacaagcccccgggctgcgaggagtctggtggcaactaagccgtcatcgtcatatatagccttgtttaattgttcatctctgattcgatgatgtctcccaccttgtttcgtgtgttcccagtttgttcatcgtcttttgattttaccggccgtgctctgcttttgtttttgtttcacctgatctctctctgacttgatgtaagagtggtatctgctacgactatatgttgttgggtgaggcatatgtgaatgaaatatatggaagctccggctatatatatttatacaaagggtacgagatggatgtgaatcctagagcatatgtgtccaacaatcaattcgtcgacaatgaaaatttgatcatggaattaaaaaatcatgcttctgttgttcatcggaaatgcctttctatactgattagtggatttccaaactgaattcacaagaaaacatatataattgttgtgttcatcaatctacttcttttgatcaaataaaagataatttgacttggcaaaaaacaaaaaatacagtttttcaggtatggagggagtactttttttttttcaagattgtcacatgcaaataggcaataatacactctttttataacttgtaagtgtttttttaccttttttttgctacatattaaataccaaaacagtgtatcgaaaagcaaatctgtacgacgaccaaatggctaagtggtgtaattgtgtgtcagtccagtccaagtccaacagaaaggttggcagatgataccccaacggtgttgcgctttctttttgtccataatttctatttctagtttttttttaaaaaaaaacaagcggtcagttaataaaatacggttggaccaactgctttctaattttatcccaaaagattgctctccaatggcaaaaacgtaaaagcaattctaaggcccttcacaatgcggggacgtggaccggtgctccaccgcgctagctaggattcgcgcttgcgtggcgtaaggttgcgcgtcccaccagaggcgctcgctcccgcggagggaagcgcgcttcctcgctcgcgctggagcagagtaacggctggagcctacactgtggagagcgtgcctccgactcgccgtcacctcgcgccctcccgctccgcgtcgccgacctcatcgtcgtcctgggctccgcttcgcgctgccgcctccgaaacctcatcgccggccggaagtggagacaaagcgaggaggacgacgaccatgagcagctccgtctcctcgtcgtcggccgagagaggaggagcccagatccgctctgccaccatctccagaatcgcgccaccgccgccgtcctcccgccggcgcttcttcaaggacgctaccgccactgctcggcccggaggacgctgctgctgccgccgcacggcatggaggacgccgttgctcggcccggaggagaggagagccggcgccggctgagggaagaggggagccggagccggcggagggagcaggggagagctagcatggtgagtgacggaggaggagacgggcgtgatgactgagggagttggggatttggtaaagcagtatatgtgggtcccactagcggtgcttgcactgtgaagaaagtgtctttgaagctctctatcctaggtgccaccttgtggtacctcacaatgtaagtcattctagcatttcccacgttcatatttcccacaatatgaatgtggctagaatgacttgaattgtgaaatggagggagtacccattaaagttggataaaaataaacattgtgatgatatgatgcatgaaggagcaagttggtcgttaaattgaagttgtactgaaatgtgaaaaaatatatatgccaaatgcaaggtaattcattaattaatcatgcttggagcacaacgctcttacaaaaagataagcagcaaaatgctaagtgctaaccaatgttgagaagccacttcagtaatcttggcaaaaagaaagaaggaaagaaattaaagaaaaactcacttcagcttgtatatatctttcttttacaaccatgagtccatgatcgataaacttatcagtagcaattaaatcactgcaactgatcagatctctttggctggaaataaaggagcaacgggcatattacttcgtaatcatctctgaaacttgtcaagacgagcagctcgacgactcgaacgtggagacctttcggcgtttgctgcccagcagcgacgcactgggtgcgaagtcgaagcctgagctgaccttgccgagcacggactggagcgcgtggcggaccgaggctatggcggcggcggcgtcgcgagacccgcacgatacaaggaaggcgagcctgacctggccgcccagcgtggtgacctccgagccgaccacctccagcccgagcctgagtcgcgctctccactgccgttcggtttcgatggatgaggaagcggcaactctgctttgcgacggagaggagcgagtgagcgagcgacgctgaccgtgggacccacgaggagaaaaattagtgtcaaatttaccctaatcaatcttaatactttactaatctacccttaaaaataaataaaccgttccgattagttctactggcctggcagcataatactatcggtagagagcatcgccctagaagaaaaatccagagatctcctatcttgtactgcaccacattcgtctaccctttacattttctcatccagccatctgaaagaccttggtgtcatagatggcacggttcgtagtctcgcggatggcagcatggtgtcatgaagtcctggaaggaagtggaatgttgcaaagaagtcaaatgtagcgacatggcattcgaagaattcttgaagagttgaggaggaccaaatgaggaggtaggcagtgtgtggtcgatacttccagattcattgataccaatcatacccctcttaaatcaatggctagatgtgattggtacctcgtctcgtggttcctgatacctcgtggtacctcacggtatctcctcaagagtggtaaaatatcttccaaggaaaacttcggaatacgactcacaagcatctggattgcgctgaaatgatgtaactgatataagaaaaaagaagtaatatatcaagtcttaaaaaataaaagtccatcagtagcaggccggtataacccaagttctctgctgttgttctccaatgtttcctctactagtaacctagcttttgtgctagttaccttgttagtagaccatggtaagaaattgtgacctacaactaaataacctataaacatcctttttttttttacttgttgtcatgggcattgggctgtagacctgtaggtaacccatatcaattaattagagataagattggattgaatcctttcttaggctgtgtttgtttccctgtgttcccaacctctctcactcgtgttctgcgcgcacgttttttaaactgctaaacggtttgatttttgagaaaagtttctatacgaaagttgctttaataaaatcatattgatccattttttgaaaaaatagctaatatttaattaatcacatgttaatagactgctctatttttcgtgcggagggaatgagttcccatctcagagaaacgaacttagccttagggggtcaagctataccaactatataaggatgggattgtgtatattatctgcaagcaaatagtctaatctatctgtcccaataatatgtttctcccttatttaaatctatatcccttcttcggaagccgacgtcgcccatgtatcttttcaacagtgtttatctcatcattgcctcaggtcatgagacttgttgacatacatacctcggactttagtaaaaatcggtgcttgctctgtttgttaagctctgtttttgttcctacgcgctatctgccgccgagtaatttgtttgctgttcttttttccagacaaaaccttattctactgccggttagtacttacttcctccgtttcacaatgtaagtcattctagcatttttaatattcatattgatgttagtgaatctagatagatatatatgtctagatttattagcatcaatataaatgtgggaaatactagaatgatttacattgtaaaacggaggaagtagtaatcattaatgtaggaccagtccatgtaaccgttgatccattatgagtccaacccttccgtggcctccataccccatacaacgatcgaaggaaataaaaaagatgggacagtgtaattaaaagcacgggacgcagttcgatcttgtcaaaccatatgtcggccacatttggatctctaccataccaattcatttgttggtagtgttaaaatctaaataattagttatgtggcttatgttagaaatgagtttaatacaaagtccgtggcggagctaaaaaaaattactgaagtttttactggcgagcccatgtatgaagtcaaaatttgatattgtattgaagtctgtgaagaaacttctaagatttagccaaattaaacataggcactattaattagttgagcttaatcccacatttactatttggatcgttgaaaaaataggcaagacacatttttgacatcaatccaaaatgtcccatcatcgaagcagaccaattagcaacagggttcactatatcagtttagggtttttgatcgggggtcactgaaatcccgaaatttcagaaattttagaaattttggtacaaaattttgaacaaaatttagttgaatttgaacaaatattacccaaattcatgaaaaaattgaaaatttcaaaaatttcggccgaattaatatcgtatcggaggaatttcggtctgaaatttccaaccctgattagcagtgagcgaggacgctcgatggattgacgtgagtggcccctgatcagtgatcactgacgacggcgagatgcgccgagtacgttcaaccaagaagagaaatccagtgcagactatactggatttctttggcggattcatgcaatgcacggatcagctccgacctacatcaccgttgagtgaggtttgtgagaagactctgtcggggtcacctagcctgggtacatattacaaactgtgtggagcgggactgagctattcgttagaaacacgggtagtaaattacaaatatagacgcccatattgctcgtaaattttgtatttttatgtaacacatatattctacctctattaatatcttcaaaatattgaaacgtcataatttaagtttggcaaagtcatcacatgaatctcgttatcaatgggtatgtgtcagggttacgggtctggcataccctctacccttcgatatacgttacgtatcgacatggcatacccacgcgtacgtggatatttccttcataatctaagaaaacttctcacgaaatcaatagacgggaagagtccttctcggacaagaactgggttacctacgtattgtgctaggtctagtgtgttcgagtcctactcggagagcatcagacctatggtataaaagggacccccggggagggcatagatcatcgaatctcagagccaacacaacccacacagcctacgaagccggagcctgcgaggagccaaatcgacgagagctagtcggatcaactcgactacgatctcgttggatccgacaagttccatcttttcctttgtaacctgtgttttctaccatataatcccatatcaactggattagggctattacctatcaaggggcctgaatcagtataattcttgtcttttgattgctcgatgtcgtactacttagatccttgtaccagcgtaccccaataccctctatatccggtctacgggtatcacccgtcgacagtatgttacttatcatcgaaaaataattagccgtaaatacgagactcgtaccaaatctagcaacgacttgtacctgaatatactcatttcaccttgtttacttccccgggctggctattttaatttgcacagctacattttggcaaagtcatcaaaatttaaaactttcaactcactttttaaaactatatattttttaaaatctatccaaaagtttcttcaataaattagaaaccaaaattattttttggggtttaaatattggtgaaaatatcgtttgaatttcatcaaatttgattcaacgttttttattttaaatttatgatcaaataatttaatcccctttgattttacaaatgaatcttgtttgcatttttttattttacactagcacaaataagtatgagaaaggagcaatattgtcattttgaaagaaatggaataatgtaccaacagaatatagagaagatccaaatggaaactcaagtacatataaagaattggtacataaacatttttctactataattaatggtatggaacagaggagcaaataattttttttaaaacaagtgtttctagaaaaaaaatggttaaatgaaatggggcatcaatgaaataaaaaaatagagtaatttttttaaaaaaaactacaaatagtaaagatacagatttaaaatgttatatcacaaaactacaaatttaatactcactccgttccaaaatataagcatttttagttatgaatttggacattgtatgtctagattcatagctaaaaacaatgtctagattcatagctaaaaatggctatattttgggacggaggtagtattacatttataacaaaacaatagatttaagttcaagtatcataaaattatagatttaataaaaatatcttatcacaaaactactggcttcaaatccatttaatcacaaaactataacacttatagccctatatgacatcaatactagagatctgatctataaaatctatagttttatcataacttcgatatatatcaaatcttgtgataaatttagtgttatatgtgatacaatgttttaaatctgtagtttttttatagttcgataaaacgtatatacagttttgtaaaatttactaaaaggaatatatttgcatgatggtttactaaaaagaatatatttgcatgattgtttaaatggtacggaacggtggagcaacgaaatttttttaaaaatatttggataaaattgcaaggtgcatttggtaaaaattggaacggtggagcaacgaaattttaaaaatatttggttaaaattgcaaggtgcctttggtaaataatggtcccggcggggctcgaacccgcgaccttcggctcataagatcaacnnnnnnnnnnnnnnnnnnnnnngaccaaactgggcttaactgaacattacagtttttataaattttgaacaatgtgaccaaatctgaccacttataccgtaggtcttatacagttcttttcccacgtatattttggttttctcgccttgcatactaaatggaattggcacactataaagattcattaacaaaaacaggattttttaaaaaattttactataggacattttaaatttgtagttttcactctagaacaccacatcaaataactcttaggagaacacactttgtcattatgattatttgtcagcagacatcgtacctattaaattagtgtttttgtgcggactagtgagaggggcccattaaatcgccatgcgtgttttgcttaggctaattgcatgtggctcctgttctctttctcctcgtcctcttcatctctcctcctctcttgcttctccagacaaatcaaacaaacaacattgttgaatctcgactaaaaatattatacataattgatgagttgataaaattatatataattgttggttctggagtaataaaaatacattaaaaagggaaaaaagcaatagaaggatgatgatgagggaggcgccgtccaacaccaccggttcgccagccacccaccgacgacagcgtgagcatatgtaactgtggtggcgacgagcaggagcagccgatcggaagtcagggatgataggtgcgagtagctcactccggatcgggtgttagggatggccatcatgattcgccgatgtcaggtcggtcagggcatgagtagatctgatgatagcgtcgtgcggactagccgagccagcggcattgactagtgaggcaaatggattgggggatggtgacttggggaaggccaactggcagagatacttacgatttcgtcccgctcctctgcctaggaccttgagagaggaagaggaagacggggattaaaacgaaaaactttttttagaggcggatgtctttttttattctaaatgcaggatcaatatggccatgccgtgtaaaaaagtagctaggctctctctcgccttgtcaacacgaaagcactaatttaatggatgcagtatagcttgataaataaaccatgaagtcacaaactcgcaatgtcatgtagcaaaaattaacctttttatttatttttaaagtaaaaccggaagttgtcgccgctatgttgatcgcaacgcctttttcggctgaggcaccccgagtcatttactttaacctccaccagtcaccggcccagccacacaacacaatacagtctgcttgcgttttcccgtgatcagtcagaaatttcacgagccggcatgcatgtgcatgcatccacgacggatcgatcatcttccaaccaaccatattatattacctctatatctatatatacacacacacccacactcctccattcacaaagaccaatataaataatccatcgacgccacagcgcagctagcgcccccacaatgcacactaaagctagatcacctgtagcactcgtgcttctcgtcgtcgccatggcggcgtcgccggcgttggtggcggcggcggcgcagcagcagcagctggtgccgtgcatgtacatcttcggcgactcgctggtggacagcggcaacaacaacaacatcctgagcctggcgcgcgccaactaccagccctacgggatcgacttctccggcgcggcgccgccggggcgcttcaccaacggcctcaccgtggtggacatgctcgccgacatgctcggcctccgcccgccgctcatcccggcgtacgccatggcgcagcccggcgacttcgcccgcggcctcaacttcgcctccggggccgccgggatcaggcccgagaccggcaacaacctggtaagggagtagtacgtactgtacagtacggacgtgccaacgttaattcagacatgttgatcatgtagctagtaataattaatgaccacggttcaatattacggaaaccaccaatattttgaggagtaatacaatcggttttggagatgttggaaatttccggacaaaattaattttaaaatttcagcaaaatttgtctgaatttaattaaactaattttgctgaatccaaacttttcaaccgaagagaatgtgctctcggtgtaccgatagacccgaaattcagtctgaattttggccaaaatttaaattttggataaatttgcactatatttttgacaaaaaatgaaatttgagtgaatttaagcaaaatttgaacatattattctgacttgtttcagaaaaaaaattggcaggattttaacagatttgacttgttttaggaaaaaaaagggatattttggcgcaaaaaaaacctacaatgggactagctgatagaaccaaaatttgtttaaattcagccaaaattactcattttcagtttcttcagaaatttcagttctatgggtcaccaaaatatttatgatttccgcgacattaaaccatcttcctcaaagtacatgtggacacgcaccacacgcatgcatgcagggtcggcactacccattctcggagcaggtggagcacttccgggcggcggtgcggcagatggggccgaacgccggctcgccggagcggctcgggcggtgcatcttctacgtcgggatgggcagcaacgactacctcaacaactacttcatgcccaactactacaccaccgcgcagtcctacgacccggccgcctacgccgccgacctcctccaggagtactcccgccagctcgccgccctccacgccctcggcgcccgcaagttcgtcctcgccgccgtcggcgacatcggctgcatcccctacgagctcgcccgcatcagcaacaaccaagacgacgatgacgctgctcctagtagcgattccggcaccggcattagcatctctctcggcggcgtcggtctgaccgtcggcggcggcggcggcggagggagtacgcgagcggcgaacgcgagcaggagcggcggcaatggcggcggcggggcgtgcaacgaggagatcaacagcgcgatcgccatctacaacagggggttgttgtccatggtgaagcggctcaacggcggcggcggcggggggaggatggcgggggcgacggtggtgtacctggacacggtgaggacggggagggcggtggcggcgagcgcggcggcgcacgggttcgaggtgctcgaccgcgggtgctgcggcgtggggcggaacaacgggcagatcacgtgcctgccgatgcagcagccgtgcggcgaccggagcaagtacgtgttctgggacgccttccacccgacggaggcggccaaccggatctacgccgccagggcgttcaactcctccgccgccgccggcgacgcttaccccatcaacgtcagccagctcgccgccatatgaatccaatgattaatctcgctgacatatgatcgatcattgatcaatgcatgcacttacttacggcaagagcagtgtatctcggttggaaagaattaatgttgtacccctcattctctaaatgtttgacgttgtcgacttttttaaatatgtttgacaatacgtcttattcaaaaacttctgtgaaatgtgtaaaactatacctcattccctaaatgtttgacgctattgacttttttaaacatgtttgaccattcgtcttattcaaaaacttttatgaaatatgtaaaactatatgtatacataaaaatatatttaacaatatatcattttcaaatgatatgaaaataattaataattacttaattttttttaataagacgaacggtcaaacatttttaaaaagtcaactgcgtcaaacattttgggatgaagggagtattgtagtagtatataggtattattatcagctattcccatcgttccataatataagggattttggtcggatgtgacacattctagtaatatgaatctgggcggcccagattcgtagtactagaatatgtcacatcccaccaaaatctcttatattatgggacggaggtgctaaagggtttgcgggcgtgaaagcatatatgaactaaatacacaaaataaaataaatgtagacaaacgcactttattaatgacatttttccctgtttacatggaacacgtacatacatcacgctcacgcgcaaaaaaaaaaaacgtctccttaagacggaggtcaacggcaattcaatgatatcactacaatcctattaaaagtatatagtgctacaaataaacccctaatagagactggctaataagcgtcagcttatttaaaaccgatacctattaaccgttttctaactccataggatgtaaaagctggtacgtagtatagtaatggttttttaaaaaactgacacctataaactttatatatatatatattgattaattaaaaaatcggtacttataatatattataggtgccaactcttttaaaaacctgcacctataaaaaccaagccaagttgatcaagccgagctttatcctctccctcctaccacttctccttttcttcgtccccctcccgtctgccactcgccaaatctccccattcctcctctgccgcaacgccacctcccctgccatcgtgctacacctcttccgctcttcctccacctcacctctgccgcctccccgttgtggccgcactccacctccttcctctcctgcatctgtcttcctcacacgtcgccctcttcctgagcctcctccaccatgagcaggagcaacatcgtccaggctcatcgatggagctcggcatggagatggagaagaaggacgcagtcacctcggccatgccggtgcaggtggcgcaggccgggcagcatttgccatcgttcctagcatcatccaggcttaccgattgcctctcttccaccgtcacttcacctctcttccaccactgcctcaccttcacggcctctccgctcacttccgccacctccacacaaccatgagcaggagcaacgccgacaagcttcggtagtgatgagctcaagggcgaccaaagccgccacgagctcaggggagttgacaatgagcaggagcagcgacgatgatgacgaaggtcactgccattggtctccctctccccttctccatggtggccctgctgacggatctgatgatggattggctacaggtgcatgtacaacttagggcattattgatggttcatgtgggatattgttcttgttcatgttggatgtgttgttcatctgttgatatgagatccggagattatttgttgtttatgagttgaactgttgatatgaggaattgggaatcgatatgtgttgatatgtggaaattgggatgtgtttatttcttgatacattgttattaggtggatttaggctagggttggggttgctcgaagtatcggatcgagccgacttcttttcttttggctagtggattccacgtggttgccggttgttaatcgactatctctgtttttttaatacactatgccggaccatgctagctgtgacgggcctaaaccatcacctctgacggattcagcctctcgtcagagattagtggtcagtgatgactctcttcacctttgacaggcgaaggaccgtcagtggtgaccagcccctatgacgggccacgtgtagaacccgtcacaggtaactattatctcaaatggcccattagtttgtgagccgtcagtgatgtctataatccagaaaaaaaagaaaaatagattgcaacccgtcacacgtgtgaaaaaaccctagcaagaaaattggcacacgctgccatggtggtgcttgctgtcattaaactgaccacatcacaaaaacttcaaactgaccaatagttcattgtcctccatcaccgcatcaccatcttatatagcaatcatttacaaaaggggatggcaaaaatttatcatacaacaatatcatatcattcacaaaaggggcacaatggccgatagttcgtcgtcctccatgacgaaccagctacgagagacacaggtggagacgccgcgctcgcagccgccggggaggcggcggaggatctcgaagaggcactccactgctgttgcactaccaaacaaaaatcaagaaacaagaaaccaccattagagcccacattctcaaaccaaacacctcaaatcatcatcatcatcaacaacaacaacaacaacaacaacaacaacaacaacaacaaggagaagatttaagtaaaaaaaaacaacaagaagaagaaacctcaccgaggtggccggtgggtgggcatggaggaggcggtacctggcgttcagatctgcgcatccccggcctcgtggaggtcggatctggcggctagcgcggtcggtggcggagctaagggaggcgttggtggcattggtggccgggaggcggggggaggcgctggcggaggtggaggcgtaggtggcggccggctagcgcgggaggaggcgaaggcgcggctggaggcgtcgccggcagcggcggcggaggtggagaccgctgccgccgtcaggcctcggccgcctcccctccccccctcggcaaaaaccgcgccacggctccagatccgtcgtccgccaccccgcttcccctcgcccctgccggatcgggcggccgagccgccgccgcgcctcccctcccgcccctgtcggatctggcggtcgggccggcgccgccgcgcctcccctcccgcccttgcacaaagaaagagaggggagatagagaagaagtggaagagatagaggagaagtggagaagagggtgccggccgaccttatctcctcctatgggccccgctgggagaggagatatatatatatatatatatagtggcagaagtcatctcaaacgggctaagacttaaagccgtttgaggtgagtaaaccttacctctgacgggccgtccggctgcgatccgtcacaggtaaacccgtcacaagtgactagttacctgtgacgggtcgcagccggatgactcaccgatgacggcatcccgtatgacccgtcaaaggtgacggtcatcagtgaccatttcgtttgcctatcacagttatcccgtcagaggtgtgaggatctggtgtagtgatagtttacaccgttaactttttgttacacgttttaccattcgtcttataaaaaaatttacgtaattataatttattttgttgtgatgccatctattaggaaatggagggagtataacgcatatctatcgcaccatggcccccatcctagtcggaaactaggaagaaattaaaatttactcctcctacgactcctattcggaaactggtaatttgggcatcgaatcaaaccagagcggatagatcgcagagggtttgctcctcgtaacggattgcattgctcgatccctccccggcccctaccaaattcacctccctggccgatagcgccgcaccgcagttatccacctcctccggccggccgccggccagtcgaccagtcgagtcggaggcggagtgcatcgatagatcgatcggtttccatcggaaataatcggagaaggtttcgtttccttcattaacccggatcgatcgggaggaatgcgaggagcgtgcgttgggtacgtgaggctggaggagaggaagaaaacgccgccgccgccgccgcagccggagatgatccccgggcagcatacggtggagataaggaggatgatatacctgacgatcaagctggccacaagcttgctgaaatcaagctcgagcctgcccaagaggtagcaactgcactttggttcactcgtttcttctttaattattagaattgtctttcagtttttattatggtaactagcagattgcgcggcaaacatcattatattttctctcatataatagtatatatgttttctcaatatattattcaaattttttataatgacatcaaaattttaaattttgcaataactttacgaaactacaaatacgtaatattcatattgtattttatatacgtgttagttattaattatttttaatatcaaattttagttatttgtaaattatatatattcctatatgtactctagacttgtcttttttttttaattctgaattttctataaattgtatttctatatagactctaggctcttcttctaatattatttatttttatttctgattttttattatttctaattatatttctacgtggactctaaactcatctctcaatattctttaatttttaattttgaatttcagttacttctaaattgtattcctatattgactttaaactcttcttcccatgtttttcttaattttgaattttagttatttgtaaattgtatttttatatggactcaaaactctacttttaattttgttatgtttattccgaagtttagttagttttaaattcctatatggactctatactctacttctaatattccttatttttaattctgaatttcagttatttcctaattgtatttctatatggactctagtgtcctcttctaatattccttattttttaattccgaatttcaactatttctaaattgtatttctatatggactctagtctcctcttttaatatttcttattttttaattccgaatttcagctatttctaaattgtatttcaatatggactatgatttttctttttcttcgattaatgtgagaatttctaagccatgagagcgaacgtggagactcctttttctattcctttaataatataatagattttgttaatttccttattagaaaaacaatagccttgagccaattaacaaagacaattctaataattaaagtctagctcaaggcctagcacaaagagaagcttagggtagctaggccttgagctagatttgtctactaaactagatagaaccccgcgcgttgtcgtgggattttgtgtacagtaatatattataatcaaataaaaatatactccaaagagaagtctgaaattatagttaaaaactttataaactctgttgtctagtagtactaaattatgaagatgtatatattttcttttctaagaaacatgttcctagatgtgtgtgtctatatatttcaaccgatggtaaggcaaaagaagatatcaaactccaagggtcggtgagtaatgatgggacggtggtactcataacaatagaacggatatgtactttgtcaactaaagctcaatcgttgtcattaaggaggccaggctcttcaatcgccttagttgatttgtggatggcattaaggagggttgttcaatcctacttcatgcatgcatgttgatgaaacgcccggctagcaaaattgtggcatcgaatgcattgagtgcatgatggaaggaataactaaatgcaagctacaaaacgtatcacactcaaaagtaaatctgagctgtccaagataatccaatggtgaatagtgaaatggctttgagataatctggaatgttggatttcaatctaatggctaaaaagaattaaggtgatgtagaagcaccacaagtgagaaaaatactaataactatacttagtggggatcaactatatatattatatagatatagattactattagattctctcaaaactcagtgaaaattttgaaaaagaaattaaaacaaaagatataaacaagttcaaccccccccctatggagatggattcgaatcactccggtggacgtccacagttcccctctactcttgaagatttctttctctgtgcctgatagcctagtttctcaaaattgatactgtactactacctccgttttaggttataagactttctaacattgcccatattcatatagatgttaatgaatctaggcacacatatatgtctagattcattatcatatatatgaatacgggcaatgctagaaagccttataatatgaaacagaggaattactagttagttagtacttggtcattaaaacactattgatatttcagtgcgtggatacatatcagaacaattttgtggtgatactaatgcatgatttcacgaaccatttgggaagccagctcctgaaccccagatgataatttgtcaatggaaaaaatagtgaaccaagttgttagtaataattgttaagtaacaatactaaatactagtactaactacgtgggcattaggcatttcaggttcaattgacttatttaaattatcaggtagctgattgatttctttggtccttcagtgctgaaatttgcatgatatggtttttcccctatgcatgctaactgttgcatgtttcatttctcagatggaattatgcattatgctcctcgagtgttgctctcaagagagaacctaccttccatattacggattactagcacaaagattgtgcctaatcaacaaagtttaccaaaaaaacttcgagaaatgttttgcgaaacaatattcgatgatcgatcgtctcgacacaaataagctggggaatgttgccaactttttcgcgcatttgttggccaccgacgcgcttccatggcatgttttggcctacatccgtttgacagaggaggataccacgtcgtcttcaagaattttcataaaaatactgttccatgagttatcagatcaccttggaattcgccaactcaataagagactgagcgatcctaaaatgaaagattattttgattcaatctttctaatggatcatccgaagaacacaagattctggatcaatttcttcacctccatcggtcttggtggtatcactgagacgctgagagagtaccaatgcctgcaatgcaacaacagaagtcagaatcaagttctgatgagagtggcagaaacccaagtaagagaaggaagatgtaaagagacggatggaagaagagctccatgaaaattcaactgtgcttatgggggatgcaactgtcgtcacaatcggcatcgtcagatttgttcagtgcgattgttttgttggatcaatcttcctctatctgtatccatgtgtaatatcagatgatgtttgttgcttatcgaattcaggaaaccagccatagcagatgttttctgcagtgcaagttttgtgccttcataaacggtttattattgtttataggtttgacaacagtgatgaagaaataattttaaggataaaatgctataacaggcagcagctaagcaggattaaaaatgatgtaccttttttatgtgaaatatgatttacctttttgtagatgaaatattatgatatacattggaaacacacgtaggtttcacttaaggtataaacttttgcaccctcttgttatatttctcgtctacatagataagtggtggaaatgaatggtaagaaaattaaatccagcaggaaaataacatcaaacatgtgtacaaaataacagacaagatttcacagaattcaactttggttgatctagaatcccctttcaggccactcagttgctgctccctgtcagacatggcatcatatgtggcaagtcatggtaaaagcgtggaaacccatctacagccgttgtgcttggcgtctgaccaggaacagccacagaaaatatgccccaatttgcaagcacaaatcacaccgtcttcagtagggcagactatcagtagctcctgctgactttcacactggaaatgagcagcagatcacccacatctgagttcttacaataccaggcgtgaggtcgaaatgcaagcaaaaacttgttgcttttgttgactagtaagatttcattgccgtatgaccgggtgcaggggaattccatgaagaggacgcaaatatcacattcaaatcaactggaccagacacttcatcatgactcgaatgacagagataacataatactactgccaaaaagaaaaaaggaaaagaggatcagtattttcttctaacagtagtcactatataacatgatccgaagtgtcattcatgagcaaatatatatttttgcatattacatttgcatccattcattcacacagaaaaagaagaaaaacagaatggctgagcccaggtttcctcctcctgaaactctgaagatagcattgctgtgccttctcctccccttgttctcaccagccacagcatccatcccttctgctgcatcgacgtcgtcggaccggagctgcatcgccgatgagagggccgcacttctcgccataaaggcaaccttcttcgacccgaacagccgcctcgcatcatggcagggcgaggattgttgcagctggtggggtgtcaggtgcagcaacagaaccggccatgtcatcaagctgagactccgtgggaacacagacgactgtctcagcttctatggagacaaactcagaggtgagatgagctactctttggtcagtttgcagaaattgaggtatctagacttgagttgcaacaacttcaattggtcacagataccggtatttcttggttctcttccaagccttagatatctcaacctttcatatggtttcttctatggaagtgtacccccccagcttggcaacctctccaaacttgcctaccttgatctgacctcttattcatacaaccagctatactcggttgccctttcatggctgtcacacctatcctcactgaagcatctggtcatgaaccatgtgaaccttaccactgcagtagattgggttgatgaaatcaacatgcttcctgctctgaaagtactctacctgaaacagtgtgggctgaggaaaacagttcctttccttcgtcggtccaatatcacggggctcgaagtgcttgacatctcgggaaatagatttcacaccaagattgctcctaactggttttggaatataactagtctctctgctcttgatatccgatcgtgtggtttctttggctcaattccagacgaaataggcaggatggcctctcttgaagaagtctatttccaagggaacaatctcatgtcaaccatgataccctcaagtttcaaaaatctatgcaacctgaaggtgctggatctacgaagtaccaatactacaggggatatcagagaattgatagaaaagttgccaaactgtcactggaacaagctgcaacagttgggtttatcttataataatattggtggaaccctgccaaattggtcagaacctctggccaacttaactgtcttgcttctctccaatactaacatctcaggagctatgccatcgtcgatatgggctctcacaaaactgaacattttggatctttgttccaataagctcaatggcacagtcagggaagatcaattaggaaaccttacaaatctagtgtacttagggttgggcaatacacatctacagattaaagccagctcagattggattcctccattcaaactgcaggtagttctcttctattctttgcagctagggtcagaagtcccaccatggcttagatcacaaacaagcattcaacaccttcaaattgcaaacacaagcattactacaatcccagattggttttggattgtgttttcaagagcagattttttggatgtggcatataatcagataacgggaacgctaccagcaacgttggagtttatggcagcaaaaaccatggatctgtccaacaacagatttactggtatggttccaaaatttccaataaatgtaacatacatgtacttgcaacggaactcattatcaggaccactgccatcagatttcggagccccgttgttacagtcacttactctctatggcaatttaatatcaggcaccattccatcttcactgttctcactggaacacttggaaatattagatctatctggaaataaacttagtggcgaagttccaacttatcaagaagattcaaatccacgcacacgacaactcattgtcgtaaacttaaatagtaacaacctctctggagaattcccattgattttcagaagttgcccgcgcctagtttttcttgatctatcctataatcagttttctggaaatttaccactgtggatgggaaagaagtttctgccaattttatcattgttgcgtctacggtcaaatatgttttcgggacacattcccacagaacttacaaggattgatcaattacagttcttagacctcgctgaaaactacttctctggaagcatacctgactctttggttaacttgagtgcaatggctcgcacatctggatacagtgttcttctagatgaagtcatcgcaactggtcaaggtgcaatgtaagatataaattatttctatgaactggtatcagttcaaacaaaagggcagcaacttgaattttcaagaggaatttcacgtgtggtgaacctcgacttgtcgaagaacaagtttactggagcaatcccttgaggcattggtgctcttgttgcactaaaaagtttgaacttttcttggaacctcataaatggggaaatcccggagactattggtcagctcaaacaactggaatctcttgacctatctcacaatgagctttctggtgaaatcccttcgagcatgcaggatcttaacgctttgggcaccatgaacctctcatacaacaatctatctggaagaattccaagaggaaacactatgggatcatatgacgcgtcttcctacattggaaacattggtctatgtggtcctcctttaactagaaactgttctggaaatgcgacaagcaaagacttacctagaaatcatgttgatttggaacatatatccctttatcttggcatggctattggatttgtcctcagcctctgggtggttctttgtttgctgctgttcaaaactagttggagaaaatcctatttcatgtttgttgatagacagcagaagaagatttatgttagtgtaaaaattagaagtgccgtcttaaagaggaagttaggtgcaaataatcattgatgtatctctagtctctaatatatacaagaatgtagtggttattgtgcggtgttgagtttgcttattaaccaccatgccttgtgttggtggcatcttctatgtataattaatcatttgcatgtatggcttgtaataagataattgtgtgatacacatatgcaatattgttaagttcacaaacttatggtattttatctaagttttggttctcttctatttctataacatgggagtagctatatttatggcgctatatttttcaccaaaaaatagttgtcatgtatttagattgtaagtccctaaattacatgtgtaattttaatgtatttacaatgtaagtcccaaaattacatatataagtccaaaatttacatggtaattatatatttaagtggtgtgtaagtggggtgtaactattgtgtaaatttcatttgatgtatttttatctaaaaatttgtcaccatatttttatagctgctaacgtcttaaaggaaatcaaatgatctagagatcgactgtaaacaagacaaaaatgtggcgacagtggtttagcaaaaccgtaacataatgtggtagcatcttccttgtcatatactcgtaagtcataagtagcaaattattcagtgattaattcagttgattccatgacgccaatctataccttctattttttattactattatttttccccaatttcaagccctacaattgattcagtttgaaattaaaaagatggaaaatgtgtttgtgagacttgtgaaagggggttcgtttcagaaatcttaccggccggcgccgatgcggcagtgctccgcggatgggaggggtttcaggggctagccggcggcgagggggctggccaccttcgggctcggggctccagcctccgccgctcttgctgccgcgagaccgcgagagctttggcatgagcgatggtgtgcgtgtcgtggcgtccgggtcggccgtccgggcggcaggcaaggcgccgtcgcggttttggggggacggcgaccggcggcggctgccggctggagcagtgaagcccgaaccgaaggcatcggctgctgccttgttgggccttttttctgggcttgcggctgtcaatttgggctgactaggggtgtgggctgctaaaagcagagtccgcccctcctcctctcccttcgtagttcccgcatataaagaaactgcattaataatttaacgcgcagattgcgcggtatcgttagcatttttttgtcatataatagcttaaatattttcatattttattattaaattaataacataattntaaattgagtaaaa

SEQ ID NO: 79205 - DNA, 914 bp, Oryza sativa
ttctatattagatttacttgttatatatttgaacaaacattgctacacattgagttttgtgtgttttcgttcgcagaggtacttgcttgggtgaaagaaaagagaccgagcgtaaggaatgcatggatgatgaagaagttgattggggaccaaaccaagaccttctccaagtatacttctacctcaccacgtcacttttggcctatagaagacaagagatcaagttgtacacgttttggattcggattcgggcctcctgacagcatcaacttcaaacggacctaactccctcattagttggtttcagagcgcagttgcccattaggtaatttatcttcccataaccagaaaattgccacacaaaaatatttattctttacctagacaatttgagccgttgcattgttctattagattttgctttgttgaattctaggttgcatcgtcgtgtcgagtgctggtttagttttagatttaatttttagttttgagtattacatctattcatcttttaggtctagggttcatcactcaagtatgtgagttgtacgtctgttttgggtccagtttttcatctcgttagttgttgccggcaccttgaaaaattgaatcgtctcatcgtcgggtttccgtttttgtgatttggagagatttttatcaaaccgttttggagttgccgtactgtgcgcgtgtactgtgcgcatgagaggagtactgtgcgcgtgaagagagactccagatcagatctattcgtgactatccgtattattctctctatagaattgttatgcagcggatttgagatatttttataaaaacggaacctacatgatatgagcaatccatttttgagatgatccaattttagttttgcactttgcgtttgagtccctgtaatattcatatttacattt

SEQ ID NO: 79206 - DNA, 19435 bp, Oryza sativa
ctgcagcccggtcactcatatggtatatttagtgtatacaataagcactagagatattcacacctgatctcctgcatttggaccatctttgtggaaaagcataggtcgacaccatttgtcttcattcatcaggctagaattctgaaaatgagcaatcaaagcactccttccttgaatccgggcgtatgcgagcgacgccaccttttcactattgaatttctcccatttcttgccattaaatgtctgcagcaaatgtcaagtccaattaatcctatgcatactttcaattagaaaatgccaggggaaaactggcagtactctacagggcagaaatactttttaaaaaatcttcctcccacaaaaaagaatgcaacacaataataaaaatactgttatatcatatgctatgcttagatcttggaaggtacattaaaaacggagaagcttaactagtaatgcatgcatgatatgtataccttatagaatgggattatgtgctgcggatcagtcatattgataaaagcataccccacattacatttgttctgagaaaagtgaacattgcaaaagtcagtcctgaaattgtactcacagttgcaatcttttacactaagaaaaaaaaagtagaccttaaaatcaattgggagatagatgaaatcgtaggttccacggtggttctcatcaatgacagccaaaagcagcttacagttgtacctgtggatcacatcaagtatgacttgagtcaacagaagaaaaaaaagatacctgagtaatgtgcaagacagctggcaaccggtggcaagatgtgcagaacctacttgtttggtatgttcttgatcatcagggtggtgcgtgaatcttcaccctttgctatgcgatcaatgtcaagctcaaattgccgtttgttttcagactgtgcaggatttccatcatgtctgcgactcctcatccgatcattagtagcatcgtatgaagtggaaacatggatcataggattccgaccattgattgcattgcacatttgctgaagggattgaaatccaccgccaactggggagaacaaggcctccctaaaatttcctctgctggatgcaaaggcagataattctgatggatataactgagggctaccatgcaaacctatgcttccgagagatcctggatgaaaagagtgcacatttccaaaactgcctccattgtcaggagctgaacccaagtgatgctggtccatgggataagaacctgtgttcagcatgtgaggcggcacaccaggataactatgcacgtgcattgggtgctgcaagttcgaccacagtattggagctgagggactttgtggaaaaacatttgtgtggttccaggtgtagtgatatccatgaagggggcaacttccaatttcagtaaagccaaatgctgcaaaaaacaatttctgtgctgatgaaattctaacaaaaaaaatcattaagctggtcaattcatcaactacatcatccaatatttccaaaaaggttcaccattatgttgttatgataataaaaacataggttagtaaagccaacaatgagcagttgaagctgagaactgttaccttcattattttgatcaaaagaatgaccgcaaaaaccagcagggcccactttttggatattgtgatccactccgtcttgtctagagctagcattcctaccacttactgtcatggacttagagttattacaaatgcggttgtgatgctctggcaatgagcgtgggtggagggtttgtattccacgtccaaagtttccttgaccaaagtccactaagatcgccaacagaggcttgattattgtgctgaagtgtagatttaattctgataggtgaagataaaatttgaggaccagtcgtagagatgcactgggttgggctctccaattgttggttaactggagaaaataaattatgaacagtgctgttgtcctgacatttggtgcccaactttcctgttttggcatgaaaaagggcaaaataagtaatgatcaacaatttccaaaatatatccaagtaatatattgtaccaatggtcccaggtgaagagtttttaggttggtgaggcaaactgtcttgcttccattctctagaatgttgctgcctcaagctgttaagtacataaataaaatcttcaccacactaatcaaataacgcttaaaaaaaagttacacgcccagttggtttgtccctaatgaaaatttaaaaggttcaagtgattgacatagagttgatatttggctgttccacaaaatgaaagaacgaccaataggtgtgttagtggctgcaaagctatgagaaaaaccgtgaatgagaacttgagatacattccttgcatctaggagtatttgcataattttacctaagaaaacagtgaacatattttattatgatattatcccatctcccaaaggtaactaacatactaaacctatagtatgaaggaaggcaacgatagctagcacgagtatgaaaagataataccaaaaacgggtagaaaaaaattcagccaagcaaattaccaagatcctgcctctccatgttggctaagttcaaccttgaactttgggcctgaaattccacccttattaaggtcatgtagtgcttcttctgctgctctaacatcatagaactctacaaacttcttggtgcagcttataggagagctggaaatctataaacaacaaatgattaccatagtgtgtggatttcagttttgtagtcaattactcaattatggcagtatagctacctcctttacatcaccataaacactgagcatttggagaagatcatcattggagatggaagaatcaatgttagataccaccaacattcccttatcaatatccttgcctggaacattttcctagcaaagtacgcgacatgacagcatcagatattaagtgtttatctattgaactcataaagtggcatgcagacagatttagagcaaatatatagcatgttagaagtagcgcaattaccggaacgactgcgtgtctcagtactatgtaacaacagcatttaattttcaaaacatagaatataaatgattattgcatgctaaaaggaacaaaaaccaataaataaacaaggggcaccagtaaaagtaatagcatgattttgtagcaagttagaatgaaaaatgaaacagaacaacattgcccaagtaacaaatggcatgataaggaagatatatagattaggtagcatgcctaattcaaaactactgatattattatgcataccttaggaaaagaaaattgcacatcaagtttcatcagccccagaggcttgctatgcagcgctctcattgcattttgggctgctcttatgtcataataagaaacagttacaaacccatggtgcttgaaggaggtatagagcatgcgaatgtccccgtattgctgaaagatatatatgtgtgtatataggttcaaaaggatattgtttactaaactaaaaccaaaatttgaaatgaaataaggaaaaggttcaatacctgaaacagaaccgtcagatcagaatcctcgatgttagcagtaatatttctgactacaagagttcgggaaggttgtttattgatggagtgtcctgaagaaatttggctcttgaaggatccatcctgaactttgtcaccttttacggaatcattgttttcaagttccattcctcctccagtgcagaatatatcttcatcggcatcatcctggttggtcgacatgccagtaaattcaaatccatcggcaatacctgatattaaatcatcatcatcatcaggaaggagatctccaatagtttgagcttctatcgcttccatggactctagaggttcatcactgtcgtagatggaggtatgtgtcccagtagattgacaaagaacaccacttactatttctctcgctgcagaacatcatgaactcttagaaaagattaatcttcaatgaacaatattgtggtttctttcaaaaacagtacttttggttgtagtgcaactaagatgataaaattctactatcaacatggcttgtaggggaaaaaaagaaggcaaagggaactcacatttgccactgaatacttcagagagggagctggatgaaagtcccttcccataaccaggcacatgttgatcagcagtagttggttcaacaaaagctgtttctcttgtagacaagccaagcctcgatatggggtttgtgaggatctcaccccaagaaagtgacggtgaacctgaagcattttcttgccgcatcaaattgctgaggctaaggatgtccaggcccttgaaggcttgacctcctggagtttccggatctcctgcatgatttgctccattgggttggatcttttcaagtggagaagcaaaaactgacttgctccctgccattaatgatcacagtcagttcctgaagaactatttaacctatcaccatattacaaccttcaatacatgtatcatatgataaattgatcatttaatatcgaactgtgctaaattaactgtccaactagttcctaccaaactgtcttgggacaaaattccgtaagcattctcccacaagtaaagttcctactcattccctgctgaactgtttcagggatatctttacctaccaaaattggatacttgatcacttttagccaaccagtgcagtatctagtctaaacaggaaatccctggcagtaaataatctgaactaataaaatgatacaacagcctaaaaattctggttttataggttatagttagttagttaaattggtggcaaagaacgggcgggaagtgaccacaataacaagcaatcaccaatatctcccataaacatgaaagatgagttcccgaactgttctttcaagcataagttgggtaaggcaagtcaggtatgatctatttaggagattactattaacaagaatacagaagagagcaccaatctgaataatttccatcatgtaagaagcaacaaccatgagataataattttcaaatgaagcatgatccacacctttgtgatccaccattgactctgaattccaaaatccaacttgcctctgcaatgaagcatggaagggaaaataattgaggtgctacagtcttgcagaataaaaagaaatcagtggcaggcaggatggttttctggtttgtttattactagtacctctgtagggacaaggtcctgagagaagaatgaagatgaggagtcgtctgaagttggggtgaatggcgacaggtgcctcctgtcaatggctccagaagctatcaccataggtgcaatggaagagcccttttttttttcctgccttgggtcactttgggattcctgtttttgtggtttcttcaccgcctcaatctctcaaacttttggcccctttcatcaacttcctgcacaaggacaggagagattagcaacaggacacccaaaagaaagagagaagatgtgtgcccctcaagggttagggattagaggagagcaactacacatgtacaaaaagatggcccattccaacaaggagaaaatatatttctcttaaaccagcagaggataaactgaatcgagccaaaagagaaggaaaaaaaaaggcagggtaaaaatgagaaaccagctccttctttattaatgaaaaagaggcagccctcctgccctcttattcgaaaaaaaaaagagaaaccagcaggtggtgaggcaagaagaggtggtggtgatctcataataaaacttgtgtaagaaaaagatgtgacgattaagctgaagcctctagaaattttggcatgaggggaggaaaggacgactcagctcacctgaagcagcagcagcaaagaaatgaagaggttgcaggaggtggaaagggagagagaagattaatggcaaaatgcagtagtaacagggagggaaaggaagcagagcagaggtggttggggttgggattggattggattggggtttgcttatatgaaagaaatggttgcttgctgaaaatgcaagttgcttctcggtgagcgtaaggcagcgattccaaagaaaagaagcaaggacatggagatggaaatggacattagcttagcttaactagttggagaagagagagagaggcggggaaccctggccaggggcttcatctccttcttcccccgcactgcaagcaaacaagagacgagaaccgcccctggccctccaaaataatattaatagaaaaaaacaaatcttttttcgcgttgccttgccgccgcacgcaaacaaacaataacgcaaacaacaaggcgagcagcaggagtactagcctagtttgccactactctcctcttctcttcttcccttgttcgggtcgggcacgcgggagaggaaagaggaagaagaagaagaagaagaagagaccaacctccatccatgccatccgtagagcaatcaataatagagccatgccatatcatagaataggaagaggggagagcagagcgacagacacgaggaggaagaccacataccaacacaacgacacgagagtactagatgctctcttgagtaccactgtccgtaagacagacacacaatgacaacacacaacgtacacaagagctagagggaggcgagaggagaaaacaattgttggacctggattccccataccgtatgctcttgtagaatttttggaaacttcttgtgcatctaaaatagagtgatatattagcacataattaattaaataattattatattaaaaaacttgaaaatagattaatagtttttaaagaagctttactatatatatatatatatatatatatatatatatatatatatatatatatatatatatattaagaaaacacattattagttgtttggaaaacgttagcgtgaaaaatgaggagtagaaattagaaaagtgtagtgacgaatgcacccggctagctctacgtggtcgtctcaaaatgtcaggagttttaagattgaaagaaagttaatggaattaaatggggagtattatgattggttgagaagatgagatgtataaagagatagtgagatatgtcatagtgaaccaacaaaataattattagggttgtgtattagaggtaatgtattatacatgttgcctcttaattattaagtagatgacatggttaagattagaggtggtagtcacatctactataaaacttgctctaagacaattattccttacctttacacacattttgatgtagtgatgattaaaagtgaacttattaaataaataaaataaggtaaagataaatttattttagggcggagggaattgaataaggaattgggagagcaaagtgcaatgcaggaggcgtaacctctcccgttcacgcgagacggttgtcatcacctcccgtgtcctgcctaatagtgatattaatataaatttgaaaatactctttaaaaatctatagaaaagttattttaaaaaatcatattaatctattttcaatttcaaaataattaatatttaacacgctaatttatcaccttgtttagtgtatcttatcgattttctcatttcctctcttttcaaacgctctctaagttggcgttatacacttatcttcatggtatataactcctactttattagtggtagttgatataatatggtatttcctcgatcccaaaatacaacttctgcatttttaattttgttcaaaatataacaacctaatatttgtatgaagtgacatttaacactaaactacctatagtacttttggtattatttaaaccctaactatttaggtctatatataatccatcctgagaagataattttatttaaccctctctttaatggaaacatatcctactcacattgtttttttttaaaaaaacatatcctatgtatactagcctcccatgtacaccaactagcaattgtcacagaaaattctacaaaaaattggacacatacttccaatagtattacacttacatgtgaaatcttatctttaaattcattatattttagccgtaataaaaaagacaaaatcctgacagatttttacctgtaaaactgttagatttttcactttttttgttacggctaaaatataatgaatttgaatatgagactttgcatatatgtgtaatactattagtagtaaatgccttttttatagaatttttcgtgatatttgctagttagtgtgtatgaagtgtgtacgggaggtttttgtgcataaaatatatgatcccctcttttatatccgcgtcgaaagtaaaattttgttatatttaactctttaatatccacatcgaaagttaaattttgttatattttgagatggtgcaacggccgtgtcacatccattgaaggttagatggaggagtataggaggcagcagcagcatattgatggcgaacatatctttatcttaaacatgtggatattggccattgattactccaaaagaaataatctcttcgaaaatcacgtgtccacatcacgtgtatcttatgcttccgcaaacaactaaaccactactattaccttataataataataataataataataataataataataataataataataataactactactccttccgtttcagtttgtaagatgttttgactttggtaaaatcagactacttcaaatttgattaaatttatagaacataataataatattttcaactcaacacaaatttattatgaaaatatgttcgattgttgatttaataaaattaatttggtattataaatattactatatttatacataaacttagttaaatttaaagtagtttaagtttgaccaaaatcaaaacttcttatgatgattgatacgatacagtatctttctctctgtgttctcgagctagctatagctgacttgcatgatagagtaatgttgatgtcatgtacttactgattgattcatggttggcacgtactagatgctatggattttgtctactgtcttgagcgtgtatatggatatatatatagagagagagaccagtagtatcttgagattttggatccaaattctatcattaaaggaaaaatccgaaaatgtaagatagtaattgctgctgtagctaactagtaacatcctgcgacgcgacgcgtgcatgtttgttcgtactacagtcttccaacagaagctttgttgtttttccttcctcctaggtagtactccatccgttccaatatgtatcaatctagaatgagaaatagatctaatcccatgctagattgctacatattgagatggaggggatagtatggtagaagcagcaacaataatacatacaacacaacatgatctgcgtatggcacgtaacaatacatacatacatacatgtgacggcttaacggcgtagaagtggcttcggctcactatgttagagccacaccacctcatgacacatgcagtcttctttctcctttcacacggtttgttgacgagacagtaaaagagagaaaaaaagaggtcaaggaggcctcctccatcgctcgggtctggcggctccattcccgatctcctcctcacctcctctgcagattcggtggcattggtagcggatgtgctgatgcggtgtcctcgacaacagcgactgcgtgtggtacgtgagggaccaggcatggcgggggtggggtgagctttccaggatcgatgctttggatgctatgctgcttttctagttttttcgaggcaaggaactcgcgtcttacctgagggacgagagcctatgcaaaggtaatagggcccacaccctccctcctccacggcatcacgcaagtggggtggaggcatgaagcaactcgccccgcgtggtccactgtgaaaggccataaaatgtaggtcacacatagatttgtcctaagacgacaccggactacctaggaaagccacaaagtacatagattagtactcctaccgttattactaattattttattttatctattttccattaagcatcctctccacgttgttaatttgaatatattcggctgggattttttttatttactatgacttataaaccttgacacgggactaaagcaataataacaataagacatggcttttattaatggtgaaattggtgttggtaattccggaccaaccggctacgtaccgttctgatttcatttaggagtaccttttcttttttccaattgaaccatctgacaatggttatcaacaaaaacaggtgaaaatagtaaaaaaaaaagaaagcaaatagaaacacaaatgatttttctgccccaccgactgtttgtttggtttaccatattttcacaaaaattgttgtttttataatacggtaaattactttatttcttttttttgactggaataatttcattccattataaccttggtggggcagaatcaccatcaaccaaaattctaaatacctagtacatgtccatctccatttgtccatacatagaggccgttcgtattttacgagaattactaattaattttccgaccgatactgcatatgtttccatttgaacagttatattttctttgttttctgatatttttcattcatttgaatagttgagattgttttgttcacatcaacccacatgaatgtgaacatctatcatcgtattaataattacacgtctttcggcaaacacataaagtcaaattgatcttataaggctgtgattgcaatcccattttcccgatccctctccctcattttccgctcgcacgcttttcaaactactaaacagtgaattttttataaaaaatttctatacaaaagttatttaaaaaaaatcatattgatccattttttttaaaaaaatagcaaatacttaattaatcacgtgctaatggatcactccgttttccgtgcggggagtttagttcccaacttcctatatccgaacacagcctaaatgaagaaagaaataagctctccatcggcctttaatttaattacttcccatatccgaacacagcctaaatgaagaaagaaataagctctccatcggcctttaatttaattagaatttctttctccattgcgtgtccgtccacgcacgcaagggaccagtttaatctcattagtttcccgaatacaaatatgtatatatacttagattagattagagggaaggcgaactagctacatgcaacggattgggtagcatattattttgtgatcgatgcgtagagtaattaattaaataaattccactaactttatacatatagttaattagagtagcaggccagccgccgtagttttccagtgaagtcaggaattatatcgatggatcctatactgcggcaactaggctaataaagctgaaacgtaaccgagtaaacgaactcttgtcttggattgagctggcatggatgctcgctcatggagtaacaacaattaatcgcctcccggccttatgctatatgtttgaagaaaataattatactttaatatgaaggggcaatttcgttcttgctcctgcttcaatgtacactattgattttgcctcagtttttttttcgtttttgcctctaatttttcgaaacgagtcagtcgtttgcccctgttccgttaattcttgctaacggtgttaaatgagggtaaaaatgacaagcatagccttagatatttccccgtacttttgtacaccacttgcacatttgccctattttgagataagccattttgacacgaactttgaacatgttgtaaattgattcttcctatgtttcaaatttgatccaaattttggtaaactttcacaaaaatttgacaaattaaattactgctatagaatggcattgagatatttgtattttgattatgtcaaaagtgcgagaaaatatctaagagtatacctatctttttacccccacatttaacaccgttagccagaattaacggaacagaggcaaacggttgattcgtttcaaaaaaagtggggataaaaacaaaaacctaaaaaaacatgggcaaaatcaatattggacatcaaagtaggggcaagaataaaattgtccctaatatgaacatgtgctctatgtaccgaaacatgattcaagaagattcagaaatagttgcgctactgaatcatgataaaaaaatcagaattttttagaaaggttacgtgtgtatatatattgggtttaatatatatagtataactagtcagtcatttggattgatactaatttttacccaaatcaacagagttgatactactcttccctattatagtaaaaacttactcaaaggtttaacactaccaattagggtttcgaaccaaacatatccttactactaaaagtattgagtaattgatttattttgtaaaacgtgcgcgacccatgtttacaaaagaggtgaatatggtcaatggataacccacataacacacatttgatatgattttgtaatgtcaattcaagatgaactactaattaagttattatacccaccttgcaatttattatattattagttaatttagtagaaaggtactaagaacctgtttagtttgctactactactttcaaatctatcagaatttagtggtactaaacggtgatagaataacaaactaaacatatgtatgctaatgtcattctatcatcatttcgcatttttggaagtttgtccttacgaaaaggctagcaaaatttagtgaggcaatgaatgaaaagacatctagcgatactaaaattaaaatttgataaccctaaaatgtgtcaaactttggcatttcgtgaaaatccttcaatgcgaattttttgtgggaagtttgatttttttttcctttgattgatcatgaggtgggctggggctgagatgggccttaatttgcagtggatcagataggcacacggaccagaataatccaaatcggaggactcgtttctgaaagcattatccctcccacacaaggaggaaatatatatatacatccccgcaaaaaaaaaagaaatatatatatatatatatatatatatatatatatatatatatatatatatatatatatatacagaaagagaaaaaaaaaactttgatctggaaggaagggagagagaaaccgaaacgagtcaaacagaagaaacaaacagacacgtaaggaggagaaatttcccctcccttccctgctcttttcgtactacttgcaaggaggagaaagaagaacacgaggaggaaatccaagccaatcgccgcctccgcctccgattccttccgatgaagaagatcttcggcgccaagaagaaccaggagcccccgcccagcatccaggatgccaccgatcgggtttctttctgtctttcttgtttcgattccatcttcaattctattctattcaattcatccaccaagcaatcgaatgaatcgaatcaaacaaacccgcagatcagcaagaggggcgactccgtggacgacaagatcaagaagctggacgctgagctcgcccgctacaaggaccagatcaagaagaccaggccaggccccgcccaggaggccatcaaggcacgcgccatgagggtcctcaagcagcgcagaatgtatatctccccttttttttttatttcatcatcattacttatcatacttatatactcttagattagattagaagattggttactctacttttgcctaataataataatctctactgcaaccccaaccatccaaccctcacccaaatatcatacatagacaccaaagctgagctcttgcaacctgcccttgtgttgcctatcaaattgttgcactgccttcttccttgtggacaacaacaacacatgaatgaaaaattaaagaactcgccattgatgacattataaaccgttgcatcttgtaccaagtcccggttacgccaatttttacaattcatcgtcttacaagtcatttgagataaaaagaggcataattttgactctgtaaattgtttgtgtcctttcataagcacagagtcttttcctttctaagtgtacttcatcttctttttttggttaagtaccgatgtggttcttcatatatattttgaaagattttcctaagggtagcagttatgttataagaaaaaaagagacttctattttattacttagttaaggaacccaatcatcatttaccattcactctgtatatcttgttgagctcttttgcttctccttcgaattacttactctattacggtactgtgctcatctgtatactgtcttatatatgctttcctgacaggtacgaagggcagcgtgacatgctgtacaaccaaacatataaccttgaccaagttgcttttgcatcagagggacttaaagatgctcagcaaacggtatatagctatagtatactcaagaagttttatttccatgatgttttacatcctgattcccaaacttatgatacaagtgttttcatttgggcagatgactgcaatgaaggcagccaataaagagctgaaaggaatgatgaaaactgtcaagcttgaagatatagatgtacgcagcatctttttgtgtaacatattcgtcatgttttcaagattttctggcttgcaatggattttcgttgtttccctgttttcttctgtttccaattgcatctgaatctagacccatgcttttcttatctgcagagcttgcaagacgagatgatggatcttatggatgtgagcaatgaaatacaggaaactctcggaagaagctacaatgtccctgatgacattgacgaggaagaacttatggggggtatggatcttatttttcagttttcttagattatactggcaccacaaaaatgtttgccttgaagttatgcagtcaacttgttttttctccccacaattctgtccatagtgtagtcagggtttgccatagctgcttactgccgtctaattgaaaataatttccagtttctgatggtgatctggtggattttcttttcaacctaaatttgtatgcgtgttgaggcagaaaacagtctagatgctcatgaattgttatttttttctgaatccatctctttggtactttgctattggtccttcaccagttctgtgttttgcatgtgttgacttaccgaaagcaaagaaacaatgcttgtctgcttgatgtcctgattctttatgtggaaaatgcagagcttgatgctttggaagccgacatggactttgaatcaaattcagtcccctcgtaccttcaaccagataaggaatcagatctagattctgagcttaacttgcctgctgcaccaacgggtcacacacccgccccaccaaaccggcagcaggtacatggactgtgacaatgtttactttcaataagactgcttagaagttcactctaaataattttctttatcttgatgtgaactatttgataggatgcagatttgaagatctttgtacttgtatttattagatttgaattcatttactcactgcagaatttggtacttcatccgtttcataatgtaagactttctagcattatccacattcatatagatgcagcatgaatctatatatataataatgtttagattcattagcatctatatgaatgtaggcaatgttagaaagtcttacattgtgaaacggagggagtagctgataggatagtacaccgtgtaaccgaagtctgtaggggtatagattatattctacagttggtcgacctgccctttatagaccagatattcacaacgtgacggtgatggggggcacataaaaggataatatgaaaaccttttcatgccaaataggtcctttggcttcatttataatgaattcactcagagctttggaaacaaataccccatttaggcatagttaatggattctcttgtgaacaataataataatttgaaagttgcttttatttgttggtgcaggaggacgaattgggattgccgacagtgccacaagcatcgatccgtagttgattggattcgttttgtaaaaacataatgtcgtatgcaataacaaattcagtgtatctttgctcatatactactgcaatttgttaagattggaaatagctttctcattgttttgtttagggtctatatgtaagagcatttgttactttttgaagtacagtgtaaatttaattggctgctggggcatacatatataagtccttattctgtgttggtgatgagctgcccttgcatctcggaacaatggttttgcctgttgcagacctctttctgtccattcacttgtcggcatatgtcatcagactaatctgtttgctggcttgcagttcatgaaggattgctgatatcctgttcagtttggttgctttacctgattcagatatcttgtgtattattactactactccctccgttttataatgtaagtcattttagcatttctcacattcatattgatgttaatgaatctagacagatatatagatatatgtctagattcattaacatcaatatgaatgtggtaaatgctagaatgatttacattgtgaaacggagttcacagagggagtagttacttttctcaaggaagtccagtagactagagagatttgatactagtctgcactgctccagaatttgagcatatatgtataagcgatctatggagtgttgttgggctgatgtatactgaagattgtggcaagaaaagtaaaagcttgattagtgtgactgagtgcattgttattaatgcgtcgagtgtctacaccatttgtctcaaaataagttcacttttaaacatgaatttgaatatatctaaattcatatatatattatacaagtgtttttttataggatgaaaggtgtatgcattactggcgaccggattaacttgcaaatgctttgccttaatttgagctgaatattggctccagctgatgaactcattgtgaatgctatccctactatagtaccaaccctagcagaaaaggattaaacaacattgaattctcagcccaaaaggtgcagcagagcatgcatggcaacatagcactgtagtcctatctacagcggccgtcatacatgtacagatgtactgtacataacatagcttgcagaaaggaagttgcataggagtatgtagttaacctggtcaaggctcaaaactcaaaagacaagcatccgatctgagaattctgaaaggtgctgggtcagcagcagctttgggaaagcaaaatttttttttgatgaatctttccaagtccaatgttcactggctacaagcccagatatggcccttgcttctcctaccattttcatttttcatgtgtccaaataggagtacaagcagcaggtcaggtcagatcaggttgcctaataaaagattccacttttctgtgcatgcacacacacatttgcttttgcatttgcaagctttgaatggatcccagagcagagataaagagagatggtacagtgtacaagagaggactggaggcaggaggccaagtcatatcgatcaggctggcagcatcaagtacacatttgcaaggcatgcatattgcacacacacacatgcacatttctggagtattaaacacatgaaaagggagtagagtatctacagatgcaacacacagaagagggggaggaacagcacagcagcagatgaatgaatgaagcgaaacgcaggaggagcaacagtacatgtcctcgtcttggtactgtctgcatgcagtcttggtgacggtgaaggcagagatatcgatagtgtggattttggagcccaggaggagatggtacagctgagccagcaaccaaaggatccttgcgagatcttcaggaggttcaactctgtcggcttgccccactcttcttcttcagcttgctcacttcacttcacttgttgattcggcatctcctcctctatgtgatgctgcttcgtggccattcctagtttgtacaaatgttactagatagctgcattagtctggtaaatgcaacagttaacacatcatcagtcaccatttgcaaagaacataagctttgcttcttgctaatcaatcatgcttgtatctcaattaccagaatatgcatgggttctactactaatgaaagaagcagtggctgctcatctcgacctggtgaagagagccctgctgctggccttgctctccaacttgcatcaccaccatgttaatgtggctgctgccatcctgcaatgcaaaggtgaagcacagacagcgcatgcatgatcagtgtcacattgccttccttatctgctactcctactactcttgatgagtgcttggtggaataatttgtgttcaacacaggagaagcgacatcacatctgatgcagtcatgcagattgggttcagattcagagagactatggttatcatcttgacctgagcaaagcctgtgggtcctcctcctagtccttggagtgaaatgcctgtactccccatttggcccatgcactgcaccatctcatgtggcatcttgcaagcttaatcaaacaaggaaggtaatactaagtactaagagagtcagagatattgatcgcatgcatggcagaagcaaaactggaatcacagaattcttcagagatgcttgcttgcgtttggattgatgctgtcattgttccctattttactttacctgtcgaagaacatctgggtgcatatcaatgcccggtccaaactcatacatcaaagggctaagggaggcaagcttcatggacagaaactgaatgagcacaaaagaatgaatcagttcttcatatacagagcagaagagccatcgatgatactacgtgctcaattacgctatttcaattcttatctgagtgacatatagcagcacctcaacttggttctgcagagattgcacatagctgatgatctcatctagcatgagggctttccctgtgaccttgtcacaaccaggaaccaggctttgcagcatcttcatcctctcactgatcttctcccttctcacctataagtaacaaatcaacagatgttactactcctgtagttaagtgaagggcactaacaaacagctgttactactaattaagataacaacgattcagataagagaacaaaagactggtgagtgagtgaccctctcagcaaggctgtggctgtctgttgcttggcctctccttgccctcacatgaatgtacccagctggtggctccccacctgctgcctccttggccttcttcttcacatcatcatcatgttgatgtagtaccacccttcttgcctttttctcctcaagtcccttcaagcccacattgctcctcttgtgctttctactcttgccccaacttgcatcctaaatggcaagaccacataaggtagatcattacatgaacacaacataaaatgggcccatcatacatatttggacacttaccaaaggggttaacaacttaaacatcaatgataattctacttgcatcagaaa

SEQ ID NO: 79207 - DNA, 1278 bp, Oryza sativa
gcatctttaagtccctctgatgcaaaagcaacttggtcaaggttatatgtttggttgtacagcatgtcacgctgcccttcgtacctgtcaggaaagcatatataagacagtatacagatgagcacagtaccgtaatagagtaagtaattcgaaggagaagcaaaagagctcaacaagatatacagagtgaatggtaaatgatgattgggttccttaactaagtaataaaatagaagtctctttttttcttataacataactgctacccttaggaaaatctttcaaaatatatatgaagaaccacatcggtacttaaccaaaaaaagaagatgaagtacacttagaaaggaaaagactctgtgcttatgaaaggacacaaacaatttacagagtcaaaattatgcctctttttatctcaaatgacttgtaagacgatgaattgtaaaaattggcgtaaccgggacttggtacaagatgcaacggtttataatgtcatcaatggcgagttctttaatttttcattcatgtgttgttgttgtccacaaggaagaaggcagtgcaacaatttgataggcaacacaagggcaggttgcaagagctcagctttggtgtctatgtatgatatttgggtgagggttggatggttggggttgcagtagagattattattattaggcaaaagtagagtaaccaatcttctaatctaatctaagagtatataagtatgataagtaatgatgatgaaataaaaaaaaaaggggagatatacattctgcgctgcttgaggaccctcatggcgcgtgccttgatggcctcctgggcggggcctggcctggtcttcttgatctggtccttgtagcgggcgagctcagcgtccagcttcttgatcttgtcgtccacggagtcgcccctcttgctgatctgcgggtttgtttgattcgattcattcgattgcttggtggatgaattgaatagaatagaattgaagatggaatcgaaacaagaaagacagaaagaaacccgatcggtggcatcctggatgctgggcgggggctcctggttcttcttggcgccgaagatcttcttcatcggaaggaatcggaggcggaggcggcgattggcttggatttcctcctcgtgttcttctttctcctccttgcaagtagtacgaaaagagcagggaagggaggggaaatttctcctccttacgtgtctgtttgtttcttctgtttgactcgtttcggtttctctctcccttccttccagatcaaagttttt

SEQ ID NO: 79208 - DNA, 755 bp, Oryza sativa
ctttgattgatcatgaggtgggctggggctgagatgggccttaatttgcagtggatcagataggcacacggaccagaataatccaaatcggaggactcgtttctgaaagcattatccctcccacacaaggaggaaatatatatatacatccccgcaaaaaaaaaagaaatatatatatatatatatatatatatatatatatatatatatatatatatatatatatatacagaaagagaaaaaaaaaacttttatctggaaggaagggagagagaaaccgaaacgagtcaaacagaagaaacaaacagacacgtaaggaggagaaatttcccctcccttccctgctcttttcgtactacttgcaaggaggagaaagaagaacacgaggaggaaatccaagccaatcgccgcctccgcctccgattccttccgatgaagaagatcttcggcgccaagaagaaccaggagcccccgcccagcatccaggatgccaccgatcgggtttctttctgtctttcttgtttcgattccatcttcaattctattctattcaattcatccaccaagcaatcgaatgaatcgaatcaaacaaacccgcagatcagcaagaggggcgactccgtggacgacaagatcaagaagctggacgctgagctcgcccgctacaaggaccagatcaagaagaccaggccaggccccgcccaggaggccatcaaggcacgcgccatgagggtcctcaagcagcgcagaatgta

SEQ ID NO: 79209 - DNA, 670 bp, Oryza sativa
tgagtacggtggttgtacttagtcttgctttatttttcctaatcccccagaagcaaaagttggttcagatagtgagttctatgaagattaggcttgtgccagccgacaagagtttgcctgtggagttgtggaggaagcttcgctttgctgagaagataaagtctagttctttagtttttccgttgcgtttgagttttattttgttatttttataagtcgtggaactgtatcaaattgtcatctatgtactctggttgatgcctggacagaggttaaatgcacaggtagccggtgattcgggttgtcgaatccccgggcgcgacaagttggtatcagagccgaccttgaccgtaggacaagccaaacggaaaacccatagagccctctgaaattcttttcttcctcccgaaaatctcttctttccccattttcaagtggtctagtgagtccagataaatgagtttgctctcaagtttctgagtttcgtcaaaaaaaatatttttttctttgtgcctctttgactttcaaaaaaaaagaaaaattttgttttcggcattgaaaaaaaagagttttggtaaaaaaaaggtgttttcgggatttcaaaaagaaaaggagtttcggtatcataaaaaaagaggggttttcggtattaaaaaattttggccaaaaa

SEQ ID NO: 79210 - DNA, 20270 bp, Oryza sativa
ttctcccttcttccttctcttttctcttttatgaaaagacgatgacatggacgatgacgtgtataaggcattttcatcttttcgacaaggaagaaagagaaaaaaaagaaggaagaagggagaaaaaaataaaaatccatgtcatcgtccacgtggcgtgccacgtaggcaagaccacggtcaaacgcggctttggaccggaatgatacaataaaccaagtttagggatctcgatgtgcgcttggcaagttcgtggacctaagtgaaacctgctgacaagtttaaggaccgctagtgcattttactcttttaaattcttggttgaactaaaaatgtgtgatatttttattatattgtatatacatgatagttatttataaattatatctctatatggactcaagaatcatcttttaatattccttactttttaaatttcgaatttcctttatcataaattatattcctatatggattctagactacccttccaatattcatttttcttaactctgaattttagttatttataaattatatctatatatggactctaaactcttctttcaatattttttattttttaatttttaatttcagttattggtaaattgtattcctgtattgactctagacttcttttttccaatatttcttttttttagtttcagtgtatggacgctagacatttttttcccaatattctttatttgttaatttcgaatttcagttatttataaattgtatttctatacggacgctagactcttctcccaatcttttttatttttaattttgattttttgtaattataaattgtatttctatatgaactccaaactctacttttagttttcttattttttagttctaactttcagttagttctaaattcctgtgtgtggatcgtagactcatcttccaatatttctacttttctaattcccaatctgttatttctaattatatttctatatgaactctaaatttatttttcaatattgtgtttttttattttgaatttaagttatttataaattatattcttatatagactctagactctttttttctcatttttttatttcaaattttagttatttataaatcgtattgatatatggactctaggctcttctcctaatcttgattttttaaaattttgaatattagttaattgtaaattgtatttctatatagactctaacttgtacttttaattttcctttttttaattccgaattttaattaattctaaattgtatacttctatggattccagtctactctgtcaatattctttatttttaatttcgaatttcatctatttttaaattatattcctatatgaactctactttttctttttttctgattaatgtaggaatttctaggttgtgagcgcaaacgtggtggcttttttttctattactttaataagataatagattattaatgcagttctaaaaaaaagaaaaaaagcaaccacctaaaatcagtgttctcacatgaaaatcaaccagaaaaccctttagtttcaatctagttgaaaagaattgtttagtccattgaaaatgattcgatttactccctaataggatttcttttccccgccctatagtagtcaattttattttgatccacctgatgttcctcttaatttacactaggtaacttatcttttttttattgttccgttagcaactctccattaaaagtgttataggatgaataatacatttaacgacgtgtgatagacaaaccctaacggtgatggtatttctggaacaaaatcgcttgtaaaataatattccatgaaactcgcgcttatcgataacatttttttgaaattggatgcttgtcaatggtatttcttggattttctctaaaattaattcccaatctttaatcccatatccaatatatttacatacactcttgtaactgaacaaataacccacattggaacatgcattacaagacaatatatatggatgtgtatacaattattcaacaccttgctaagctactcagtagggtaggaaggctgcatggcaaggccacacatacccctcttgtcatcaatgtccttctccatcctcaggtacccggcctcgccccacgtcgtgccccacgagttcttcaccagccaatacttggtgccatcgctcgccgcgccatagccgatcacggtgacgccgtggtctaggctggtgccgcattcgccggccatcacgccgccgccgtagaactggaacttggacgcgtcgacggccaccgacaccggctggccggcgacggccttcatgaggctgggctcgtcgttggccggcacgtcctcgtagcccctgatggacgcggcgacgtccgccgccgccgtggtcttgcaccggccgtcctccgccgtgtacgggtagtttgcctcggctgtgaggccgccgttgctgaggatgaactggaacgcgccgtcaatctcgccgccctcgcagccctggtcgttgccgtcgacgtcgcagtcgaccagctcctgctccgacagcgagatgagcttgccggtgctcagcttgacgaagccctccatcgctgccacggccgagaacgcccagcagcaacctgcacttgtgattaattatggtagataacattatcttcttttaataatcaaagtgagcaacttccggattctgcatcaatcaattaagagtgaattgcaccagcaacgacttcagctctaccaccatgcacttcatctcagcttgagcacctgtaccggtgctgaacctgtgatgatttgctactcttccctccagattggatagggtgactggagtttgggaaactgtcatacttctacctcctcctgatcggtgatagaataacgagaacaggttgggagagaggataatagggctgcctgacttggagaagatgaggtgtggtgtaaagtgaaacaaatggtaaggttatgtggtgcaaagcgaaaatcatggctaagaccctgtccaagctgcaacaaaggtaaaaatacatgacccaaactgcaatttactcatcaattaacgatgaaaaacagccgacgtgccatcatattgttcacaaattaagatgaaagatggattattttttcatgctttgaccttggttatttgtgtactaaaatgaggacaaccaaggaggttatttgtgtacttaaaatgaggggaaatataatgataaccaaggagaaacttgattatcaaataattagaaggaattgtgaccgttttaagaattaaacacgggatgttaatgttcaaaccacataccttaccactacactaccaagtgcatctcggttattttctacttaccacattggccttggtccttgatgcgagtgacggcacctttggtcctccagtccacggacgcaggcaaagcatcggcactaacattctcatacttgaacccagttgataccctaacaccattattaggagtactgaaccccttgctgttggtcatggtcgccttgaactcctcgctggtgagatcggcgaactggttgacgccgagccagtacctgttcttgccaccggcgttgaacgactcgatgaacgcgacgttggccttgaacacctcgagccgccgcgccttctccgcggcgtccttgtacacacggccgtgctgcgccatccacctctcgtgcctcgccgccatggctgcgtcgccgccgagctcacgcgccgccgcgacaatggcgccgccgctgctgctgtagaggcagacgatgcagcagaggatggcaaggagcaatggcttggagatggcgcccatggtgagatcaaccagatcaggatttgtgagttgcttgctgcttaattacagctactactatgtgttttgtactgtgtttggtttgtccaaatggattggatggtatgtggtttatatagtgctgctcctgcaggtgttgagagggacactccagcgtagccgtgaagctaattgatcacaggattattactagtaattaaaaacctgcaattagaacgtacgctagcttctccagtgacttatgaattaaataagaggtttaaaaaaagccggcaaaagagaaaggaattaataatgatcagccgggcgggcagtgcaggtaggctgctgatgaggaattaaaaaacgaaacagacaacatacgacgttatgggttctgcacattagaaatttagaaaatgaacatcataggatactcggattacatgtttaccatccccaaaaagggttgtttgaacatgttacatgtgctcgtactattgagataaaaaaaaatcactgctcaacaacacctctgctttattttccaagctagaaaatgatagtcccaattacaatcagcaagcctaactcgagaattagatgcgtagagaaaggcatcctctaatacagattggaagggcaaacataactaacaacattaatacagattggaagtactacaaaggcaacacagcgaagataagaatcaaacgaataagctattatttactaagccctaaaatcgccggagaaaaataaaagagaccatataatctaacccagccttctgagtggaaagcaacatatttgtttgtctttggatgcttctttgtttgttgggtgtgcatgactgttgttgacatcttgtgaactctgcatttaaatttttgttgtcagaggttgagatctcagaactttgacacaaatgtatagagccaattgcaagcggagaaaatgcatatacagattggtgattctccttttacatctgatttctatagacaattcacaactgataaatacacaaataaaacatcaaggtgaggtgcagtcatgaattagtcatacaaaaggatagtgtttgcaagaaatgggaaactccaaaacagagaagtttttctttgttatttatcatccatttccattacaatatagaccaaatgctgttacaatgtaaacatgagctctaattccttcttagcataaatgcggatgaaagactaaataattggatttcaaaatcagtaattccatgtccgaagttacaggtcaaacatgaagtgagattgggtaactttcaattacattctctatttctgctgcttagtttgccccttctgaataatatgcacatattattcttttttgaacaattatgatttgcaatgatagatgagtcgttcagcaaggctcctttgctcaatgatgcaaagttctgaacttgttccctattgacttcaccaatagttattaaaagaaacatatgaaattggcacaccacttatggtgttctctcatggatggatcaaattgatcttgacatctccaaaatgttcatcagaagtgtgatgcaggaatacacaggaagaaatgtgcagcgtgggtataccataatctccagtaactgctaccatcattatgaaggcataacgatgattatctatatagtgatgttgatctatctctggttctttctatgttagggacggtagaggtgccctttacctatcatatacaaattaatttacacatcatttagatgaataccaaactaacatgaacttatgttgccaaaaaaatcttacatgacaaagtggaggaaacatcacacgattaatgaatataagaggaactatgatattcaccagatatgtgaagtaaaccactatgttacttgccagatgcacatatttgatattggaaagttttgacttgaaaatgtttgtgctcgttactatgcattgttcctcagaaatgttcagacacaagcctccatatttcttaaggaataataacatatcggtttatggttcatttggaagtatgtgattcaattagcataaaatgatttcgatgccacactctcaattagcataacaaattggaatagacttgtacctggtgaattgaatcctttgcttgcttatttctacgataaaaatttggtagtggccgagccttgaagctttcattttgggtttttccctgcacaagagtagcatgtaaggttatacctgatctataataccttttcaatcattatccgttatgatttattatggtctttgagaaggcatcacaatttttacattaatttatggcacctcaacatttggatggtatgtgaaatataacaacaaattaacattgtaaagtatggtatctcgtggtacctcttcaaggatcataaaaatctcgtcttgaaaacatgtagtttataaaagtattatttactagacaacgatggaacttctatttggtatgtccttgatattattttgatgtgattagctggtattttagtatctggcaattcctaccaaaatattaacagcatggaactccctaaaacatatgaaaacagagcagtgcggcagctatatttatcatattgcattcactcagtcaggtactttagtaatttaccttctctttacgtggtgtattggctttctgatgtgccgattgtgaggtaaaaccaaataacttttctttcaccctcgttacatgtgaggacctggtgatgatagaagatgatgcaatcaagtcattcagggaaaccaaaaactccagtatctctttcaagtaaaaaaaagatgaattggcgtactgtatacattgtaatgtcaaaaatgttcatttacatcacacaaggacgtaaattctttcagtataaaagcctaatgttcagatcaatccctagacaactttggtatattcaggctctcacaactctgctgtcgaacgtacctttgttcttccagttgggatgttctcgaggtaatttctggcacatctttgggaaatgcctgaaatgccgtcaaacaaaattagtgcaacgataaaaattaattgaaaacagttatgttcattccatgaattaggcagcttcaaacctctattggtggcttgacttggctcagtgcagaatcagtgtgtttcacaggcccagttgcagattccagctgactaatccttgcagcaattgtggtgccaagattttttgagctcgaggcagcattgcctgtttcgcacctaccaaagttctttgacttctgaaacgcttccaagatggaccgattttgagggaccgaacttgttgcctgctggtcgctttcgttgttaggaggtgagctgttctcctttgcagaatgcaggcgtgaccgtcttttcgccgatgaggtaggccctttgctaccagaggaaggagagctgaatttggccggtttctgaagcagagatggaagccgtcttctctttacagactcggcacttccctgattaacaatggaactctcctgaaaagaacacaacattacagtacagggtggtatgtaaaatgcccaaacatttgattccgctgcacattacgaacaaaatccccacataatttgatgaacagaaatgtcaccttcaatggttgcttgtcgtctgcatcagcaggcacggaattgtcagcacaaggatcgggagtagcagcctcctgcttctccatcgcttgcaacacctctctcgattcaccagcatggacaccatcctgcttgtgatgcgcggctccatccgcatccactccgcaagaggagccaaccccaccatcggcgatgacatccagctcctccatctcttccaccggcccagcagcgacaacgcccgaaccaacgacgcagctcgtcgtctcctccgcggcgggctcgtccgtcatacacgaagaggaggaggagcgcgccgaggagacagcggcggcggcgtcctcgtcagggtcgacgtcactgccggtggcgtcggcgtcggcgtcggtcttgcgcttccgggcgtagtgcgcctcgaagaaggccttcttctgggcgacggagcccgggcgcgactggtgcgccgcctcctcgaggtagcggttgtgggcgaacgccgaccacttcccccactccagcggctcggcgaggaaccgcccgaacgacaccgactcccccagcgccgacatcatctccgccttccagctctaaccccaccattagaaacccaattaatctcaccaaatcgatcgattcgatctctccgacaattcgacgaacaggaggaaggcggggggcggcggcggcgctcacctggtggtcgggggcgaggatctccggctccggcgacagcgcgggctccggcggcggcggcggcggcgagaagtccaggtcggctcccatggcggcgaggctggattggatctgggcttctggggtggtgaaaaaagcttcgctggattggattgccttttcgaaatgtggaaggaggaggggagtatgattgctttggggaagggggggtggtggtcacagcctcacaggcgcagagcgtggtggtgggatttgaattggggggaggaggagaggggtcaggtgtacgttgggaggagctggggttgggtctcgggggcctacgggtgaccgttacacagtgtttgaccctgagacacactgactgcgtagggtcagagggagaaatgtttgtagcggctatagtagattacctttttatttttctttttcggcacatatcataagaccaagtttaactccatcctgtttttttaaaaagataatttgctgtgacaattttttttggcaaaagatttggcattcaagttctgctagctggcgtttaggtggtgtttggatccagggacttaactttagtccctgtctttagacactaatttagagtattaaatatagactacttacaaaactaattacataaatgaaagctaattcgcgagacaaattttttaagcctaattaatccataattagagaatgtttactgtagcatcacataggctaatcatgtattaattaggctcaatagattcgtctcgcgaattagtccaagattatgtatgggttttattaatagtctacgtttaatatttataattagtatccaaacatccgatgtgatagggaaaattttagtcccatctaaacagagccttagatgtagggtaaagttttgccactttactagtaaagaaagagagaacgactcccaacgttttttttttcaaaatttgctaccctaaactcccaaatgacaaatgacaaattgcgctactagtgcttatccatgtagcaaaaagtgcttcaaaacatcaaaacttttgtcattttagaggaactaaacagggctatactccctctgtttttaggttataagacgttttgactttggtccaagttaaattgcttcaagttttaccaagtttgtagaaaaaaataataataatttcaactcaacacaaatttattatgaaaatatattcaattattgatttaatgaaactaatttggtatttataaatattactatatttgtgcataaacttagtcaaatttaaagtattttgactttcaccaaaatcaaaacgttttataatctaaaacggatggagtagtagattttatctttggttttaattagtacgtttttaaacgattaaacattgtaattgttaaaggaaatttaatatatcaaataaatttatttttcaagttgtaactcaattaattattcgctaatgattttcttgttttacgtgcactaacttctttctaatcttaatttgtattaatctatcttaattactacctccatccatgttattcaagctaccttttctaaaatgaaactattttatcacctgtctccttgtctcaaccaatcacaatcattctccttcactaactttctcttctcatccaatcatacactttctccaattatttccacgtactttcttagtacctgtgtcaacctttaaaatacgtacattttttgatggagctagtaattaagatggattaatataaattaagataaagatgaagtcaacacacgtaaaatgagaaaaccattaacgtatgattaattgagctttaattattacaaacttgaaaaatagatgtatttgatattttaaatcaacttctgcattgaatttattttaacactgtccaaagtacattactacactcaactttggtaccctctttaaatactacactacagtactacactgcaatccggagcggctacggctgcgttcgcttctacgactcggatgaagataaagggtacgtttgagaacttctctcctgcatacgcaaaacggagtggctattggcggcagttatatgccaattttatgccgccaatacctgcataaaacataggaaataaaacatctaacatagtggtagtgcttaattctaacatattccacgagtgtgtatatttggatgcaggtaataaaccaccaaaattggaaggaaattcagactatttcatgcaagtgttgggctccaaaagtctatttcaacattggaaaatgggcccaactctcgaagaaatggataaggcaagttgcaaaggagatacaaaccaatttatgggcctgttgggctagaccagggttcggctgaaccaggcctggttcagctgaaccacaatctcagccgttcaggctaaggttcggcgtggtcgctccagatgcactcctgatgacggttacgggcatttcaaacatttcgcgttctgtaaccatcattacctgtctatataaggacatcacttcactcaatttcacacacacttcaagcttgagctgaattataagagactttattgtattttattgtatactagaattagagagagagtagagtagaggaagtcggaggaattataagaggaagtcggaaattctcttcttatttcttttactctgttaattactctgctttaatagaaatactattctgagtaattatgatttattcagtgagatttatctcttggttagttcctaattagcgtgcgggatcattgaccactatgatccagtaaagtatagtggttactttagtgtttagctaacgctgaagtagttattaattgtgtagacatggtgttagagagttaatttctgatggtggtctcgtatcccacaataggtctgagatgggtgtagaggtggtgacagccctcaattacactgaatccctccctgtccaggtatgcactagagcgacatctgggagcagctggctggccagtggctgaagtaccgcgttacgatcaaattgagctatctttgcctatctttgctttgtatcattggacgaatctggtgaagagctgacacacacattccctgtagaaatcgataccttggaatactctcaggtgaactgctacatcggtattttccgtgcgcttgcgtattctatatgtgatgttaagaaataccaaccgtggctcattagcacatgatgagttaagtattagtaaaaaaacttgaaaatagattaatatgattttttaaagtaactatagaatttttttaaaaaacaaagttcgataaatgtgcccgtgaaatacgagagagtagaagtttgtgtaaatgttttatattgaaaaagtttttcaaaaagtcaaataaatatatttttgagctggtaattattaatactcaattaatcttatgcctcgctctcttcagtctattggtacttagattattgcatatatgcttttcaagtcttttttttacataaagctaaaaacagtactttttaagtttataatagttaatactaattaatcatgcgttaattgactttcttatcttgtaagctaaccggctaattgctccaacctcacgaaatccgaatagggccttagctaatttgtgaaaagtttacttttacgtatgagcaaacttcacatacatggtaaagaaggaagggatcttgttaaagtttggcatgaaccgaacttaaaacaacttcttcatttaagcaaatggcccaatagaataatgctaagatataaaaagttcccaatagaaaatttaaaactactgttccaaaatactccaaacttctagaattttgtttctagcacaattcatactactacttgttacaccaatcaccccccatttgaatttcttcctatcttatcccacccatctttccaactccacttatccttatttattgagaggtgctaaagtcttttcttctcaaccttagtctctaataaggagaaaaatttttagaacggatgtagtaaatgctaccctcacatccggagacaacttcaataaggagaaaaattaactaaagtgctcctcgttatagaaaagtagtatgggtggtgatgtacctaaaggtaatgaaatgatagaacttcttgatttatggactgaggttacataagggtatagaaatcaacttattttgaaatttgaactttagaaattaacttgttttgatacgaaaagactaacttcttaaatttgttaatgctttgatgtccgaacgttggatatattccctccatttgaaaaatataagacatcattgtttttcgcatagtcaatattaaaaaaatgtctaataattaaactaaaaacaaaatgcttagtgtcatgcaagtagtatacctagatttgtatttaatactattttcatgcaatattaatattgtagttgttgatacattataaaagaaattaatgatcaaaggccatataaaaaattaatactgcttatattttcaaactgaggagttgctaagtacttagcaaagaaaataaaatactactctcctctcataatataagaattttttagagttaaatggttattaagaaagtaggtaaaattaaatggtggaaggttgtgattggttgagaagggaagatagatggagaaattaaatggtagagacttatgattggttgataagagagtgttggtggaaaaattgttatgttatgggataaattcaaaaggctaaaactcttgttagacttactattacaagtgtagcggtttactagtattccacgtgcaatcgcacccactagttccaatccgattcatcccacgctccccaccgactcaatgcaatccgtaaatcatctacttgttggttgattttgtcgacttgtgtccataagggttagaagaggatctaaaccaccagtttccttatcctaacaagaaacaaactaacagataaattcgttttttgtgtggtcggtacaaaaaacagaatcctaaactaattgagataacccctgagccccactagtgtcgcatatataaagaaagagaaggaaggaggcagacgaccgaactctctctctctctaatctcaaaccctaaattaatcgcccgatcgatctaggcactggaaggggttcgtgaggcatctttagaagaagaagaaagaagaacggcaatggcttcaaacacaggtcagtagatcaattaatttccgcataagcaagaggtgattgttttgtagactaaagcctaagatcctgtaattagaactccaacattgtggtatcagagctgatctttagtccactcaatccctcataatcacatcatccctgtgattagaagccatccttaaaaaggttcaagattgattcggcatgaacaattttgaattagattagattaatttctttaagtcttggttgcatattaagccatgttatactgttggtctcggccaacagtagaagaagcaaagttattgaagaatttaatttcgttgcttagcagtagaatttaagagaagaatgaggattgggataaacgagattgaaattcccaaactctcacactaagaattcccagaccgaagctatggcttcggccagatattagaggggaggattggtcaagtcagatcgaaaatcaccaattaacttttttttaatctactcggcctattgcaaggtctattaatctactgttcttacatgattaagtttttcatcatgaatgagcttcggctagcagtggattaagaagaaaattggggaagacgggataaactagattgaaattcccaaacttttccccaactatttagctcagaaaagaggagtttgggataaacaagattgaaattcccaaaatccacaccttagaaaccctaattcgaagaactctaatttcggttctaagaaccctaagaccaaagcccgaattaaatccaatatagagtcaatttagggtttgatttcgaatgacttaccggaattgaaccccaccggagcctcccgggaagcggcaccgccgcaccttagctcctcgcggtcgtgtcgggttccccgtgcgcagccgtcttggagcttgtctctccacaccatccctcgccagggacgggaagcgtcagcttggcggatgctttcgagctccgccccccccccccgacgagctccggccgcatcgacgctcgccgtcgcttgcgcgccgcctcgccggaccgtcgatgccgtggcacacggcttggcgccaccctacgggtgcgccccccagccggccgagatgaagccgctgcagcgctcgccgccgcacgcgtgcgccgcctcgccggaccgctgctcgctcgctcgccagggtgagagagccgtcgaagagagggaagagaaggggagaagaatgagctagggttagggctcacacccatttccccctggcatgcgatttgttcggcgcgggcaaaatctaagccgtccgtttgatcggacggccgtcctcgcttccgcgtcgggccgtcgccgtaatgggccacgccgatctcggccgcatccgcctgagagtgggccgatcgtgcacataaataggccggtccattttgggctggccttttcaataagagtgggccttttattttaatttattattaagcccgtgaatttaattttctcaaaatgtatttagcctgtttttatgggccggcttaggaagtgatgggccgcattattattttaagcccgccatttatgtcttatttatttccagaaatttatttatgagttttcttagccatttaaattgctggaaaattatggtcaattatttgatcacttagaaaattatttctagttaaatggaaccaacgggatgtttagctagaaagaaattaatggtatgatataatatttgaccaacgttaatataatttcatgtcaatatttattaagaatattatttccttaagccacttaatttatttttagttgaatggaaatttaactagaaagtatttatgatttcatgtcaacatcattatgatggtcatttccttagtatattaattatttatagttgaatggaaccaacgaaaatatcgtctagaaagcattaagatgtgaagttatatttaacccacgttattataattgcatgtcaattataatttttattccttagttattttctaccaaatggtgatataattaaggaattaattttaagattacataatcatttatgaccaatggtgctttgactatgaaattgtaagtttattttgcatatgattgattaagccatggtaaactaattatatgcaattagcaatgcttattatttaagattagttgcaatactgagtaaattatttctagattaatggaaccaacgggaagtttatctagaaagaaagatgatttaattaagattgttatttccttaattatttatgcccaacggtgatgtaattaaggaaacatctaagtattgtcaatcattattttcattttctttgtcattttggccttaacggtgatatgacttagaattttacttatgccattagtgcattatttcctttatcacttttaccttacagtgatgtgatcaaggatctctaattcgtcactaagcttaattcctttaccatttctgcccaacggtgatatggctaaggatcttaatttcatgtcatttactaatggcattatgccctatatgatatctacctacttttggtaatttgatttaggattttaatttccgtaattcattattctttgccatttcataatcttttctaccctatggtgtttgattatgaaaattaagattcatttgtatgtgattaattaagccaatggaaattaattgcatgcattactaatgtttaattaataattaatttttcagcattaggacagcttaaggctattcagcttcttgatggatcaaattacgttgaatggagaaataatgtgcttattaacttagccatgttggattatgacttagccataagagaggatcctcccgaggaacctcaaccagccgaagaactcaatataattggggaagaatatgataatctcatgtgggcctacaataagaagttagccaactgggagaagtccaacagaatgtgcttaatttatgtcaaggatgccatctctccagaagttattggaggaatcattgactctaatgacattaagacgtatctggcaaacattgaagaaagttttgaatttgcacctgaggctcatgccaatacgcttgtaaatgagatgatcactagtcattacgatggcgaaagtggtataaggaagcacatccttgaaatgactcatatggcaaatcaactcagatccatggatatgaaaatatctgatggatttttagtgcacatcatcatgagatctcttggtcctaactatgatccattaaaaaaatatataacactcagaaagaggagtggaccatacaagaattgatcttacactccgtggaagaggaagagcgccagaaagctgaaaagcagaagattaaagaccggctcaacctcactaatgcctttgataaaggcaaaaaggtctatcaaggggaatcctctaataagaatagcgagccagagggtgagcagaatcaagaagggatcaaggcctccacttcagctgttccttttaagtacaagtccctactgccacttctgtgcgtcagatggacattggcagagaaattgcacacgcttcacagcgtggttagtcaagaaaggtataaatgaaattaaataaatcccttatgatgaattttcccttaatacttagtgagtttaactcaatgccattgtgcatgtttctaactcattacaggaaactcgcaccatccaaacggtagcaaagaggggagtgaacactcagagtaactgatggagtgaagatgaaagtgaagggttgttggagacctcacacttagtttctccagcagttgcaataatgtctcatttgttcactctattaagagaaactctactagtttaattatttaaagtcatgtgagaaacgggtcatgtccgttatttttttccaaatagaacatgatatattaagtgtgataataaagtgattggtcttgtccttgtgcacgacagtcatatttgttcttttggatgatcatgtgactattataataattgcctgtaatgacaaaagatgagacgtcattgaaattgtgacattgtaattgatgtcacatttctagggggaggttagaacgtctcataagttggagatattctttcccttggattgattttagtgatgttatttaagctttaagggaagattcactaagttaagaatttagccaataaattacttttggcgatgtttacccataaggctatgtttactcataagcaacctctaatttcctttaagaaatttaagatttaagatactaatgctaaaatcaaatgaagttatgagatcggattatggtggtaaacactaaataaagcgtgttcacccgatgaagacattaaaaataagcgttcatccaaatggtttccgaaccatgtaagaataaattgagattgatgaacaaaataagacattgaagtgttcatctaaatggttttcgaaccatgtaataaagaatttagtagaagtttctaaatgagtcaaaaataggctatttaagtgggttaataaaattaagcctgactctaatggaaatttcgaacaattcaagtgaggtggacagctgcatgaaaattaaaggtgggaatttcattcaccggtactctgtactaatgacattttattgtcaagcaatccatattgctgttagaaactaaggaaatttttccatgaattattttggtctaaaggagtactgggcttatatcagtaagtcatacattgacataaattaaagaaataatttgagagaattcagttaaagttagtaaagctgagattaaattctaaagttagactcagctgacagaagcttgagattagctcaaatctggatgcatacagatttgacatacattttgctgggaatcttggcagtattaattaaatccagactagttcactggtattaagaatgttttgtattatttgcaaggcaatatcaagtaacatgctcatatttctaaagtccaatgaccttagaagttcagagacatttggacactttattttgtgagatgtgtggatatttataaagattattaagttaactaagattaagctatgtccacacataggggagcaataaccatggaaaagctccaaaataatctcttactgcatagtcgatgatgtagttagattttaaagcatgttatgattaatcataagaatatttcctagaactaagagtggtaaatagtgctcataaaccactcaaaaggtgtaaaccacccaaaatatactgtgttataagttgtgcactaattaaacacagttttctattctagtagcaatgtgttgtgtgttttctgcctaacacattgatatggttgtgaaagacatgtcccaggatcgaattattaagctaagaatttgctaatggatccataatctaaaggctcataaaattaagattaattaagattatgttctggccagtacatatgtaaattagagccttactcagatcctggatgagggggactaaattttcaatcaacatccactaaattaagcttgagtttatttgagtactatagtgagctataggtcttgttgtttcagtgacgcataatgttgttgaagacacattgccttggggagctattttatttaatagactcgtaagtaagtctcaaaatctaggggagaatgttggttgattttgtcgacttgtgtcgataagggttaggagaggatctaaaccaccggtttccttatcctaacaagaaacaaactaagagataaattcgttttttgtgtgattggtacaaaaaaatagaatcctaaactaattgagatgaagaaagagaaggaaggaggcagacgaccgaactctctctctttgatctcaaaccctaaattaatcgcccgaccgatctaggcactggaaggggttcgtgaggcatctctagaagaataagaaagaagaacggcaatgacttcaaacacaggtcagtagatcaattaatttccgcataagcaagaggtgattgttttgtagagtaaagcctaagatcctgtaattagaactccaacattattatctatagaaccagctattctagaaatgaaccgcccactctcaccattattcatctctctccccgtgtttttttggatcttaccaaatcgagcggctccaagagttggccaaatctatgccatctgttatttcctatggttgagatcatgatgaaccctaagctcctctggagatactcaaagctgttattggcccaatctttcggtgagttgatgataactacgatttgggagaaacgttgacgacccaactacaaccgtactagatgttgttgtgttgcaccttagcgatcgatacatgtcacgccccgaactagtcccgaccggatctagcccgtgacgctccaaattaacctgttaatcgataccagtcccaggaaacagtgctggtatcacaaggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactagggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagc

SEQ ID NO: 79211 - DNA, 1408 bp, Oryza sativa
gttgccctagtttcccgttttgtttagtcgttgcttggtagatttttgtgttcaagtttgtttgcttgtggggtttagctcacggtcgataccatgtgccgatggtatgacggtctatttaaggatctttaagtgtgtttttaagtgtgttttaagcaagagcagaacaattacagttgattaataaaagcaagagtaaagaggttccttagtaactgtttttctccttccctatttctcctcccgtcttctacttcaaatggtgacaacgaggactacccgttctggaagcaatgtcaattaggaacaaccgtcaggaaatggttcaggagatttgccagagaatggacttgccatgcaatgaaaaagacattcggctcttccaagcatgtactgaaattcaagtcagaaatggaaaaaaaaaacattcttttggaaggacaactggctctatgggttttgctcaaaggacatagcaccaaacctcttcaagctggcaaagagaaagaaccgaaatgctggaactgagctcacaaatgatgaatggttacactctctaagacaaattacaagcttcgaagagatccaggagctcattcaactaggaggactcttgagccgggtcacgttgctaaatgaaatagaagacatagtcttatggaaaaggagcaatgtgaccacatattcggcaaagagtgcctatctctttcaattcatcggctctcagcaagacaaggtttttctgttgaattggaaggcgttggcacttccaaagcaaaaattcttaggatggctcattctgcaccaaaagattctaacagccgaaaacatgttgattcaacactgggagtgcaactggatttgccccttatgtagaggagtcttcaaggatactgatcacttatttcgacaatgtgatttctgtaaagaaacatggaatcgtgtctctgctgtacaaggtattcaaaataaccagactttctcctctctgaaagattgtatgacatacatcatgcagaacgaaagcaaaacggaagtgaggagaaaggcgggtgttcttgtcaaaacttggtggcatatttggctacaaaggaacgcaaagatctttagaggagaagaaccggatgtgcaaaggacttcacaccagatcatccaagatatccaagaaagtagctttcaatttcaaccgccaagagtgtatcccttctcttacaaaatcaagatgtatggtcctggaacgtttctaagttgttttttacattgattcgtgtaatcctaatcatgtaaaccgtactttttccctccctctaatatattcggcaatgctcttaccgctttccttttcaaaaaaaaaaagatttgccagagaatcctacgcttgccaggcaatagcaagacagactcaggg

SEQ ID NO: 79212 - DNA, 1843 bp, Oryza sativa
atgattaattactctactgttttataattctcaaatgtttgctaaatgctgcttttgcaaatgagccctatataatgccatccttttggtatccttgtgcacttgcatatttactgtgtggcttgttgagtatgtcatatgctcaccttgcaataatcaatcaaacctcagttgaagacaagttgcgaaggagaagacgtttggcttataccccagttgagctgcctgtgggagtggagccggagctttgctagattttattttccgctgcagttttcttcatggtgaggactaagtgcctcttaagtaagtatttatcgttttagttaatttgatgaatctgtatattaaattgtcagtttgtgtatctcggctgattcatggacgaggatttaatgcacaaataagttcggaaattactagtgaatttctgggcgtgatagttgtctaataataaaacagattacagattccgtcaggaaactgcgagacgaatttattaagtctaattaatccatcattagcaaatgtttcctgtagcacaacattgtcaaatcatggcgcaattaggcttaaaagattcgtctcacaatttgcacgcaatctgtatcgtaattggtttttttcatacatttaatactctatgcatgtgtcaaatattcgatgtgacagtgtgaaaacttttgttttgggaactaagcagggcctaaacctccaccgatacaaacggcaagcaggcatgcatgcctcgctaccctcagcatctccatgataccgccaactgtctcccttgcatttcagcagcacaaattgtctcaactaatggtttagaacaatatgttaaatatcaaatagttttaaatatctaatgttcaagaacgatagatgcctgccccaactatgacaaaagggaattgaacttaagacctcccactttcgagtgagagaccaaatgaccaattatcatacaacctttcatgcatatctaaatgacttgggctttctatttgaatatttattaatctccactttcctgcccaggagttaccattttcataatcttctacattacatctttacatgtctcgttgtgtaagaccgtttggaattattttgcctaataatagtagtaaatgtttcagttcaagaaacaattgaggatttaataacaagctaacagtccctttttagatggagttaacaattccaatggcatggagcaaatctctgaatccattacttaaaaaacaatttttctatacgagaccccttatgttgcatgccgtccgtaagtgcgggcttctacaaaaatcgacctccattttcgcatacggctccttaagaggtcctgtaaaaaatcgactttcgcaaatgggacacttaggccgctgcgaaaatgagtttatttttacaggtggacctcttatggtggatcaagaagcaatagattttcacatgtggacctattaagttgatccgcgtggagggcgaatacggcgacggcggccctcccccgccctaatccagtggcggctgccctcccccgccccaatccaatggtcgccgtcctcccctgccctgatccagcggtgatgatgggaggaggaggaggaggaggacagtggcggctaagggaggacagctgcagcggctgtgaggatgaggatgacagtggcggcgactggaggatgacgacgggaggaggacaacatcaatggtggtggctggaggatgaggacaacgacgacgatggcggcgatatgaggaggacaatgttgacggcggcggcaggagaacgacgacggcagcggcaggaggacaaggatggaggcggtggcaatgt

SEQ ID NO: 79213 - DNA, 3129 bp, Oryza sativa
atctccacatatattttatgtatgaattttttgaaaaaaattgatcgaataaaaaccttccattttgtacattacatgtttatttattttctgaaaatataatatctgatcgatattcttcttggtactagtagctggtacagtggagtagtggacagaacattatatattcattgatgtgagacacgcttatttatttcgagcaggatgacagggaacaaagccagcgcaccgacgtgagaaaaatagccaacaaaagaacagtaacaattgaaataaaatatatcctatatatctataaagttcatcctctaagtgtaattaatgttatttcttttttctctcattaatccacatcaccttaattattttagttcttgatcattaatctatggtccaaattaactctatccttttcttctcttaatggagtcatattaccttagttttgcctttggataattatctatattatctgttttcttttccttctctcattgagcacaatcaccttagttttgctttcgaatgagcactgtaagtatgatttaaattgttataaactaaatcatcttaatttgtttatagccttcttttcctctatggtcgattaaggatgaaagttatataaaacatataaagttatataaagcatataaagttatgttgttaagctattttacatgttatttctattattatcacatattttttttcagtaatgtaggggtttcatctagtatataataattggtaaagcctttaagtggtgttacttactgaaatataggtaagcggtaaaaacttctggctgagtacttcaccgtatatctatcatctctaacatatcactgcaacaaatatggcattatatatattgattcatttccttgtgacgactatgcaaaacgtcattgatctataaagtttccttagaaaagcatcataaagattagttggtttattttagtaatgaatcgaaggcagggaaaagttatttaaaaacatatataattaatgtcttacaaaattaagctttctaacaactaataatctcatgtattttaatttatagagttcatgaccgtaaggcatagttggagtcctgaaacctgcctatcaacgatataatttaaaagtacattttacgtgtaaggtaccgttgatcgagtgtccatccatcaagaagactataacagaaggcacaacagtgaggattgctaattaggacagtattttcgatatgtgcaagagaaaatgagatggagggagcatttgggggatttgagtgtcattgtagctaaagggggcatatgcgacacgctgcgatgtagaggggctgagcgccatgttggctgtcagccatgaacaaagggtgattggactagttcactgatcttaaacatgtaattttcaagtgtactaagctaagtgataccacaccacaagtttagagatcatccatgtatttcactctaaaaccaataaggtattttatctgatttgataattaaggtggtgcaaaatctgatttatagatgtgagtaattgatttctcgatttaaacatttagtaatgggggcaaaggataatctttatgtggtatttgctcaagggagtcgtcttaacaaaggataatcttgcatgacggaattggaatgggggtttaacatgttgtttttgcatgaaaaatgagacaatccaacacttatttatggattgtcattatgcaaagtttatttggagagctgttcaattttcttttggattacatcttcctagaagcatacctcatatgtttaatggttggcttcagggtgtggacaaggacaagagaaagttgatacttgttggtgcctctgctttatgttgggccctgtggttgtttagaaatgatagggattttgacaaatcatcatctgtttcctatatgcaggtaattttcagggcaacatattagcttcggctgtgggctcaactacaaaagtgtgaggaaaatagagttttcctgaatgttgcatgtcgtactcttgagtcaactgttatgcaactttttgccaaccatggatagagattttctactaggctggaataacgttttccttgtcatgttaggtctttcttttaattttggttggtttgatagttttatcttgaattaagattttataagtctattacttttttaataattggctgtatctcttcggagtaaaggccgagatgtttcattccattatctaaaaaaagtaatgggggcaaaatgaaaattccacttttggttgccggtgattcatcgcacaaacagctaattaatggcaagatcgacagggatatactctttgtatattggctaatcttaccaggtgaaaagagaatttgatcactggagcaagaagagccacgccatctgctgcataatggtcctccgattgaaaagcaaacaaaaatagtaaacactactataaaaaacatttttcccgacgtggggtcttattttcgtaggcggacatgacccttagagccaaataaccgtctataaaaatataaatcagggtgaattttgatgtccgcctgcgaaaatagacttgaatataaatagacttgcgggcgctaattttttttctaagtctcacacctttcctccctccacacctctcctcttctcccctcccctcacctctcctcatcggcctctcccgtcccctcacctctactctccccggccaccaaccgaaggcggcggcggctcccgggggtggcggcgtgtgctcccgacggcgacggcgggcggtggcggtggcggcggagggccgcagcggcaaggaggcgaggcggcgcgtgacaagggggtttgaggcggcggcggcggctcccagcccccccctcccagatctggctggaggggagcgggggaagcacggctaccggcggctcccggcccgtccctcccagatctggctggaagggggaggggggagcgcggcggtggcggcaggcggtggggacggagtgtggcattggcgaggaggcgaggcagcgcggctcccgacaacggtggcggcagctcctggcccctccctcccatatctggccagaggggggcggggggagcgcggcgacagtggc

SEQ ID NO: 79214 - DNA, 1208 bp, Oryza sativa
aaaaattctccgggccatatttgaatttttcttgtacgtattttagtgtttgccaatttcttttcgaattttaattaattctattattccttttagaagatgatttttatttcgggatgaatttatcaggacgtgacaaatccaccccccttacaagaatctcgtccccgagattcgaggaggctagcaagaagataggttgggcggtcttctcttcttgtctgacttcttccgctccgctttctataacaaacttgcctaacaaagcttctccactctggactgcttggctcgatctcctattgcagatggaatcttctctgcacctgacttatccctggttgaacctttagctgacttcgactgggttgcggcacttgaagatggggattcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagggaaccaacttatcccacttgatatactttgacgtcttcccaaatagttttactgctggacttcttattgtctgatcgttatccggccaaatttgaagcttcgttgttagatgtgattttactctgacctctgtagactatcttcgatcatatcacttggttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctcccaagacatggcgtcgcctggtaacctgggcttgcacttttcactccgtgtagcatctgataccgagttgaagatttcactccttgccttcatagaaacccttttacctaggtcatcttgcttacttaatgacagggtgactgttgtgggggaggcaattactatcaggggtcttccttgagcgatgcagagcatgtttcttgttatcaatcaccttttccggctacttctttcatgctagagaacatctttggcaatctcttttat

SEQ ID NO: 79215 - DNA, 687 bp, Oryza sativa
aaggagattaacttgacacttttaacttagcaacattgcctccagtgatctgatatttactctttaagtcctgttagtgattttctagagcaaagagaattcgtaaaaaaattctccctgacaattccgattattaaatacattgttaactggggttttctcctggttaaccaaagtaaattcttgaagtcatttattaatgatttgaaacctaagggaagggaaaactccaagtgtgacaggagatgatcttcagtcttacaaaaaatttctatacaaaattaagttgctttagaaaaatcttattgatccgttttatgtgtttggggagagagtttcccaactcccactcacgattcgttttatgcgactcacgaacacagcagcctaaaaccataaatagacgtcgcctgggagcatcttgatgtagatcgactcaaatagtttcgggctctcacctcccttgaacagttgttggaagtgtaagactgacatggccaacgatccaaagctagcatttatggataatcattattagtagcagtaataacatgaatttcttaatttggtgcagatcctctgaatcgttgatccaagctcgaagatggcggcaccaatgggggacggaggcgacctggttatgctgatggaggtatcccagctgaagaagctggccctcctgctgag

SEQ ID NO: 79216 - DNA, 685 bp, Oryza sativa
atcatggtgcctcaaaacgacaaattaatagtactaattaattgttggtgatattactaaaacacgcggcttcaggcatgtaaagtttaatcgttcgagcatattcgatcactaagtaatcagttaagtatcagcgtgaatgtgtacctcggatatagtgtggtgatattacgcaaacacgtgaacctccgatcaccatgattgtgtacgataagagttgatatgatcgaacgacgtgcttaatcagagtgagaatgcaagacgtactatgttggtccaaatagttccacatcgacattaacatcatacttcctccgtttcgaaatatttgacaccattgactttttagcacatgtttgaccgttcgttttatttaaaaacttttgtgaaatatgtaaaattatatgcctatataaaaatatatttaacaataaatcaaatgatagaaaaagaattaataattacttaaattttttgaataagacgaacggttaaacatgtgctaaaatgtcaacggcgtcaaacatttcgaaacggagggagtatttatctttgttaatttagacgttcctggagcatctttattctttaacgtttatttccatgccctgatctgcatgcacttccaacgtatacacactggcagaaccaagactgcaggccagctagctatcttcatcattca

SEQ ID NO: 79217 - DNA, 1512 bp, Oryza sativa
  unsure (1)..(1512): unsure at all n locations
ccactaataaagtaggagttatataccatgaagataagtgtataacgccaacttagagagcgtttgaaaagagaggaaatgagaaaatcgataagatacactaaacaaggtgataaattagcgtgttaaatattaattattttgaaattgaaaatagattaatatgattttttaaaataactttttatagatttttaaagagtattttcaaatttatattaatatcactattaggcaggacacgggaggtgatgacaaccgtctcgcgtgaacgggagaggttacgcctcctgcattgcactttgctctcccaattccttattcaattccctccgccctaaaataaatttatctttaccttattttatttatttaataagttcacttttaatcatcactacatcaaaatgtgtgtaaaggtaaggaataattgtcttagagcaagttttatagtagatgtgactaccacctctaatcttaaccatgtcatctacttaataattaagaggcaacatgtataatacattacctctaatacacaaccctaataattattttgttggttcactatgacatatctcactatctctttatacatctcatcttctcaaccaatcataatactccccatttaattccattaactttctttcaatcttaaaactcctgacattttgagacgaccacgtagagctagccgggtgcattcgtcactacacttttctaatttctactcctcatttttcacgctaacgttttccaaacaactaataatgggntttcttaatatatatatatatatatatatatatatatatatatatatatatatatatatatatatatatatatatatatatatttgtagtagatattcacatgggaggtggattttcatttcgaggggatatcttctcgttttatgcataccacctataaaatcatcaaaaaatttggaaaaaaaatcaacaacatagatcaatatgtgatttatcactctacatacatgcaaattcaacttgtataagtataaaaaaaattaactctgaagtgtatactattcgtactgaaatttgttgttttttcctatttgtgtaggttgaatttgaatttgcatgtggttatgaaataacgacatatctcatattgatctatcatgttagttttttcaaaaaaaaattataattatctgaatggcatataaaaataagggatatatcttgttaagaaagaaaagagtttcacatttctaaattactacttccatgcatatatgtataacgttggctagtataaatttgaagtagccaatgtcatataaaaaaactggagggattattttttttataatgaatttttattatatatatagagtcaagctagtaaattaattaggtgtacgtacgtcgtagtatgtgctggtgctttcttttttttgaacggaagtgctggtgctttcaggcacatgaaactaattgttcacaacaatagtgcaccacatataccaaattg

SEQ ID NO: 79218 - DNA, 6215 bp, Oryza sativa
caatcctacattgtttttttacttgaatttgaatatgtttttattcagattaattgtattaggtttaatcacattcaatcctacattgtttttttactacggatgaattactagtctatatcatatcctcctcacaaaagttgggacagggaagtaaaaaagctgtcagtggaatcagagaaattaattcattaaattaatatgcacatctatatatttagagaaaatccaaagaaatgtcattggaagcgttcaatttcaagaaatgccatcaacaagtacatacatgttccatgaaatgttattgtacaagcgattttgtcctagaaatgtcaccgccgttaggttcccatgcatcccgcactattcatcctatatcatttaacggagggttgctaatagaaccctaacagcgatggcattttatggaactcacactggttgatggtatttttttggaattgggagcttgtcagtggtatttcttggattttcacatccatttaaattcaatttcaagaagagcacgtagtacgtttcgctaattattgaattcaaatttttggaattgataacttaagtattttaggttattaattaattataagacgacactccaatacatttaattacaactagggtgctatcctatatatctataaagttcatccccactaaatatagtagtgctaattttctcttctctcataaagccacatcacataaattgtttttagcctttggataattcatcaagggtgtaaattgcatctcttccctaaaaggcacaccatacaactcaaccgtttataacctatggataattgataaaaattaaaaaaaataaacatatgaaaaataattgtatattaagtaagaaagaaaaatttggaactcatatctactatgttctcacacaattctcctacagcaacgagcgaggtacccatctagttcattctaattttttgaattgttaaatatattgcgcaaaatataattaagactccaaattgacgcagtcttatatatattatttatttattaaaataataagaaaaatagtccagtttacacatatatatatatatagtaaatttgtttggtgctccatggtgcccggacaccattgttgaaattgagtatatacccaattcaaatgagtataaaactttttcaattacttaggtattaacattaactactttactaactagtttaaagcaagtttgaattgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaatatttgaaaaatttgagtgattttgtgcattagataccatggtgccatatatatatatatatatatatatatatatatatatatatatatatatatatatatatatatatatgttcgatacccaattaaagttaatttagttaagtggaagctaattaattaagtatctatgtaatttaacagtgaaataattaattgtgataccgccaatcaaagataaacagtaaattaattaatgctctagaaaaaaatcgtgtgattattatttacaaatgaagcagtcgtcacatttgttgtttgcaggtgacgtaacgtggatgtctctataagaattgacttgtcaaatttgtaagaaccacctgacacctgtctagcaacctgcatatcgtcgtggtcgtagtctaactacgcttgggcctagtgtatacatgtagggagatggattttcatcctcgggaggtgatatcatctcgttttcttatatgctatttataggttatgaaaaattattaacataattaatataaaatatatcatttcacaaaaatacaagacaaatacatttttttacaagttaaaaggaataaaataaattgaaaatagttaacacatatttataattatttttcttacaatatatgtatattatatccgtattaatagactattatttatatccgtattaataaactgaaaatagttaaatacatttagtggttaaatgtatttatttattaattaattgaaatattattgattaaaaattaatattaaaaattttggggaaaaaatatattttagcgcgaatatttttccaggtagctagactagcattttcgtaggcggcacatcatgctctcgttcacctaggaaaattgatcttcccaatcggatcggccggctgctgattgttttcgcatgtctttgcctacaggtggactggccgtccgcctaggaagaccgttttcatcagtgtagaaaaatggtgtcaaattttttgaaagaaaaatattgataaatgcatacgcagtccctatatggctatatatatggtggtaaactggcatgtacacatgctgttgtgagtagtgattagctaggcggctattagcagcagcaaccagttctttttgcgtatgatagatgatgcagagtgcagctggagcaatggagctgctggtggcgtcgcaagaagcaggcggcgttgtggtggtgggcatgaacagtggcgacgccggagagctgagctacgccaacaactcggacatgcagcggacgatcgctgcggcgacgaggaaggagcggcaggagatggcggcggccgttcggcgcggtcggcggcaggcgagagccatagccatcgccgacctcgggtgcgccacagggccgaacgcgctgctgatggccggcgacgccgttgaggccatgctgggcgacgcggagcggcagcaggaggcggcgcctgcagagttccacgtcttcctcaacgatctccccagcaacgacttcaacagcgtgttccggcagaagcagaagctggtggtgccgagcaataatgccaatagcagccggtgcctggtgtcggcgtggccggggtccttctacgggcgcgtgttcccggcggatagcctggactacgtggtgtcgtcgtcgagcctccacttcctgtctagggcacccgcagatgcggcgcccaacgaggggaggatgtacgtgtcggcgtcgtcgagctcgagctccagctccagggtgctgcacgcctacagggctcagttccaggccgacttccgcctcttcctctcctgccgcgccgaggaggtccgccgcggaggcgtcctcctcctcaccttcgtggccaggcgggaggcggtgccctcgccgcacgactgccacctctgggacctgctcgccgaggccgccgccgacgacaggaggctcgtcgactccttcgacgcgcccttctatgggccctgcccggaggagctgagggaggccatccgcgaggaggggtccttccaggtgacgaggatggagctcttcgaggtgagccgctcccgctcatgccaatcccaagcagatctagatcagctggcggctcagacaagcagcaccatcagggcggtggttgagcctatgcttggaccacacttcgggtgggacgccatggacgccctcttccggaggtacacccacctgctccacaattactaccgccacaacaacgaccagctcaccaacgtcttcctcgccttgcacaagatttgacttcattcatcccatccttccttccttcaaccatatatatataccacattccctacagtatcagtatgtattactgtatttccaaaacgtacctacaatatataccacgtgtcagttctacgatatatatatactacccggataaaatgatagtatcgtttctaaaatcgggataccaactgtttcatgtactagacaatatttaaattcaaaactatttaagtgtatttgtgtttatgtatcttcaaaatcaatcttaaataaaattattagaactagtgagtggctttctcttgacaaatgtctcttttcatgtactattctatttatttagaatggctatatatatttaatataaatattaaattaaacttaaaaaaataaaatattatatatcccgatactacgatgcgattaaacaatccgatactactcaccttctacatgttcaaagtgtatagtacaacttccattctagcagtatattatatactagtatatatctgttcaaagtgtatagtacaacttctcttctagatgtgatcctcctatcttattataaatatgtttttattgtgtttgtgttgtaattaacatatataaatctgttgtgactggaatggattttaaacctcttgagggataatgactgcttgtataccttgttcttcctaaatcaaagtaaaggattatgggggatcctagcacgcgcgtacgcaccagctggaccccgtccccgcatccctcttttttcgcacttttttgacgcgttttcttctctttttttcgcttcttcctttttttaatctttcgcatacctctttataaatgtagaattgaaaatttttaattttgacttgaaagtttttaaattttagttgaaagttttcaaatttgagttgaaagtttttcaaatttgaaataaaaagttgaaagtttttcaaatttgacttcaaaaaattcaaaattttgagttgaaagttttcaaatcactagttgaaagttttcaaatctgagtagaaagttttcaaatctcgagttgaaagttttcaaaactcgagttgaaagttttcaaattttatcttgcaaatttaaatttcaagttgaaaattttcaaagtttgagttgaaagatttcaaaatttgacttgaaagtttaaatcttaagttgaaagttttcaaatctgacttgaattttttcaatctattagtaaaaaaatcttcaaaaaaaggacaatcttatcttaattagtgtcattatctaaaactaacttagttagttaggcttaactactcccgtctctcgtgaaaacgctcgcgacttgctgatctcgcgcgtgcgcgcgaattagccatctcgacgtttgttactcctacttggttcctatactgatttgtatttcgaaaaggtttttttttggaaggacaaaacctagatattactgcggagagaattaagcagtttgtattagaggagaaaatcgttgtggctgatttggccacgtcttgcgatgcccacaaaaataggaacaaattgtggttcacatggatggtccgctagtagtatttctgcttgctttttgctcatggaaattattaaaggactaagcaactggacatttaaggggtggtaactagcaagcatgaagcatgggctaactcgaaggggcgcagctaattcgcgcataagcgcctctatgttaactcgcgcgcactaccacgtggcacatacagcgaatcctcccatcgcgcgattagcataacggtgattatagatctaattacggtgctacagtaatttctcaataaaaataattcatttaaaaaattcgagttgaaagttttcaaatattgactttaaatttttcaaaatacaatttgaaagttttcaaatctgagttgagagtatttcaattttgagttgaaagttttgaattttgagatgaaaattttgacttttgagtaaaagatcttaaaatttgagttgaaagttttgaattttgatatcaaagtttttatttttgagatgaaaattttgaattttgatttggaagttttcaaattttgagttgaatgtttcaacagtgagttgaaagctttaaattttgagatgaaatttttgaattttgagttggaagttttcaaatttttagtttaatgtttttcaaccgcaagttcaaagtttttaattttgagatgaaaattttgaattttgagttggaagttttcaaaatttaagttgaatatttttcaaccgaagttgaaagtttttaatttttgagttaaatgtttttaaatttcaggttaacaattttattttttttgggtatgacttctttttctagagagttttaaattttatgtatagatttttcaaatttgtagttgaaaaggaaataacctttatgtgaaaaagaaaaaagaatgattcagatcgtgattatcaaaatctaattacgctagacatgatcttatctgatatcatgcgtacgtgcgcgtgtttctaccttcccggtgttgcgtggtaggccgggccgaaaca

SEQ ID NO: 79219 - DNA, 1730 bp, Oryza sativa
  unsure (1)..(1730): unsure at all n locations
tgtatcattttattagttcagattatttactgccagggatttcctgtttagactagatactgcactggtgggctaaaagtgatcaagtatccaattttggtaggtaaagatatccctgaaacagttcagcagggaatgagtaggaactttacttgtgggagaatgcttacggaattttgtcccaagacagtttggtaggaactagttggacagttaatttagcacagttcgatattaaatgatcaatttatcatatgatacatgtattgaaggttgtaatatggtgataggttaaatagttcttcaggaactgactgtgatcattaatggcagggagcaagtcagtttttgcttctccacttgaaaagatccaacccaatggagcaaatcatgcaggagatccggaaactccaggaggtcaagccttcaagggcctggacatccttagcctcagcaatttgatgcggcaagaaaatgcttcaggttcaccgtcactttcttggggtgagatcctcccaaacccaatatcgaggcttggcttgtctacaagagaacaagcttttgttgaaccaactactgctgatcaacatgtgcctggttatgggaagggcttttcatccactccctctctgaagtattcagtggcaaatgtgagttccctttgccttctttttttcccctacaagccatgttgatagtagaattttatcatcttagttgcactacaaccaaaagtactgtttttgaaagaaaccacaatattgttcattgaagattaatcttttctaagagttcatgatgttctgcagcgagagaaatagtaagtggtgtttttttttttttggggtttccccaaaaattttgccttaaancttggggngacancatacctccatctacgacagtgatgaacctctagagtccatggaagcgatagaagctcaaactattggagatctccttcctgatgatgatgatgatttaatatcaggtattgccgatggatttgaatttactggcatgtcgaccaaccaggatgatgccgatgaagatatattctgcactggaggaggaatggaacttgaaaacaatgattccgtaaaaggtgacaaagttcaggatggatccttcaagagccaaatttcttcaggacactccatcaataaacaaccttcccgaactcttgtagtcagaaatattactgctaacatcgaggattctgatctgacggttctgtttcaggtattgaaccttttccttatttcatttcaaattttggttttagtttagtaaacaatatccttttgaacctatatacacacatatatatctttcagcaatacggggacattcgcatgctttatacctccttcaagcaccatgggtttgtaactgtttcttattatgacataagagcagcccaaaatgcaatgagagcgctgcatagcaagcttctggggctgatgaaacttgatgtgcaattttcttttcctaaggtatgcataataatatcagtagttttgaattaggcatgctacctaatctatatatcttccttatcatgccatttgttacttgggcaatgttgttctgtttcatttttcattctaacttgctacaaaatcatgctattacttttactggtgccccttgtttatttattggtttttgttccttttagcatgcaataatcatttatattctatgttttgaaaattaaatgctgttgt

SEQ ID NO: 79220 - DNA, 1326 bp, Oryza sativa
gtaagtcaacacatgcaaaacacagaactggtgaaggaccaatagcaaagtaccaaagagatggattcagaaaaaaataacaattcatgagcatctagactgttttctgccacaacacgcatacaaatttaggttgaaaagaaaatcctccagatcaccatcagaaactggaaattattttcaattagacggcagtaagcagctatggcaacccctgactacactatggacagaaatgtggggagaaaaaacaagttgactgcataacttcaaggcaaacatttatgtggtgccagtataatctaagaaaactgaaaaataagatccataccccccataagttcatcctcgtcaatgtcatcagggacattgtagcttcttccgagagtttcctgtatttcattgctcacatccataagatccatcatctcgtcttgcaagctctgcagataagaaaagcatgggtctagattcagatgcaattggaaacagaagaaaacagggaacaacgaaaatccattgcaagccagaaaatcttgaaaacatgacgaatatgttacacaaaaagatgctgcgtacatctatatcttcaagcttgacagttttcatcattcctttcagctctttattggctgccttcattgcagtcatctgcccaaatgaaaacacttgtatcataagtttgggaatcaggatgtaaaacatcatggaaataaaacttcttgagtatactatagctatataccgtttgctgagcatctttaagtccctctgatgcaaaagcaacttgggcaagggtatatgtttggttgtacagcatgtcacgctgcccttcgtacctgtcaggaaagcatatataagacagtatacagatgagcacagtaccgtaatagagtaagtaattcgaaggagaagcaaaagagctcaacaagatatacagagtgaatggtaaatgatgattgggttccttaactaagtaataaaatagaagtctctttttttcttataacataactgctacccttaggaaaatctttcaaaatatatatgaagaaccacatcggtacttaaccaaaaaaagaagatgaagtacacttagaaaggaaaagactctgtgcttatgaaaggacacaaacaatttacagagtcaaaattatgcctctttttatctcaaatgacttgtaagcgatgaattgtaaaattggcgtaaccgggacttggtacaagatgcaacggtttataatgtcatcaatggcgagttctttaatttttcattcatgtgttgttgttgtccacaaggaagaaggcagtgcaacaatttgatag

SEQ ID NO: 79221 - DNA, 906 bp, Oryza sativa
tcctttggttgctggctcagctgtaccatctcctcctgggctccaaaatccacactatcgatatctctgccttcaccgtcaccaagactgcatgcagacagtaccaagacgaggacatgtactgttgctcctcctgcgtttcgcttcattcattcatctgctgctgtgctgttcctccccctcttctgtgtgttgcatctgtagatactctactcccttttcatgtgtttaatactccagaaatgtgcatgtgtgtgtgtgcaatatgcatgccttgcaaatgtgtacttgatgctgccagcctgatcgatatgacttggcctcctgcctccagtcctctcttgtacactgtaccatctctctttatctctgctctgggatccattcaaagcttgcaaatgcaaaagcaaatgtgtgtgtgcatgcacagaaaagtggaatcttttattaggcaacctgatctgacctgacctgctgcttgtactcctatttggacacatgaaaaatgaaaatggtaggagaagcaagggccatatctgggcttgtagccagtgaacattggacttggaaagattcatcaaaaaaaaattttgctttcccatagctgctgctgacccagcacctttcagaattctcagatcggatgcttgtcttttgagttttgagccttgaccaggttaactacatactcctatgcaacttcctttctgcaagctatgttatgtacagtacatctgtacatgtatgacggccgctgtagataggactacagtgctatgttgccatgcatgctctgctgcaccttttgggctgagaattcaatgttgtttaatccttttctgctagggttggtactatagtagggatagcattcacaatgattcatcagctggagccaatattcag

SEQ ID NO: 79222 - DNA, 1134 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggccctgc

SEQ ID NO: 79223 - DNA, 2624 bp, Oryza sativa
tgagaatattgtgtcactgacagcagaacaacaacatataatagctacttctataaccaatagtttgtaaaccacatgtttaacccctattgaaatagcttaactagcagcagtcaacagaaactatacaggttaatagaaactacaggccaatagacaattcatatatccaaaatatcaatctccagaagagatcctacaattttcaaagttcacaagaactaaacactacagtatcaatctcacattatccaaaatcaagaatttttttcttcgacacagtatactcttgattaataaaagtagaaaatttcagttccaagactgaaactctgaagcatgacagtcacctaaaaagtgtctaattgcgggaataacatcaactgcatgatttctctatttatacacttctaaagatttggtgttggtctacgaattaatcaaaaaatgcacattgaaaggaaaaatggcacaatctacagtttcagagaactgaaactcccaaacctgcacatgatctgagactgaattttctagctaaatttcagcaacctgaaccataatttcagaatttcacaattcagaattgagctcaatttcagcaggtccccaacatatacactgcagtaatgcagtcagtgggcaagaaacacaagcacatttagagtgtgtagatggaattgatgttcctactcttgttgtttttaaaaccaaaagaattgcatattcctgggaagctgttaagaggaagatgtgatatttctctgatccatttccacagtgaaggacgcgtttcacaaggggcatcctaaattcctaaaaatgatggcatcctttagagaattacggggtcatgggaatcaacaatcatcttcagatttcgtggaacacgtgttgtattaacagatccaatggccaaagcagttgatagtcactcaaactaccagaattaaagggaaaaaaacaaaacagaaacaaaatcagaacaatatcagattctatgctaactgactggaatatacttgctgtcaatttcagctaatgactctgaacaaacacatgccattctctattacaaatgcatatgcgccattctctagaactaatgcacagcaaatctgagcacccaatgacagtagtaaaacttagtactatataaatctgagcactgtttaacagaacattatcgaaacacaagaacagttaatttaggcaagacataaacaatagaaactttaggcagaacatacctcacaaaagcacccaatctcatgtatatcaaccctgtcaatacaagaaaaccaggtaagacaacatgctctgaaaattcgtgtgagctacttactacactgcagggcttgcgttgaaagctgaagatagcaatgttagccaaaactagcctaattaatagtgtgaaattagaagggtaggttagtttagtgttttgccgggtataaaggcttcaggttgggttaaattaggatgcttgttgggtggattaacacttaacagccgcaactttagaccttagacacgccacaaatttatcttgaagctaattgtctgtaatgctgataattgacaagcatgcatgtaccatcttgaatcgtcgatggagttcagaagaaggatggtgtttgacatacctagatgatgtagcagaagatgctcctcgtggttcttgttggagaagacccggtgtccggacagaggtgaccgaacagagaagtaattgccagcggatcttgcatggagggatggcagcaaaacataagcttcctcatccacacgagcagcgacggggagaagagtaaggggctcacctgatgtctgcactggggaagtcagtggcggccgcggatgtgtctacaagcggctgctccggcagatcagatgtgaggcggcggcggtgtctacagtgagaggaggcggcgacgcgagcggatgcggtggaaggcggcgacgcgagcggatgcggtgaaaggcggcggcgcaggaggatgcggtgggaggagccggcgcgcgacgggacgagaagagcggcacgggaggcaccggcgcgtgacgaggagagaggcggcgcctggttcttgcagccgtttgatcagggcatcgcctggacagcgtagattaccccaacgacggttgaagggtatttccgatcatttcaaccgttacaaccgtcattagaaggctataaaagaagccgtctctctctatttttccacacaccttaagcaaaaagcttcatttatctttcaagtttagtgtaggctctagagtatatagtggaatagaatcttcagtcctcgaagtcttcaaaagaattcgggtatagctttagtagcttttccttcttttgtaagaattgtacattatttagaatactcttctttgtactattttggtattgtactattttccgagtatatgaatatcagttttattatatatccgagtaatatttattatgatgctagcttatctgggagatggaatagtgtgggtataatgatcgtgtatacgatgactatgtcattacgatgatattagagtagtatttggtaatttaagcgtggtgtttagattactggatatcattatttgtggttatatgtcgcgca

SEQ ID NO: 79224 - DNA, 3991 bp, Oryza sativa
caacacgtgaggaagatgtgtcttgtgggtaaagatgtacacctttgatcagagtaaatctattcgaatagccgagccctcggatatgggcaagcctagcaatgtacccaagtcagtgtttaattcttaaaatttgctcaacaactaaaatgtggaatggttggcctgggttggcttgggacgagctgggacccaggtcgggttgccagttcggtctgaatcatcgtaggccttgggttaaggcaggttcgtgagggttcatggccttgattaataacagtgtatagctctaggatcgtgtttacaaaatagcttgagcaactaaacgtcttcaaatgctgtttactgcaactctaaccccttatattataattcccttgtactcccttgcatttattctgcatttgtgggtgtgtcttgttgagtacggtggttgtactcagtcttgcttaattttcccaagcccagatgaggagctccttgaagatgaaggcttcggtgtctagctcgtgcctgccgtcaagcgcctgtggtcttcgccctagtcttccgctgtttttcgttgtctttgtgtgctgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcacttatcatcaaaatctgatctttcaaatgttgcttttctttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgttctcctcgccatcggcacccttcaccagcgctacccggacgagttgcagcactcgccctaccgctaccaccctcgtcgcggaggagcccgcgactacgccacctttcgagacgccagctcggagcatgacgctaccgtcgtgcatctggcacgcatggtggaggcatacgacgcagctcgtattgacttccatcagatggtgcgccgtggcatggtggagaacaacatgaagatcctggagctgcgccaagagaatttgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttcctcaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagtcgtgtggggcatggttacgccggtgtgtggtgtaactatgtcggggcctgtctttatttgtttgcctaagcaacttgaacattaatgaaccaatttaatagcagtgataaattcaagatttatagtagtcgtgggtggttagttttaatcgtcagctctccttctctgtttgctggttctgtgtggggttttcagatggtgacgaccaggagaaatgttaacaccggtgaaggcaaccaacccgagggcagcaaccccaacccccaaggcaacccacctccaccaccaccaccagacaccaacgccattctcacccaaatcctcgcccagcaagccaacatgatgaatgctttcctccaccacctccaaaatccgccacaacagaatgctccaccaccccctccccaacactccaaactcgccgaattcctccgcatccgcccacccaccttctctagctccaacaatcccgtagatgcgttggattggttgcatgccgtggggaaaaagctagacacggtgcagtgcagcgatgaggagaaagtcgtcttcgccgcccatcagctgcaggggcccgcatctctctggtgggaccacttccaggctacgcagccagaagggcaacctattacttggactcgcttcaccgccgctttccggaaaacccatgtgcccgccggagtcgtggctcttaagaaaagggaattccgagagttgaagcaaggcagccgctccgtgatggagtatttgcatgagttcaacaatctagcccgttatgccccggaggatgtgcgggaagatgaggagaagcaagagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctcgcagcagcagcagcagcagcagcagcaacctcgctccgcgcctcgacctcaattcgtggtgcgcattccacagccgcagcagcagcagaatcagcaagggactcgtgcaccccgtcctcctacgccaactgtgcagcctgttcaaggtcgcagggacgctcaaggtccgcagcggctgtgcttcaactgcttcgagcccgggcactttgcggataaatgcccgaagccaaggcgtcagcaaggccaagtgcctccccgctccaacaacggcgggaaggatgtcattcggggccgtgtgaatcatgtgacggccgaggacgtgctgacaactccagacgtcatcgttggtacgttcctcgttcattccatccctgctaccattttgttcgactctggagcttcccactcgtttatatctgtgccattcgtggggaaaaatcagttgggggtagaaaggcttagaaaccctctgctcatcaccacccctggaggggttatgacagcaaagtattatagccctgccgtccctatagaaattcaggggattccttttccctcggatctgattctgttagacacaaagaacttggatgtgattcttgggatgaattggttggctcaattccaaggagtagtggattgcgcgaggcgcactgtcactctgtaccgaggaccggaacagccggttgttttctttgcacctccaacctctgtcagaagttcagaacttcatcagataggtctgtcagaaatccccatagtcagagagttcggagacgtgtttccggaagaactacctggtatgccgcccaagcgagagattgagttccggatatatcttgctccaggaaccactcctctgtacaagcgaccctaccgtatggcagcaaatgaactggccgaagttaagaaacagttggaagagttgaaagaaaaggggtatatacgtccgagtacttccccttggggtgctcctgtgatttttgtggagaagaaagacaaaacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgggaagaagatattccgaagaccgcattcaccacgc

SEQ ID NO: 79225 - DNA, 16320 bp, Oryza sativa
taggtaagtctcagcttacatgaatcacgtgatcatagataggatctcacagacctgctgatactacaagataacataaattatagtgagcctgttattgtttaatctatattgcttatcacgccacaactaatttaacacgaacaatcaacctagattttcccgttaatgtgggagttcctagctagtatagacactagctagacagagatcgtcctcttggggatagagtactactagtactatataagaggggggagttgagttggatcatgtaagctaatagatcgagctggattagctagatcgaccgtataagctaatagatcgatcgatcgagagatggcgaactgcttcggcgatgttgtggacaactacaagctggacgagatggagaggtacgtggggaaggccaagaggcaggaggaccgtgcacgggaggccatgaacctggtgaacgaggacggcaaggacaagaaggcggccagctacgtgcagggcgtcaaggactggtacggcaacggcgagtcgacgctgtgcctcgtctacaacgccaccggcgccaccctccgccacgtcgccgaccacgactggtggggcttcatcggccgcaccccgtaccccaccgagatcggcaacggccagtgggcggcgttccaccacgtccacaagtccggcgactcctccggatccgaggccgccgtcgtgtaccgcggcaccaacgccgacggcgtcgagcgcgacctgctcgtcgcctggagcacgccatggagctctttctaccggaacaaggtatattcatatcaaattattcttcggcgccattgctaattaaaattgtgtcgccatttcgcagtcgatttttcctcggtattttccaattatctccaagattcatgctagtattcttcctgttcatctacatcgtatcagatgtagaggtcggatttaatatccattatctggtttcggctgtcgcggtagaaaacgagaatattaattaataaatatataaacgtatatatgtttctctttgttaatggcaggcctactgcgctgttggaggtgtggacagcttccaaggtgactgggagcaattgtacgacaaggtgaataacgcagcttacacatgcaatgccgactcggatgggttcaagatagatgccagtactgctaccggtgacagccccgtcttcacggcgaccatcaaaatccatttcagtcaatgaaaagaaaaacaagatcgaccacatacttgcatggcattcgctcatgttgcacggggcaggcccgctacattctattgctgtatcagccagtcaatgaatgtaatgttcttctctttcgcgaaataatgtagctgttactatcgatcgtgtgaatcgatcatgtacaccagctctcgttttattacatattataataaatgcgttcagccatgtaatttgcagcattaaagcaaaaatatcagtatttacatccttatctttactacttaaagaaccttttttttttaaaaaaaggtttaaagcaaggtgatcctttatcttcaatttcttctttctataaagctaatgctcactaaacacctaaagcacaacatgcaagcatagtatttattagtactcctaaaacctacatacaagcatgccacattaacccaagcacataaagcttaacatgcaagcatatagtaattatttctacaatttatttcattctaaaactaaacagacatatgctaaatcatcattctcaaatcattttcataatatttcaatccaaatcattttatcatttctccaatatctaacatatatcccgtagaaaagcatggggcatcatctagtttttaatattatcatagacatgttagctatcctaatcaagcgttcaaaggaggatgaacaaattgctggagtagtgccacatttgattgatgatggtttatctattctgcaacatctagatgatacattgttttttatggatcatgactttgagaaaactaagaatatgaacctaatactttgtgtttttgaagagctctcttttcagaaaaatgaaatattctgctaaggtcaagcttaagataatgaagaacaatattctattttgtttgggtattgttagggatatatcttttctggttaattatcttggttttccaatacatttaggaagctgactaacaagaattggaaattgttacgggaaagaattgagaaaagcctaagtagctggaaaggtaaacatatgtatgtgggtagaagattggtttatttaactttgtattaataagtctaattatgtttatgattttttttgtttgatattcttagaggagtgcttcaaaagattcattattatagatcaattttcttttggcaacggataaacttaagaaaaaaaatatagacttacaagatgagatgtcatctgtcaaccaaaagaatagggtggacttgggttttataacatagatattcaaaaccaatgtcttctaagtaaatggttgtttaagttaaaatacgaagatggagtatgacgagaaatgcctaggaggaagtaccttaataataagtcaataagtcaagtagtgaagaaaacgagtgacccacatttctattcaatcaatgcactcaacattaatttttaatgggcatgagagaaataaattgttgtgaaaattaagatgcctatcaaataaagatttatgtggtatttacttaaaggggtagtgttagccaaagctaatttagcaaaaaggaattggaatggtggtacaaagtgatgcatttgtttgcatgaagagactatccaatatctattctttgaatgccatgctgctaaatttctctggagaaccgtttttatttcctttgggttgcaaacaccacataattttcctcaaatgtttggaaattggctggtaaccatgaattctaaggccaagaaatatattttgtacaagcatctgctttatattgggctgcatggctaagtaaaatgatatgttttttttgttaagactccaactaaatgttttatgcagatattattcagagcaattttttggcttcggatatagggccaacttcaaatgtgtgaagaggaaataaaagtcatatgtgctacatgccataatttagattcagtagttatgcaagttttcgataactttggatagagaattagcaatagacttaaactttgaataagtttttattttcgcttggttggtgtagttttatcagctttttatttatctttgtttatttatagtgtatttgagtttcgtgccaataactttgtaataagtggctatagcttcaattgaagcaaaggctaggtttattatccattaccaaaaaaaaaacttttaaaagcctagtacgtggtggttcatcatctgtcatttgtcactcctaaacatgcgggccggggcctaccagcagagtcgtcgcccctctccactcccccttgactgctaaatctccaccaatacaaaccactgcaccatctcgagcatggcttcctcacatggcaagcaggcatgcctgcaggctaccctgaacagcacatattatctcaactaatggtctagaacaatatgttaaatatctaatggttcaagaacaatagatgccacgaattgaacttaagacctctcactttcaagtgagagaccatttatcatacaaccttttatgcatgtctaaatgacttggccgggctttctatttgaatatttaatctccactttcgttctcagaagttaccatttttcataatcttctacattacatttttacatgtctcgttgtataagaccattgaaattattttgcccaataatagtaataaatgtttcagttccagaagcaattgaggatttaaataacaatctacaagtcccttttagatggagataacaattccaatggcatggagcacatctctgcatcatgcgaaacaacgagattttcatgaacatcaaccctcgcttttcaagttgacgagatcgttttagatttgagtttgccatggttattcatagggcataacgaaagttacttttctcacattacacaatggtttgaaaacatgtaataatatatcattacacattgtaagtgtatatattttagtaatatattcactataagagcatttcctactgcatgtaagtttagcctcatctccacatatattttatataagtgtccatacaagtcatatccggcctctatgaattttttgactatgataatagaatatagaaaaaccttatattttgtacatatggatctcatcaatattcttcttcgtattagtagctggtacttcatcagtccaaaaaaaaaaaccaatcttgtattaagatgtgacacatcctactacagtaaatctggacatactctatgttgtttagatttgttgtactaggatatatcataccctagtacaagattggcttttttggatggagggagtacagtagagtagttgatgtgagagatatgtttatttatttacagcaggatgacagggaaaagggccagcgctgcgacgttgcctctccatcaagactactaattaaagcttcatttctagagatttgtatatacataatgccagtgagaaaaataatcaacaaaataacgggtgaaatccaatatatcctatatatttataaagctcattctctaagtgtaattaatgctatttctcttttatttcattaagccacgtcaacttaattagttttagcccttggatgattaatctatggtacaaattaattacctccttgtcttctcttatggagtcataccaccttatttttgcctttggataattatctatattatctcttttcttttccttctctcactgagcacaatcaccttagtttgcttttgaatgagcattgtatgtacaatttaaattgttataaacaaaatcatccaaatttgtttatacctttttttcctcaatggtcgattaaagatgaaagttatataaagtatataaagttatgtagttaaaaagctattttacatgtgttatttctattattatcatataaaattcttgtagcaatgtgtggggtttcatctagtatataatattggtaaagccttttaagtgttcttacttgctgtaatgtaggtaagtggtaaaaacttctggctcagtacgatcactgtatgtctatcctctctaacatatcactgcaacaaatatgacattatattgattaatttccttgtgatgacgatgcaaaacgtcattggtccataaattttttttagaaaagcttcataaagattagttggtcgattttagtgacgaatcgaaagaagggaaaagttgcaaacacatatataattaatgtcttgcaaaattaagctgtctaacaactaatactctcataaattttaatttatagagttcaccaccgtaaggcataactcgagccctgaaacctgcccatcaatgatatataattcaaagaacgttttacacccatcaactatgcgtgcaaggtaccattaatcaagtgtctatcctacaaagaaaagaccatcatagagcgtacaactatgacaattgctaattaggattgtattttctatacatgcaagagaagaatgagattgagggagcatttgggggatttgggtgtcattgtagctaaagggggaacatgtgacgcgctgtgatgcggaggggttgagcgcaagagtgttgcatgcgtggtgcgccatgttggcggtcagccatgctcaaagggcgattggacctaattcacgggtctatacatgtaattttcaaattcacggatctaagtgataccacaccaaatgtctaggaaccagccatgtatttcactctgaaatcaataaggtattttaggtttggtaattaagggggtgcaagttctgattcatatatagctgtgattcactgcaataaatataaagcatagtgatgattggagatctcgatatgcaatggttgcataggctgacggtgatgatcgaattattttagcatgaaaaatatcatctgatacgttaattgtcagtattcctggcacgtgtactaaacaatcttacgttgtcagtgttgatttaatgattaactgatcagataatatgctcgatcgattaaacttaatttattacatgcctgaaccgcgtgtttgagtaatttcaccaataattagtactattaaattgaggaagcatgatacgtagcgatagcatttttgcctcgattctcatgcatggcttaaaattgctctactattacttatttttttcaacgtacgttaaacacgatgagctgtctgtccaaaaagttcgcttgtaattttcaatacgaaaaattggcagttgtacagtgcgtgttacgcacgagttgtttatcttatacccagctagatttgaatcttatagttttgaatgatgaagatagctagctggcctgcagtcttggttctgccagtgtgtatacgttggaagtgcatgcagatcagggcatggaaataaacgttaaagaataaagatgctccaggaacgtctaaattaacaaagataaatactccctccgtttcgaaatgtttgacgccgttgacattttagcacatgtttaaccgttcgtcttattcaaaaaatttaagtaattattaattctttttctatcatttgatttattgttaaatatatttttatataggcatataattttacatatttcacaaaagtttttgaataaaacgaacggtcaaacatgtgctaaaaagtcaatggtgtcaaatatttcgaaacggaggaagtatgatgttaatgtcgatgtggaactatttggaccaacgtagtacgtcttgcattctcactctgattaagcacgtcgttcgatcttatcaactcgtatcgtacacaatcatggtgatcggaggttcacgtgtttgcgtaatatcaccacactatatcggaggttcacgtgatcgaatatgctcgaacgattaaactttacatgcctgaagccgcgtgttttagtaatatcaccaacaattaattagtactattaatttgtcgttttgaggcaccatgatatgtagaagatacttatgcctcaatcatggctttaaaaattgttctatagtattaaataactttttcaacggttaactggattcatgccattgcaaatttatccattcagaaaaatatcattacgattagtctattcgtagcagtgtcatttcaattttacaaaattagaaccgtaccattattgtcacgttgtgcatccatctccttccttttccgtcttcttctttctttctctcccatgttcttctcgaagtcaagccggcgaaccaatcctcggaatccttggagctcagaggagagtgagtttgccggcgaggttaccgaacccaaccatagtaggcagcgatgaggggaaggtggcatgctcggtgtggatccagatagttcgctctgatccgcgtactaaaatattttttaatacaaatattttgctgtcctacattacttggttgtaattgtttatattatcaacccaaactcgaatcttatctgccagtgtgtacgcgcctaaaaaactattgtactatttaacaatcgaattaaggggtgtaaattctgatttctagattcaaactattataatgggggcaaaatggacttttcagtttggcttgccagtgatcaattgcacaaacatctcataaatggtaaactagatcaagagggatatagtcttgtatattggctttttatttttggctgaggatgtatttccctaagaaaatcaataaaagacaaaagttatataaagtttataaagttatacaaagtatataaagttatgttgctaagctatttcacgtgtcatctctattactatcatataaaatttttcagcaacgtgcagggttttatctagtatataataatggtaaaacctttaagtggtgttacttactgaaatttaggtaagcggtaaaaacttctggctcagtacttcactatattgattaatttccttgtgacggctatgcaaaacgccattgatctataaagctttttttaaaaaagtatcataaagattagttggtcaattttagtgatcaatcgaaagaagggaaaagttgcaaaagcatatataattaatgtcttacaaaattaagcttctaacaactaataatctcatgaattttaatttatagagttcaccaccataaggcataatttgagttctgaaaacctgctgtcgacgggggatacccgtagaccagattacgaggatattggggtacgttggtacgaggatcttctcgatacgacaacaagcacaaaaaagacaagaattatactggttcatggccctcgtaaggtaataacccaaatccagcttataaaaaaagtgattattttagtgcttagctaatactatagtagtaattaattgcatagacatggtgtctaggtagttagtctatgtagttaattgcctgtgtttgttgtgtatcccataatatgttagaggttggtgtagaggtggtaatagccctcgaaatcaccatagttctccctgtccgggtacgaagtagagcatgttcttttaccagcgagcatgctagtgcctgaagcatagcgataggattaaaattaagctttctaaacatgccagtgtcctaggatgaagctgaagaagagctaaacacacacattccctatggaaattcgatacattggaatacttccgggtgaattgctatagcagtatatccgtgcgcttgctgattttatgtgaacgcaagaaataccaacaatattctaaacgatacttccaggggaggatacgatgtcgagagagccggcgtccctgtccaagggaaccaggacgtggctttcacctaaagaaatcaatgggaagattagtgaaaaagcaacaaagcccaaggggaatgtggggtccgcaggcatcgctgttgctggcacgaaggttaggctttcgcccgaagtttttctaccctcccgcataattgagtgcctgctaggttcagcagcctccaccggctaaatcccttcaacacgtagccaccacgccaacgccttggcgtcagccaacaatcattaatctcgacctccagagcgctctagatccatccacatgggtggattggagagggagagggtgacacagaatgatggatcctctctcccccacgtgaccatcttgtggtggcgagatgccactgcaagagggctgatgcccaccaaatggcgctaccatcatcgccgccttggccaggctgcccgtgtcatctatgcaatgggccacctagccacttcatcatcgccttgtcgtcctcccataacggcaaccttgctgccacaacgctccagccttcgagacagcctcgtcgcctccgtgtcgtacttgccagtaaaatggggttaatggaggataaggaagaagatgacacgcctggttcgggcataggctctcaccagagaaactttcgtggcgttgtcagctcgtcggcctcgtcatgggcgtgcatgttcctagcaacccaacagagtttagcccgtgcaactgggcactatagaacgaggggcgagcaagaggtttttgtggaaaaatgggaggttaaatggtgggctcttgtgcgtggtccatggacggggtgcagggccttgtgttgtctctgtcttctcgagcagcccagcgatggaacgggacggcagggcatttcaggggctttgcttccttttcagaaaaaataatggaggaggagatttggtcggggcatgataattttggagaatggtgtgaggtggatgatgggtaggcccacttgcaatggctgctaagggctagtcttcacggagaaggctcgacttggcctgggaatagtcgtgcagggttgttctctactccaaaagaagatgcgcaccacatgttttacaggggggggggggggggagaggggaaaggtgtggacgctggttggtttttcctgggtggatagatcgattatgtgtagagcaagccatgatgaacagtctgatagaaaggcagaagcagaagagttatgatttcactgtggtgaattttgaaagagggctaagtgataagaatatattccacattttcagcagtttgactgatctacttgggacatcaaattagttgataaaataatgccaatttaattaactcacagtttttcaaaatgtgtacagtaattttgtgaatttttccaggagttttgtacaaacaaacaaattattaaaattcttccaacctatttttagtgcatatgaatgcaatgatgaatgtctgcaaaatccaaaaagaaggaaaataatattaaaagacagaggaagtcatttcactgattataacatgtatttaaacttttaaaatttttgggtctattacattctgagttgcgattcatgaaaaactagatgtagatttattagttcatctggtaactccaatttgtatgcgacttttcctcgtcgatcttggatcttatatgggtcgttatatgttggtgctaacatagccttcatctgaaatatatgcactcctttcattagtgacatgagatatacaatctccaatttcaaaactcacgtcctgtcttatattaaccgaatattccttatgttcactctcagcatagtcctgagttgtttctcgccaactttggtccaactttaaggcgtcttagctacacatttttccatataaatctttataaggtgccattcctaaattgatagctattattataggtgaactcggcgaatggcaaacaaatctcctatgctgatccatacataaatgtgcaagctctgagcataagatctgatttactctttcaatatgtcctctagcatgtggatgataggctgatttgaataccaattgagcacctttatagacatggataccaaatcttgccttgtcgatcggcatttattcattttattataagtccattacccgacattatttagccggttgcgcacgctgacagttgacaggaactacatactcatgcaatttttaaagaaaattaaatgattaacttgcaacgatttgcctagcccctgtgagaaatgatgtaggcaagctgcatgccatcgggcatggtggcagtatggaacttgagatcagtcaccggaggcgccacattgcccccggttcccatgatgaggtccaccagcacgccggcgacggcgacgaacaggaggccggcgacggcgccggcgacgagcccggccatcgacacgacaaagacgccgagctcgaggtccgcgaccgcctccgtcaccgcgccctccaccaccacctgcaccgcgaaggcgcccacctccgccagcgcgttcaggctgttgcggagcaccgcctcgacggtgtgctccgccgtgaagatgtcccacaccatgaggcccgccgtcgccaggagcaccgccacccccgccgccgtcgagaccatctccgtcaccggcatcttggccctgccggactcctcgatgatgctgttgtacacctctagcttctgcgcgtccgtcagatgctcgaactcgccctcgaatcccaacttgttcttgtgtcttcacatcgatccgatcacatccgataatcaaagattacaactaattcaagaagaagaggagatcgaactgctatatatatgtatggtaattaattagcaataacttcttaccgtttgacaaggtcggggaacttgatgccctcctgcttgagcatcatggagaacgcctttgacatggcgcgggcggagccgctccggagcctgttgcagtgctcgaacatgcactccttgaacatggccgtgtccttggccagccgccggaggttggcgacgtcgtcggcgtggaggccggcgaggtcggcgacgagggagtcgtagtgcgccctgatctttccgatgcagtccacgcgcaggcagcagttgcggacgttctgcatgctcatgttcaggccgtacttgacgtactccaggacgtcctccgcgatgctggccttggcctcgccgccgccgcccgccgcggcggcggcgtacttgtccctggtggccgagccgtcgtcgaggaggtcgacggcgtggttgtacgcgtggttgacgctgtggaggtacttgacgcgctcgttctgggacttgaccgcctgcgtgatctgggcctcctcgttgttcctcagcaggagggccagcttcttcagctgggatacctccatcagcatcaccaggtcgcctccgtcccccattggtgccgccatcttcgagcttggatcaacgattcagaggacctgcaccaaattaagaaattcatgttattactgctactaataatgattatccataaatgctagctttggatcgttggccatgtcagtcttacacttccaacaactgttcaagggaggtgagagcccgaaactatttgagtcgatctacatcaagatgctcccaggcgacgtctatttatggttttaggctgctgtgttcgtgagtcgcataaaacgaatcgtgagtgggagttgggaaactctctccccaaacacataaaacggatcaataagatttttctaaagcaacttaattttgtatagaaattttttgtaagactgaagatcatctcctgtcacacttggagttttcccttcccttaggtttcaaatcattaataaatgacttcaagaatttactttggttaaccaggagaaaaccccagttaacaatgtatttaataatcggaattgtcagggagaatttttttacgaattctctttgctctagaaaatcactaacaggacttaaagagtaaatatcagatcactggaggcaatgttgctaagttaaaagtgtcaagttaatctccttccttcgcctttggtcatgaattgtgcccaattcactcccctctcagtccgcggttttgttttgcatgacgaaccgtacccgtgtcagtttgcaggaccgttttctttccattcctaaagctgcaccgcattgttttcctttttgggaagtcctagttccctagttttccttttccctccctctctccccagccggccgcgccctccccctcccctcgcgcgcgtgcccctcttccccctggagtccgactccctcccctccctcctagttctactccttctaggactcctcctttcctaatcctgtccacccctttagaagtgttcctcccctagttttttacgttttccccgagtcctagctatcatcgtccccgccgtcgtcaccgtcacgtcgccggtaatctgttttccctcttaaatgaattggttaatccaatgtcaattatctcccgtctaacctggccgttgtgtcctctctagtgctgccgtcgttgtcgatcttgccggaccgccgctgccgtcgtcgtgttccctcgccggttatgcttcccggtgagaacctccctcctgttttagggttttgtttccgttgttagccgtgtcgtcgtcgtagcccgtgccgtcctagaagctgctatgctgccgcgtggccgccgccgttgccgcgccgctgctcgccgccacgccattgctgccgctgcttgctgccgagccacgccgccgcttgccgagccgtgccgccgcttgccgatccgctgtcgtgcgcgccgctgcttgccaagctgctgtcgtgcgccgccaccgcttaccgagccgatgccgtgtgccgctgcttgctgccgagcctagccgccgctttgtgtcgccgtgtcgcagccgtgtgccacttaaacctactcgagttgtctagccgtaggtgcaaccctaggttcctaccggcctatcgtttgtcgtaccggggctttacaatgaactgtgtctagcctgctggtttagtagcagccattgttgagttgttcgaacaaggtgctcccctatggtttgttcgttcgtccgtcccgagtcgtcctttggtttagagccgttcagagccgctagttccgttcgccggtttcggttgatcatttgggtgatcccatgtgacgttaaattgactcgttgagtcggtatcttgtgaggctcgcttgccagtcaatccgtcctttgatcctatgttccttttgggcttaaatccctgtcaattgattaaggttttttccgtcaatagtaattaacacagagcaccttgtaaaattcataactaaataatctgagctccattttaacccattcaaattgcagtaaatttgttagaatgccaagaatccattaaaattggtttcttttgctgcttcagtagctttttagcttgtatttattgtgtgccttgtctgtcgttagactccagcagttctgtcgctccagtttattttgaagtggttgccgaggtcccgtcagctgaagagcaaggcaagtcatacaaatatcattgatcatattgagcctatttgcaaaaccctttctttttctctcaaaattgcattattttataatgtcatgtgagatggaatttacctgtaaactcagcctttgtttaccctgcttcattgatagcctgggttaataatttgactagatgattggtctaggattgcttagccatgcttagatcaactagctcacaatgggattcacaattttatagtccttatttttatgatgatgctatgccatcttggcatatggttaattaattaaaatatgatttacttggtgggtcctgagcacatgcatgatgatttatttggtggtcgtgcccatgataattaaggaccggttctcgggaatccctggaagatatacttaattatcgtgcccatgatttatttggtggtcgtgcccaaatgggctccatgctgtactcgtagtaaccaagccagatgggctccaggctgaatcttaagtataatcttttctaactagcgcaccattgggaagggtaagcgtgatggagtatggatggaccgggaggcactctatgctgcttccggatttacctaggcatgagtgagggctgcctgctcctggattttggagtgggagcgaaaccggaggtgggtgtgctggttagggatggttatatggagggttttgtcacgatttcctcctttgcagtatcgtggcagttgatgtgcactagggttcccgatcttccgaaaggttctgataaacaacgatttggacgcagtcgcgacacaaatcgatccggcttcttgaacgcgcacgctattgagccccgcaatcgcagcactacgtctcctctggttatcacccgtgtcgaaacgcggatgacctcgccgagaaggctaatccctgtttgccaatcgaagaacacaaacaagaacgagatagaaaaacaaccaaaattgcagatgaatgattaagctcacgagttggggtcttacaaaccgatctagcggcgaaactgttctcgacagattaatctaagcaaaacccgactctaaacgatgacggctactgaataaatgtgattagcgacatcctagggttgccctagggcgcacacccccttgggctaagcccatgacacaattacaaggcccaaaacccaaattagattcggactggatgaggtacgtggcttgttttgcagattcccgacagctcggtaggaattttgactgggaccaaaaccatctgaaagtagactccataagctttccaacaagtactcatgggccccgaaattccttctaaatcagcggctaggtacgtttgattttgatgctgtcaggaggcccgaatctgaatccaaaacgtgtacaacttgatctcttgtcttctatgggccaaaagtgatatggtgagctagaagtatacttggagaaggtcttggtttggtccccaatcaacttcttcaatcatccatgcattacttacgctcggtctcttttctttcacccaagcaagtacctctgcgaacgaaaacacacaaaactcaatgtgtagcaatgtttgttcaaatatataacaagtaaatctaatatagaacatatgcacctttggttgatcaatacataaggtggtcatggttatatctgaactagttgtatcctcatcatcatccctttcttgattggaaaccatcctcggtttcaccttgtaatggagcatactgtacttatctttgtctatcacaacatcctgtacggaacatttcttgatggccatatgattggatcctaaaatctttgtagtcgaaaaaccacaacattccccttcttg

SEQ ID NO: 79226 - DNA, 1700 bp, Oryza sativa
tttctagacgatattttcgttggttccattcaactataaataattaatatactaaggaaatgaccatcataatgatgttgacatgaaatcataaatactttctagttaaatttccattcaactaaaaataaattaagtggcttaaggaaataatattcttaataaatattgacatgaaattatattaacgttggtcaaatattatatcataccattaatttctttctagctaaacatcccgttggttccatttaactagaaataattttctaagtgatcaaataattgaccataattttccagcaatttaaatggctaagaaaactcataaataaatttctggaaataaataagacataaatggcgggcttaaaataataatgcggcccatcacttcctaagccggcccataaaaacaggctaaatacattttgagaaaattaaattcacgggcttaataataaattaaaataaaaggcccactcttattgaaaaggccagcccaaaatggaccggcctatttatgtgcacgatcggcccactctcaggcggatgcggccgagatcggcgtggcccattacggcgacggcccgacgcggaagcgaggacggccgtccgatcaaacggacggcttagattttgcccgcgccgaacaaatcgcatgccagggggaaatgggtgtgagccctaaccctagctcattcttctccccttctcttccctctcttcgacggctctctcaccctggcgagcgagcgagcagcggtccggcgaaggcggcgcacgcgtgcggcggcgagcgctgcagcggcttcatctcggccggctggggggcgcacccgtagggtggcgccaagccgtgtgccacggcatcgacggtccggcgaggcggcgcgcaagcgacggcgagcgtcgatgcggccggagctcgtcggggggggggggcggagctcgaaagcatccgccaagctgacgcttcccgtccctggcgagggatggtgtggagagacaagctccaagacggctgcgcacggggaacccgacacgaccgcgagaagctaaggtgcggcggtgccgcttcccgggaggctccggtggggttcaattccggtaagtcattcgaaatcaaaccctaaattgactctatattggatttaattcgggctttggtcttagggttcttagaaccgaaattagagttcttcgaattagggtttctaaggtgtggattttgggaatttcaatcttgtttatcccaaactcctcttttctgagctaaatagttggggaaaagtttgggaatttcaatctagtttatcccgtcttccccaattttcttcttaatccactgctagccgaagctcattcatgatgaaaaacttaatcatgtaagaacagtagattaatagaccttgcaataggccgagtagattaaaaaaaagttaattggtgattttcgatctgacttgaccaatcctcccctctaatatctggccgaagccatagcttcggtctgggaattcttagtgtgagagtttgggaatttcaatctcgtttatcccaatcctcattcttctcttaaattctactgctaagcaacgaaattaaattcttcaataactttgcttcttctactgttggccgagaccaacagtataacatggcttaatatgcaaccaagacttaaagaaattaatcta

SEQ ID NO: 79227 - DNA, 4190 bp, Oryza sativa
cgtgggatgaatcggattggaactagtgggtgcgattgcacgtggaatactagtaaaccgctacacttgtaatagtaagtctaacaagagttttagccttttgaatttatcccataacataacaatttttccaccaacactctcttatcaaccaatcataagtctctaccatttaatttctccatctatcttcccttctcaaccaatcacaaccttccaccatttaattttacctactttcttaataaccatttaactctaaaaaattcttatattatgagaggagagtagtattttattttctttgctaagtacttagcaactcctcagtttgaaaatataagcagtattaattttttatatggcctttgatcattaatttcttttataatgtatcaacaactacaatattaatattgcatgaaaatagtattaaatacaaatctaggtatactacttgcatgacactaagcattttgtttttagtttaattattagacatttttttaatattgactatgcgaaaaacaatgatgtcttatatttttcaaatggagggaatatatccaacgttcggacatcaaagcattaacaaatttaagaagttagtcttttcgtatcaaaacaagttaatttctaaagttcaaatttcaaaataagttgatttctatacccttatgtaacctcagtccataaatcaagaagttctatcatttcattacctttaggtacatcaccacccatactacttttctataacgaggagcactttagttaatttttctccttattgaagttgtctccggatgtgagggtagcatttactacatccgttctaaaaatttttctccttattagagactaaggttgagaagaaaagactttagcacctctcaataaataaggataagtggagttggaaagatgggtgggataagataggaagaaattcaaatggggggtgattggtgtaacaagtagtagtatgaattgtgctagaaacaaaattctagaagtttggagtattttggaacagtagttttaaattttctattgggaactttttatatcttagcattattctattgggccatttgcttaaatgaagaagttgttttaagttcggttcatgccaaactttaacaagatcccttccttctttaccatgtatgtgaagtttgctcatacgtaaaagtaaacttttcacaaattagctaaggccctattcggatttcgtgaggttggagcaattagccggttagcttacaagataagaaagtcaattaacgcatgattaattagtattaactattataaacttaaaaagtactgtttttagctttatgtaaaaaaaagacttgaaaagcatatatgcaataatctaagtaccaatagactgaagagagcgaggcataagattaattgagtattaataattaccagctcaaaaatatatttatttgactttttgaaaaactttttcaatataaaacatttacacaaacttctactctctcgtatttcacgggcacatttatcgaactttgttttttaaaaaaattctatagttactttaaaaaatcatattaatctattttcaagtttttttactaatacttaactcatcatgtgctaatgagccacggttggtatttcttaacatcacatatagaatacgcaagcgcacggaaaataccgatgtagcagttcacctgagagtattccaaggtatcgatttctacagggaatgtgtgtgtcagctcttcaccagattcgtccaatgatacaaagcaaagataggcaaagatagctcaatttgatcgtaacgcggtacttcagccactggccagccagctgctcccagatgtcgctctagtgcatacctggacagggagggattcagtgtaattgagggctgtcaccacctctacacccatctcagacctattgtgggatacgagaccaccatcagaaattaactctctaacaccatgtctacacaattaataactacttcagcgttagctaaacactaaagtaaccactatactttactggatcatagtggtcaatgatcccgcacgctaattaggaactaaccaagagataaatctcactgaataaatcataattactcagaatagtatttctattaaagcagagtaattaacagagtaaaagaaataagaagagaatttccgacttcctcttataattcctccgacttcctctactctactctctctctaattctagtatacaataaaatacaataaagtctcttataattcagctcaagcttgaagtgtgtgtgaaattgagtgaagtgatgtccttatatagacaggtaatgatggttacagaacgcgaaatgtttgaaatgcccgtaaccgtcatcaggagtgcatctggagcgaccacgccgaaccttagcctgaacggctgagattgtggttcagctgaaccaggcctggttcagccgaaccctggtctagcccaacaggcccataaattggtttgtatctcctttgcaacttgccttatccatttcttcgagagttgggcccattttccaatgttgaaatagacttttggagcccaacacttgcatgaaatagtctgaatttccttccaattttggtggtttattacctgcatccaaatatacacactcgtggaatatgttagaattaagcactaccactatgttagatgttttatttcctatgttttatgcaggtattggcggcataaaattggcatataactgccgccaatagccactccgttttgcgtatgcaggagagaagttctcaaacgtaccctttatcttcatccgagtcgtagaagcgaacgcaaccgtagccgctccggattgcagtgtagtactgtagtgtagtatttaaagagggtaccaaagttgagtgtagtaatgtactttggacagtgttaaaataaattcaatgcagaagttgatttaaaatatcaaatacatctatttttcaagtttgtaataattaaagctcaattaatcatacgttaatggttttctcattttacgtgtgttgacttcatctttatcttaatttatattaatccatcttaattactagctccatcaaaaaatgtacgtattttaaaggttgacacaggtactaagaaagtacgtggaaataattggagaaagtgtatgattggatgagaagagaaagttagtgaaggagaatgattgtgattggttgagacaaggagacaggtgataaaatagtttcattttagaaaaggtagcttgaataacatggatggaggtagtaattaagatagattaatacaaattaagattagaaagagttagtgcacgtaaaacaagaaaatcattagcgaataattaattgagttacaacttgaaaaataaatttatttgatatattaaatttcctttaacaattacaatgtttaatcgtttaaaaacgtactaattaaaaccaaagataaaatctactactccatccgttttagattataaaacgttttgattttggtgaaagtcaaaatactttaaatttgactaagtttatgcacaaatatagtaatatttataaataccaaattagtttcattaaatcaataattgaatatattttcataataaatttgtgttgagttgaaattattattatttttttctacaaacttggtaaaacttgaagcaatttaacttggaccaaagtcaaaacgtcttataacctaaaaacagagggagtatagccctgtttagttcctctaaaatgacaaaagttttgatgttttgaagcactttttgctacatggataagcactagtagcgcaatttgtcatttgtcatttgggagtttagggtagcaaattttgaaaaaaaaaacgttgggagtcgttctctctttctttactagtaaagtggcaaaactttaccctacatctaaggctctgtttagatgggactaaaattttccctatcacatcggatgtttggatactaattataaatattaaacgtagactattaataaaacccatacataatcttggactaattcgcgagacgaatctattgagcctaattaatacatgattagcctatgtgatgctacaggaaacattctctaattatggattaattaggcttaaaaaatttgtctcgcgaattagct

SEQ ID NO: 79228 - DNA, 2231 bp, Oryza sativa
gtactccaggacgtcctccgcgatgctggccttggcctcgccgccgccgcccgccgcggcggcggcgtacttgtccctggtggccgagccgtcgtcgaggaggtcgacggcgtggttgtacgcgtggttgacgctgtggaggtacttgacgcgctcgttctgggacttgaccgcctgcgtgatctgggcctcctcgttgttcctcagcaggagggccagcttcttcagctgggatacctccatcagcatcaccaggtcgcctccgtcccccattggtgccgccatcttcgagcttggatcaacgattcagaggacctgcaccaaattaagaaattcatgttattactgctactaataatgattatccataaatgctagctttggatcgttggccatgtcagtcttacacttccaacaactgttcaagggaggtgagagcccgaaactatttgagtcgatctacatcaagatgctcccaggcgacgtctatttatagttttaggctgctgtgttcgtgagtcgcataaaacgaatcgtgagtggaagttgggaaactctctccccaaacacataaaacggatcaataagatttttctaaagcaacttaattttgtatagaaattttttgtaaaagaaaagtaccgtttaatagctcgggaagcgtgcacgtgataaacgaggaatctgagctgggaaagcaacacaaccttaattatgctggaccagcgagcgcaccgcaaagatatggttaaatggaagggtactattatttttttttaatttggcaactactaattatgtcccttaattaattatatatataaatcgagaaaattcattgtgctctgaaatttgcattatgtataaattagtttggtgcaggtctaattttggtatagcttgtccactatgtagaaatttcatttagttggtgccaaagttagttgctagaatgtatgttttaactgtaataataattgacaactcttaatggacgatcctagcaaggtaattctttttgttacgctagtgccatggccgtgcattctaatgggatccgaagtaataagaacgaagagttttcatcggccgggttccttttttatccgctttttctgataggtcttgaaaggactggtttcggcaggatgtgttttttaggtcgggtgattcgatttatgtggagaagtacattaatagagggaaggaggagaatgacttgtttttttgcagtgtagcagagttcaatataaagggtttgtttggtaagactttaacccctaaatttaacccctggaaaatagtttagagtggagttgctttacccttctagcttttttaatgactcaagtccgctccacacccattttgatagaactaaaaccgtttggttgggttcaaaagagctggagctatagtccgaccaaacaggaaagaaaacctaacgttggcaaaacatttaatttaactatgcctggaagaaaaataatttgaatttttttacgagaataaaatatatttgaaaggaatcgttttttaagattccatgaaatgtagatattttggttcttacattctggtaaagatatttttgttgtgatttgtttaatgtctctctcccaacctgaataaaagtgtttagattcatgaggacgacatctattatgggtctataagtgaccccgtaagagatgtttgtgtcgggtcctcttataggcccgtcacatatgagttcttacctgtgacgggccatcccttcgagcctcatctacaatgagttctagttcatgctagtattcttcctgttcatctacatcgtatcagatgtagaggccgggtttaatatccattatctggtttcagctgtcgcggtagaaaccaagaatatgaataaatatataaacatatatatgtttctctttttgtgaatggtgttagaataattgggctaggcccaacttatcctattaaatctcaaaggcccgtaataagtgttgaggataataataccacctcaggatttaagcgaggaatatctcaacctaaatagggagttattggaggctccctgttgaccagttgaggtggggatcagaatgccacacgctcgcgcgcgcgccgggccgaggccgtggccgaggcgttgctggcggcgtgcgtgcgtcacgtcgctatccttttgcagtcactaacccacgttctcacgattaccttcgtaacagcgcgttcac

SEQ ID NO: 79229 - DNA, 792 bp, Oryza sativa
ccttgtgtttgtgatctgtgtgacttgccttgcaatattgggtctccaattaatcttcttgaacacttggggcgcacttgcgaaccttcgaaacgacggaaacgacaagctaaaacgcaaaacgaggaaaaagactaagaaactacaaataaacattacatataaagtaaacaaacatgtagatcataattttagatgaattatgagacttgaacagtctcattctgacttcatatgaattaattacgaattttacaagatttaatataattaaagcctatttaaaaaggactaaataaatttaattcaatttatggataattttaatatgtagatctttattttatacaacttttgcaacttgaaccacattaaaccgagttacaatgaattagttatgaatttttaaagattaaaccggattaaaacatttatatagattttaattgaattatgacgcaataatgaattatttttgaaaaggaaaagggaattattgcgtcagcgggctcggctcacggtggaccgggtgcacggggcggtctaaggaaacgaacggccgggatctaatcgattcaaaacgaacggccgagatcgatctaacccaacgcggtccatgggaaacggcgtcgatgacgtcagcggtgacgtcatcaccggcggcggctcggcctcgcatgctcgccggcgaacgacggcgaagcggctcaaacggagggtaccaacgcgtagagcttggctcggcgaactcaccagcggcttggacgacggcaaacgacgacggatgacgat

SEQ ID NO: 79230 - DNA, 2063 bp, Oryza sativa
  unsure (1)..(2063): unsure at all n locations
gctaactcattagctgccattcggtagggtctttttgcaattggagctgtgcctggtgccagttctatggcgaactcgatctctcggtctggtggattctgttaattctccggaaatcgtcgggggggaaaaattaaatttttttcccaaccccaaaagggaaaacnccctttaatggggcacccgactcccaaggaggtgacttgtaaacaggttaggatagaccgacttgcggtaggggtgttaggggtaaagcggacttgctttcctctaggtccttgcaaggtgatggacttttcggcacattctatctgtcctttgtgcttagccaaccaatccatccctagaatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttcagcttgaatgtgattcacacggcctcgaccaaagttgttggaagcacgtgaaccttgtccacttgcctgagagctaggacgagactgagttgccgctggagtaggagttctggcagtgctgccattagcatgccctgagttggtgttggtaggattctgaggacactgtctagcatagtgacccatctggttgcaccggaaacactgaactgctgacggtccctacggtgacttgaaagaggtaacgctgttaggcgcagtattgccactaggggcacgctgctgtggctgaggtgcccgaccggtttatctgaggacgaggggcgtagcctggcttgcggttagcctgagtgaccgactggtggtattgcatgggttgaccgtagcgaggcgagaggtgcgcctcgggaagaatttccctgatggttagacttgcgtttcttgtattcttcggtagcctctttcctggcatcctcaagtagaagtgcgttgttgatcatatgttgaaaagtggggaagtcatgagcaagcactggagtctcattccaactgcgattcctttcaagaatttcctgatcttcttcttgtctgtgtccacttcctcaggggcgtaccgagccaacttgttgaactgactttaggtactcatttgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcgtcttctcaacaggagtacactgcactaagttgagttttctatcaacatctttcaaccaatcgtcagcctcgacgggctcgacggtctgagagaactctggcggacgagacctcaaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatcctcaacaccaaagcgggctggtgcacgagctgcacggcggggacggctagccatctaaactcccagaagagggcggggtaagagtcagataagcactta

SEQ ID NO: 79231 - DNA, 622 bp, Oryza sativa
gcggaggtggtgcgccgccgacaggagctggatccggagccggagctggtgcgccaggaggtgccgtgaacgacaataacaacggaggcaattctgcctcaccatccagcggagggctattctcggggtataatcttctcctcctgttcctattgttagcgctattcctattcccattgttagcgctatcgctatactatgtgcgctatgttctttgttcctgttcttcatgatgcctctagcatgttattgcgttactgttatgttcctgttcctgacattcatgatgcgcatagtatgatactggttatgttaagatcactctacactgcttatgccatgattattgctttaacattttggattaaaatatgccgattaatgactatatttccaacaatccaaaaacctgataggtcattttcggtagttggctttgctgtgctctgaaaccacatgcttttgatggttcaaactataagagatggaaagcacgtgcactattgtggttgacagcgatgcagtgcttctatgtttcacggggcaaacgaagtgaaccacctctttctcctgaggaagaggtaagttcgaggcttcggattgcctgttccgtggagcattg

SEQ ID NO: 79232 - DNA, 2758 bp, Oryza sativa
ggctaactgggtgtgggtagggcgagtacactggtgagtacggcgcacgcgagctgggggagcgcgggccactgggagtgcgggcagagccgcgggagctgtgggaggacaggtggctggcgtggcaaaagcggcctgagtcccaagagatagtgtcaactgaggtgacaccctcctcggccagacgggcctccaaagcggcgtaactgcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccagaaaaggtcttggtacgcgatctgaagagtgggcctggccacagtgaagtggtgggggcgaaggccagctccgtgtatacctccacgggggtaaaggtacaccgagagctcacagtgaggggaacacggtccacggagtaccccgtgtactcgggacacgagaagccaaggaaacgggagaggtcacgaagctgagcgacgtggtgaccctcaccaaaaccgtgggaactgaagctggcgttcactgccatctacaattttgaaagagggagaaagatcagtacccgttttagaaccaaactattgaaaataaagaaaacaaaagaaaccttagcttttcgcaagtagttttgaacttagtatccttagggtcgtcctaagcgtcgggtttcgccctagggccaagcctgtgctctgataccacctcttgtcacgccccgaactagtcccgaccggatctagcccgtgacgctccaaattaacctgttaatcgataccagtcccaggaaatagtgctggtatcacaaggagacagagtatcacagcaacagaggtctctttattatagagtagaagtacagtcatgttgggctgcggacagatcccgagctcacaactgcattacaaaaggaaagcggaagccagtacttggaccaatcatcacaggcgcgacttgggaactaggccgaaaccctaaaactcatcgtagccgacttgctcctggaagaactcctcgtcagcaggatccacttcatcttcttcagcaactaggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgagcagtttgttaacctctgtagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggtgcaactgggtggttacaaggggccatggtataacaattaacaaaggaaggatcaaatgcaacaaattaggtaggtctgccaacctgccttacagacgggacaacagattaagtgtgatcctatcaatgcataatatttcgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagattattggatttttggtctaaaggaaaaaggatttatttaaatcctttttggaaaagaaaaagaaaagaagggagggagggaatatagacttttctcggacggctagggcgcgggccaagagaaatggagcggtctggccgagctaaatg

SEQ ID NO: 79233 - DNA, 16164 bp, Oryza sativa
acgactttctttatgagtatggagggagtacatgtttaaactcaatctaaagtagaataaattaaacatgtggtattattcttatttctttttagccccatccctggggaaacgtagaaggcgtgccccatcgcttttgtttgggtttgagttggacttgtcttatccatttttgcctttccacccaattttatttttctcattgaggtgtcaaatgtgtttggttggctggtttcaacttgtacgggtcccaattgatctccatctcgttatcatcgtcttatacagtggtattatactagtagtagtagcagcagttgaaaaggtgggtgaatcaattcgatcaatcttaccactactacagaaaaaagatcgaggcatctctccttttcttaaagttttctcttaggcactttgaaaaatgcatttgtcatctgtcagtaaaaaagtcaagacaagctcacctgtgccgtctatttgtcgctttttcatatttactttttgtatgtatgtattgtacacgttttttttccagtcctaaaaggagttgaaacttaatattgaacctgatttcttcaactgtatattgtcccctcttttccagaatttagaccacgtaaaatgtcttctttgaatagatgtcattatcatcatctcatgataatcattatggcattccaaaataaataatgcactcctatgaataaaatggagtgatattctctccgttttctaatatatggtgttgttaacttttggacatacgatttgatctttgtcttattaaaaatctagtataaatgtgaaagtcatttttaaaatatctttagtgacaaaacaaatcataataaatatatgatacttacatagagtactttataagacaaatgatcaaacatataactaaaagtaaacggcatcatatattgaaaaatagaaagagtagtaattatctgcacaatcgaataaccggaggacaatgccattttaggcaatctgttaatcccagcacaaatgtctaatgtgacttatttttcagagacatggatttcgtatgtatttttggacaaaagactcaaattagacatgtaattttaccctataccatatacttttactccaaagtataccctgtattcagatttaagtacacagctcgacctgacatatatttatctgagtttggatctcaagcagggtgcaaatacacaagttctttttgcaacagttcacatacagtacacaagcttgcactccatctaatctatagctaagaaattaccactagataattacatcagaacaagcttaaccataatgatactggcatgcaagtgcagggtgtctgtattgttcttgtcaattaatttgttctatctttcacctctctgctccggtgtgagcccttccttgccacagctaggacagctcttgagcccaaacccttggcaatcgaagcacctgaacacataataatcacacaacataaatactacatggttggttaatactacttcatttgctagttgatataaagacataagaaatgtaagagtaaacatatagcagaagcatgagtcatgaatggtgtataaataaacctacttccatctctcgaatatgttgccattcttcttgttccttccagtgccctgcatcagttgatcatttcagtcatcgaatcaaggcattcatacctagctcacttgtttgctttaatttgcagagatcatatatacttaccttgcaacctgggcattctacagctccctttcctctgcacgtcttgcaaccggcagagacctgcagtgcacaatacagctcattcagattcagagaacatgtagtgccagctgcttcccaaaaattgaagaaaagttaggagcaaatgtaattagaagctagtactgatcttcagtaagaccttcactttggctccaggtttggatgccatggttggtgccatcctcatcctcctcttgatcttgggtgaagtgaatgctgctgctgcaccagttgctgtgaaggtgatcagagaaagctccatgatgctatattgctatctatgctcctgaagctgaattcagagtggcaagaagaagatggagcccaaatagttaagcctaggaagaaagacagaacagggaaagaagaaagaaagaaagaaagcgacttgccgtttgaaggatttggagccacaaaacatccatagatgcaccagtattattaattctgtaccagattttgatgcatggtccatgtgttgtgaggcgttgtggccatatagtctggatagggatgcggctgcttggcccggatgggatcatcagccatctacagattcaggttccttgtatgcatgtgagtgtgctgctaagagccaagtggcactgatgagtgatggctcctagctctgaattgggcatctccatatatataactgcactgatgtactctacctgtcattgctggctctgcctctgcatgatgtatgtaaattcatgttgatgagtttttgattcagaaattcagttagccagcactgataattagctcaagaagtataacaaattcagcacttgtttcctttgagacttgagggctagcttcagcacctgcaggattgataatttatcagttgatattattaagtgtttacctcattagcttttaaaaggaggaaactggtttcatgtagttaaaaatcctacagattaatgtatttcaaggacaccaaaatctgctcctagaatatctgacaagaactccaatgtcagctagatcataacatgttagtaaaagcatccatatacaagcatcaattttttttctcggtgatcatattaagagttctgaacaatcgggttaacaagtagttcagtagcacacaaccaagcccgtcacatggaaaacatgttgcgacctcagctaagcaaacttataagtttaaaatcgcttataattgttaaaaattgcctatgactgttagattgtaaaatactatattttacacatgccacaaaaaggcgtaggttaactagctcactcaagtcttacttaacacggtatggctaattattctttacgtggtacacaacaaacccgtcaacattaaggttctcatgatgacttcgtcaataccaatatatgcccatttagtttttcagagaatgtatgtgcgcaagcgtctaaatttgtaatgtgtttatataaaaagtaacttctttttcacacaagagcaaattctaattaaaaaaaactagactgttacaggagctgtgtttagttccacgctaaaattgaaagtttgaagaaattggaacgatgtgacggaaaagttaaaagtttgaagaaaaaagttgaaatctaaacaagaccagagattgaaatgaaacctagaacaggataaggatacgagagttgaaccgaaaaataaaaaagaaaaatcagactcacctcacaagcttgatctgagccgtcggtatacaagatccaacggcgcagggcacaagctgtaggcctgtaccagtgcaccgagagttggggggatgattggtggcattaaatgcaatatctgagccgttgttttgtgcattggatggcccagattcgatgtaatgtcatcagtgcagttgcaaaagccctactactcctatacctatactacctagtactccttagagagagagaagagagaagagagagagagagagagagagagagagattgcaagggaagggaagggaggaagcggaagaagctttttttacccttcccacgagcattcaggggagagggtacgtgcaggagccaaggtccaacaaagcgatacctccttctcctcctcctcctcatcctcgtcatcagattcgccgcacgcgcacggtgaactcctccttccttcctgcatttcgattccctcttctttatcgcattatttcctgccctccattcttctatttcatgccctttctttctttctttctttctttctaataatcgatggcaagatcgatcaacctgttcgtggttttgggtaccactgccgatttcccccacaattccggggtaaaagaaccattttttggggggttattttttgggttaaagattccctttttgtatcacactgggggccataactgtgtgcaagtgctcacctgattttaactggtgaggtttgatcacctataagaccattttaatcgtttggatttagggcgtaatcggacaatgttgccttgttcagagataaaatttgtatcttttgtggttgagcgttgatttaccgaggggactgagttgtataacttttccatcctttttctgccctcgttatgttttgatcagattgattatgtaacggtggtctattgccctatcaacaatctcatttaaacgagcaaataaaagttcaatcaattatggcaatcagttacatatctgctgctgggagaagtaagggttgtaaccctttgtgggaaatggctgactattcataactattatgattatcaaattgttcattcgtctttctgttctccctgcctcactcactggtggcctggtggagtgaatgagtgagggtttactgccaatggtacatttcctttttccatgtaataatcccacattatcacccatttgaacagaaaaatacatataggaactctgctccagctagtcctccgcagaggataagtaaagggagaatttctcataacatatagctgatgcaaggattttgttcaaagtcaccttgtcaaaccatttttcacaatctagagaatatattgtttggttatttaaacatggctttcttgataaatatttgatgaaatgtcgcattgaattttgatccgtctaggcaaatgagtattcaagattgatctctctttaaaggctagcttatatatacatatatattctgcctgatgatcttttatttattttccctgatgactgattgatgtcggattatatctacagaagcagcgattgcataaaatgtgcatgcagctgcttccatgtgaaattctaagagaaatatgatcaccctctgcaataatcttactgcaacctatcttctgctgatgagtttgaagatgctttgccgtagttgttcgccagttgcaatatttgaataataataacagcaagaaataaccatcttattatcagttcttttcttccatttacatacttctattgtgattgacagatgcaggaagaattcgattggccaaccttagtgttatcaacatcaccagaaacagaaaatgttacctccagctctgtgagaagcacaaccaagaatgacgtggttattcagcaaggttccatctcttcatactggccatgtatgcatccggcagtttccaaataaatatattctagttgaggctgttttttgtacaccttgttttattctgtgaaaatctctgtctcattctgcaggggatgtcatgaaacttgaaaacgacacccattttctgtctcattcttcaggagatgggatgaaatgcacaaaggctgaccattttctatctcatgcaaacaggggttcattgaacttggtatggtacaaaactatctgttctactatcgttgatgggaacatttgaagggacatattgctgaaacataaatactgggatgggaatgggtcacagggtaaatatatggatacctatttgatccacactagttcaactaaatacacaacataaactagaaaaaaaaaagcaattttagttgatcagcttgcttgaattagagtggctcaatgggcacccatatattgacccactcccatccctaataaagaagttttgtaggtaaagaaataacaccctaatatactgtactaatcactcaatcagttcagcaattgatatagaatttcaagttgtttgcattatttcaaaattttagttcagttgaagttaacaataaaagcaaggaccaaactgtagccaagttggttggttggtcatgcaggtgtgcataccacccacctaggttaaatcttactccctctgtttttttatagatgatgccgttgacttttgacatgatgtttgaccgtttgtcctattcaaaaattttatataaatgtcagttattttgttgtgacatgttttctcattaaaaaactttaagaatgacttgtactttagcatatttacactatttttttggaataagacgagtcaatggcgtcatctattaaaaaatggaggtagtagatcaaaggcagggaggcaaagcagcaattatattcctttaattaattaggagtagctgctggatttttagccacacttcagagtttcacttgatttgaaacatgcccctttattcatcactattttttgaccaaaggctagaattgctctgcttctcattagaatcaatgtatatttacagtgagtgatgcaagttgtgaaaaatctttcctttgttagtagctgtaatcaatatattatagtaaataaaaccatcatccaggttcaatgtggtaattcaattgtgtttcaatgttaatatgcaatttatggataacatgcactgcattgaaacgtaaagctttgttcatcaggtgaccccttttttctttttgttttgttttgaaacaactcccttctcaggattatcaagaacaaccttcaaagtccaattttgctactgaccttggatcacatgcatattctaaggaagccaggacacttggaagagtatatcatgggcagcagccttacttttccccttcaagctgttcttgggaaaaatcttctgcattaaaagtagtgccaaatagtccagatgcatcagggcatatagtcggggaaatgagaaccaaaaccaacatcctcagtgcaaggtcaaattacctttcatatcctactgatgttcctcatataaggtatcgagatgaagttaaagttgatcttagccaagatgataattccaaacagtacagaagacctgatcaatttactgccttctcaaacttcaatggtcaatcttctgaacaccttgaggtacatctgttgattgtgttaatcataatagagttgttacttctatatacatctctctatctggcatcagtagaaaataattaagatcatttgaattcgggagtatttgaccgtgacaatttttttgttgaaacagacagccaaaggggcaaactacatggatgagatcactccaatttcacgtcaatggtgctttgataatagaggcccatcactaccaagagggctggtctatggtgatgagataccatcgctatcttctaagaagtgtaatggcaatgttgcatcatcatattcaagaatatgggattatagtgctgaaaccacatcagtcagacaatgctatggcgataaaatcccatcattgtctcaccattggcactaccgagataagatccccttgcattctggtcagtggtgccatgatgctgaggcacgcccattgtcgaactaccagcaaggtgcttcttatgggaatggtcgtttaagagataatatttccaggggtggtaggaatgagcaagtcaacattatctcaagcagacgtactatgacaaaacctagggtggctaacaaggttgtaagcagcaccgatcactacaagattaataaggataacctatggagaaattctgaggatataagggatcaagttcgtggcccccgggcaaataaattaaataattcttcaacatcatctatcaagaataatgccatccctcctttggtctgtagagatcaaattaatagaccagagttcacagttcagtatgagcatgcaaagttctttatgataaagtcatatagcgaagatgatgttcataaaggtatcaaatacaatgtttgggcaagcactccaaatggtaacaataagctggatgctgcttttcatgaagctcagattttaatgaaggagcagggcaaaaggtgccctatattcctattcttttcggtcagtaaggatgaaattctcttcttctaagtatcatccttattaagaaaaagtccacctaaaataacgctgagatatattatttggcgtcctagtacctgttgtgtttgatgcttaaatatgatagttaagtgagacatgccggtgctttttttagtgcatgtttgtttgtgtttagtttattgtcttctatttaggaaattgagatgattggctgttgtatcttcactcttcacttgcggacattttatgattttagttttcatcgtgaatgagtattcttaagaaaactatagtgattgatagccatggatccagcttctacagacaacctgctccagattttctttttgacttggttaattatttcaacaatacattgaatttcctttgagcttgtttgattaggagggattagattctgatatctttgtattgttaagatttcagtagaattacttgctcagtcataatccccaccgtctgaaagagctgattttacctgaaatattggtcacaatgtcctgccattagattgagtaatgggcttctctagaagatttgatccactggataccattcaccaaatatgcctgaagcattttttgtcttctttaagtccgttttatcatgtgacaaccaaaagctcttgaagcagctccatatctcgtctgttgtatggctatttttatcatatggttactacatgtgcctgaagcaattccttattatctgttttatgttttatcatctgtccaattttcaagatagttaattttattatgatccctttttttccaggttaataccagtgggcagtttgtaggattagctgagatgttaggtcctgttgatttcaagaagaccatggacttttggcagcaggataaatggaatggatttttccctgtaatgtggcacattataaaggacattccaaatcggttcttcaaacatataactcttgaaaataatgaaggcaaagtagttacttttagcagggacactcaggaggtaccatgcttgtagctttgttctgagacttttttttttgaaagggttcttatagttagaaatggaatactctcttttataatttgtttagtcgtagtctcttttatattggtacaatcaagaacatagaaactaaaaagtattccatatctttgaaaatgaaatggacacttaactattttaaattaggtgtctatatcaggttgccaggttttatttccagtcctctgaagaaaggtttccctttcagattatgaatattctacatgatgtcaaatgctgttattccatgctttgattttttttatccatttgtattgttgattcgtttttatccagcaaccttttgtccttctatgtagattgggctgccccagggtctggaaatgttgaagattttcaaggcatatcaccagggaacatcaattctggatgatttttatttttacgaagaaaaggaaaacatgcgccatgcccagaagggaagaaatttggaaacaaccaatcaagatttgttctctgatgacttcagatcaatatcagtggtatgtgctttctatttagatctttgttttgaatggctacttgataataattttaagacaagatgatacttttgttatgtaaatatatttacgaacaccatgggcattttgtgaacactgattgtggttgcttgccaagtccacatgtcattatgcagaagtgctcttgattagaacgaataatcttcaaacccttcttaacataacgctttaaggagaaacttcacggtttccagtctatctcaaggagagaattaacatgtatagatcctactgttggaaaccagatgatcctgaaccatgtcgtttaagtttcactatttcgaccaattaagatacatagagaaagtgaatatgaaaaaggactgttggaacttctctggatattgtgccggtttctgccacacatggtccgttgttgggctcattgctgcaaaaccaaaccattgtagcatgtattgtgaaatatcttctgatgtagatggcaactggagctaaagatcttgagagtttatgggtcaggaactcgggatagtttagatctctagtgtcctttggtcacttttttcttctgtggcgtgtctgttttaatggaatgtaggttgtgatgtactgtttgtttaatggaatgacacgcagctctcctgtacgttcgagaaaaaaagttagtcttctgatcctgcttatttccatttgtaggagaatttggaggccagcatgcagagcttgagtttctatgaaacttgggagtaatttagattgttctagtgtgcatccaaaatcagtaagttgacgagtcagtgaagcagctcaaggcttgaccctcctttgcaaaattgggttgatccaacgacgggataatacacagatgaatccaaacaattttaatgattatatatatatatagtattttgtgtagaaccacgtatgattgtgggtaaccttagaacaagatttgaacacactgaatgtttgtaatagttacttatctggtggctacagtgactttccatagactagatgaatttgacgaaactggcaagaacaaagcacaagtctgtaggcaataatgccatattatctgcgtgaacaatcatgttgatgaatgtgcatctcttctgatgtgtatgtgatgtcggtttccttcctgttgacatgagcgttaatgttaactaatgtactctgatcaccacgttgttcgttggtgttgatgacacagctacaagtttccatccacagagatactaccatgagattgtaccatagcccataggctttctgtgatcatcaattgaggagcaaaaacataatctagagacagtaaagaaaggtttgttgcagatttcctaggaagcattttgaattgcttgccatgaaccacaaatccacaattaaacgcaaattagcaaatgaatgctcatctcaatgaggtaccatggctgtgaagagcgaaacactaaaccaggtcgacgagaaggcttcagttttgactcaaatttagaaggaaatataacccaggcagacgcctgaatgcaatacgctgaatcatcatatatgcctctgaagatagattttgttcatacaggcgtccaggatggcccagcaaaatgttggcagggaccaatctcaatctgaggacatgacaaattataattgatatatacagcttcagaagcgttgtattggacagatcactctccacatcacggctacactaatttgatcggcgtccttggactcgacggaacgccgccaaacctgtcgaccataagcttgaaacaaggggtgaaaaccatgtacagcgcagcaagtgcgaacggtgcagcgatcagccacccgagcatctgtgatccgcattggcagtagaactcatgtcagtgtttcctcaaaggcaaagcaatggccatatcatcagctagatggataatagatgaagtttgtttactaaccgcatgcacaatgctgagcatcacatcctttgaggcctggccagtgataaccttcttgaatgcatctgaagtcaaagggaagtgtccactgcctgtgataacttctccgaaacgcaagaaagggacaatcaagctgaacaaaacataatcagtaatgaattagcaaagccaaacacatggaaaccaagtgaggaatctggcaaaatgacaaggtcaccagcagtggtaaatcaattcaaaggttgtcatgggtcataaatctacactgttgcactaggtaccgttagtcatttacagagaaaatatacatataaatgaaagtgcaaaggcaaagacctgaagtaaagcagttcatggatacatcagaaattgtaacatatccaaatattcatacagaaggcatcagatgcaagcaatgagcaacagcaaatgcatttacaaaagccataaatagctaataagaacacaaaaatggatttgggagtgtatgcacatgaggattataatatgtaaagatgcaaactgtaagcaagataataccagagtaccaaacaggggaactcaggctacacaaactcaaaagaaatcagatagcctggcctatcatagattcgtatcatagagcaaagcttgacatagaagatcaagcatctacagacgtctaagactattttatgatgcaaaagaccaccatactgttatgaacaaagtttggcgtatatacaaaagaacatgcaaagagatagcacaacaggaatgtggcttctcaataatttaatacaagtttaccttagctcaaggggagtaacaacgaaatttagaaccatgacagtaacagcattgcagctacttcccaacattgctattgcaactccacaaagaataacagtggtccctgcaatcatgaaagctcaagatgcatcatgttgttttgaggaatatatgacatgcttgccactttaccagtagctcagcaggcacgatgcttacaagttacaacttcatgccacacagtgaaaagtgttgacagtttcacttgcaggattatacacagacatgattgagcatcatcaccacagaaatattgtgaaactttttaactcggtagctactccacatcatatttacaagtgctcgagaatataaaacggatcctccaaacttctaagataacaaccagaattaatctttctagaaccagaacactattaccattgcatcgcaacaacactgaacttcgaatttcacaacagattaaatacacgtactctacatgtatctgtaatttaccaaaaaggattgtgtgctatttcttcaagaccatggagcaggaagtcattgtttcaagaataaaaaaaagttagtgccccagcttatcaaaagccacaatgaaactacacagcttaaatgcgcaaatttgtatctaatcataacctccttggctgtctaaggccacttaactcagttaatttggatatcttcttttgttcagttaaactatgagaaaaatctggtacaatgaagacatgctgaggcttgagaggctccttaccacatatcggaaagatcccaagggtgacaccaagagcagcagagaaagccagttgcttcggctcagctcccctgcacaacattacatgaaagttgtcagcaacgcaaggacaaaatgaaaacaaaccatttcgcgaagaagttaagcagatctagcccaagatgtgacaccggatggaagggggaaaacttaccttctaactacttgcattaggggatcgacgaccttgttctgtatccatggccaaacgccaatcctcgtgaaaaatgacattttcttggcaaacttttcaagaaaaagaagagtccagcaaaacgcaatagcctatctgttgcgggcaccaagaaaccagaacctgcaactttttatgatcaaatcgcgcggaacaaataaatgtctggccttgcagcatgaaacaatccaagaaacggtgaagtgcaactatccaacccaacttgtaggggtgaagtgcaactatccaacccaacttgtaggggaaggagacgaaggagggattggattggaagcgggggtgaacagggtgggtgtcttaaattggaagaaaggctccacctttgggtttggatttggattgcttgtgaacagggtgggtggcttaaatcggaagaaaggctccacctttgggtttggatttggattgcttgcgcgaaaaagatttttttttgcttggaaagatgggagcggaagagttgacgaaatcgagcgtgtgggcaacacctggcaagatctgacaaaaaaggtgactgaatctcttcctcaaatcaatcgaagaggaggtgaggtggggaagtagaattaatttaatggggaaaggcacttttacatattaacccctatctcctcaaatcaatcgaagaggaggtgaggtggggaagtagaattaatttaatggggaaaggcacttttacatattaacccctatctatctagttgatagtttttggaggtgaggtgggaaagtggaattaatttaatggagaaaggcacttttacatattaacccctatctatctagtttttggatattaaaatttcaagtaaattggtgttacatatgcataattaccattcccttagtatatactactccatttgtttggtttaatttaggtggactagcaaaatgcccgtgcattgcaacggatgaaaacaatacaattttaataattaatctgtcgcatggtaaatcatacatttcactcattgacatttaataaataatacgtgaaaatatttagaaatacatcaacatcattgtttattaataatatttttcctttaatgattttaacttacattttattatgttctcacttacatataaatttatatttttctttaattttaagtatgaatcgtacttaaaatttataaaaatattgaattaatattgtttctaacattttattgttattagattgtacttggcacatatcattttgcatttttattctaaactatagtttatttgaatttattaattacctaatttaaatatctatattattagtctaaattatttttaaaattaaaaacattaaaatattatagatatatcacaatgttttagggacgggaagacaaagtacgttcaatggtttcaatttataacctgataaagaaagaatgttaaattagattcatgcaagtggcacaaatgtcttttagaaaatttataacctgataaagaaaaaaaagttaaattagattaatgccaagtgtgacagtatgtcctttagaaaattttgtggaatgaaaatttcttataagaatataccttgataaaaagatattttgtgtgactatgagtagtttgtggtctagattcttcttaagaaatttatgtgagtttggatgagcacaaattatgtgagcttacatgtttcgttctaagggtgtttggatgaccaaattacatctgctataataaaaatggaaatcaaaattaacaacaagttggaagtaggtggagctgggcagaggcagatctaaccctgtttcggttgaacccccaaactttttgagggataacgcagaatacctgatgaggtacggtgtgggtagggaggggatgctcaccggcgagcgacgatgcggtggaagaattgaaggaggacgccgggcgccacctctgctcgcaggatggggatcggcgcaagcggcgggcgaggagacgaaattcgaggccgaggccgaggccggatgggatggattaggatgctcaccggcgagcgaatgcggcgggagcaggaggacgccggcgccacctctgctagatggagatcggcaggcgaggagacgggacgggacggattgcggaggcggaggtcgtgcagcgctctgctgccgcggtatgggtcatatgcacaggcccatgaggctggagttttttcatatcccaaaaaagttcatctaaggtcccttatcttgtcgttgagttttaacaggatcacttttaattgttgttgttgttcacgtggcggccgagtcagtgtagggcccccacaagccaaccagcaatcttctttcacctcactcccctctactcccatctcaacctaaacctccagggcattcgccaatgggtagggagaaggtgtcggtcggcgaggaaaagctcgacggcggaggccgccggctgacgtggctcccaacggccgggagcgctcacgtcatgaacgggttgcgcctcgatcgagccgaggatccctcacaccaaccccgcgttcttcctgctcttgggcggcacaaagccggcggctagacctcgatctgacgaatcagcaatggcgctagagcgagacagggtggcgcggcacgacggttggcgggggctcggtcaccgcgacgacaaacccgaggtgggggatcgttggcaatcgcgatgatgatggttgtgaggaaattcggcggcggtggttgaaagggaggagaggaagatcacgagcaatgcagaacgtggagcggactgtgggcgtgtgatgcgtatacagagatacaggagtggtaggtcgagacgagaaaattgatattataccatcttcgaaaaatgtggcttcgctaaaatacaactctcaaacgaatacaa

SEQ ID NO: 79234 - DNA, 35965 bp, Oryza sativa
aagcggggcacactgtcgtcgtccgccggctgtgcttctgcgatggaatggaggaaggggcggcgcagccatgtcggcgaggaggctcgtgggcgcgcgcgttctggcagatgaacaaggagaggctggctgttcggggaggatcgaggtggcgcgctggagcatcatctgcttcctcacagccgcgtgccgatcgatcgaggtgagtgaaggcgaggaagagcagctgcccgccgacggagaagagcagccgtgctgtccattctgattattcacacgaacgaagcctaccaaccctgaccaccttattgtctgaaacaagcccttgctctgtatcatcattgaatcgaatggggtaacaaaattctcttcagaagccttgcattgcatgcaaggaaatcaagaatgatgccatcaacttgaccatgctttgaaccaactggttggaattggatcaagcatctattgatgagctagttaaaatagcgttcaccaacttcatatgaagtctgttaacccttgttcttcgagaatgaatccttccgcgatccatctatttatcaaacgttgtttgttgatctcattatcttctggaatatattcaggtacagcaaacaagttctcaaatggtgaggaacatcatagtaactgagagataatatcattttcatgatatcaacatctgggtcctttgcaagcacgagaaggagccaaggagaatggtggcggtggctcaccggtgatgggaacaaagcaacgaaagaggggatgaaatctagagggggtattttggtcagctcatcaagaaaaacaaggtaaaattcatgtaatttgattaaaaaaaagagaggaagaaatggcattccagcaagttgtactggtttgaaaatggtgttttagcgaagccatattttaggatggcattctagtgaaacccaatcctgaagatagcacaatgtcaattccgtagatgcgatctagaccgttgcgtgagaaccgaaagaatgagtgatgactgaaatcatttgttgaactatggggtagatttgacgaattcaccatcgctggatggagagcgacgcggcagatagaaaaggcttggagaatcatatgctacatccagttttttttttcttgtgcaaacaagaaaaaaaatagtactccatccgtcttacaatataataacttttaattatatatcttgataaaaaaatatgcctagatttacatctaaaagttactataaccagcccgccattatgattaaaagataaacagcaagataagttgctataaccagccattatgctcaaaaggtactaaacagcaagaatgattgtctttctgtcatgactcataatgtggtcgagtcgagactcgagagcacgtacatgcacacacatttgatggcgttaagctgccgagtgtaagttacttgagcatttgtaccatgttacagggactttgttttctccagctcaacacaccaaatttactcaaataaatcaaattaaaacgcacacaaagaatgccagtaaactagattaggctagctttcttcgtccacgataatggtcgatcccgtgccgatcccaagctccatgagagaaaccgtgtcttcctcgaagaattgcggcatagggcaaccctgtcaaaatgcaaatcgatcagatcccagccgttccagcatgcaagtattttaccctacctagctttctgcctcttcttttcttttttttttcctttctcgacaacattttaatacatgagcaatgatcatacacagcacaaataatccatacctcttcctcaagatacagtctcagtttaacgtccttcagtttaaagaagctctcgcacaaagattttaactttccaacctataacatgcaaatcataggcaatttagccgtcgtagcaaaacaggagagcatgttatatcactatcagcaagttgccactaatatctcgcatgtgaaagctaaacataaccaacctgtgtttgagaggaaaggaaaggagaagattgaaaagatacaccaaacgaggtgagtcattaacacatgattaattgagtattaattatttcaaacttgaaaaattgattaatatgattttttaaagcaacttttctataaataatttttgtaaagcacacaccgtttagcagctcggaaagtgtgcatacgaaaaaagagaatcgtttttctctatctgctggtctcaaagactcaaccacgaaaaaaggacagctaataagtagtaataggacccaagaagtacttacagtagttgcaggaggcagcttctttgtcaatggttgcttctcacccatagatggccctacgcatttcaaggtgatacctgtgtgcaacggaggaaaagaaaaaatcacttcctcgcatgcataccatacaactctcttgccttaattatagttcaacattattacttataagcccagaagccattttttgaggaccagaagtccttgaactcggcttctcatcctcaataccatgaaaggctttcagctcagcaaatctgcattgacaaatcgttattgcctaagcataatccaattaataattggtgcgtcactatcatcaggtatctgtcccagcctagtcccagggaagttaaatttagcaaatgaagccaagcaacacaaatttggaagcgcgtgtaaacatcaagatagacatataatcctaattgttgaataacaggtataactgagatcatataggctggaattgactaggtagagcttttctagttagtaaggtcacagctcatgtggtgaaatcatttaagtaacaacatgtgtcctttgcagcaaaataatggcatatgtagtgaaaaatcctttggttatatcatggtcatgtggtgtcaaaaagtaaagaagggaaattggacaaccttacctagggtgcagccgtttgatctcttcaggatcatatgattcagcttttcccataacaaggcgaacatatctatgtttttgcatcaaaagtatcagatatcgtaattgtggtattccttcgagaaaagcaagacaatatagataagtgcaagaacactttctagaaaaccagaagaaaaattcaccgttggcatggataaacacacatgtaaataatggatggctagccatatacagaggccctatacatcataaaagaaggtaataaatttacagaagggattaactgaccgtatctctgcttcccttcgctcacgtggacttatctggatatggaaaagaaagatgaagtaacatatttgtacaacatacatgctcaagaaacatccagggactcaacatacctcactaccattcagtattttaacttttcctagtcgggcgataagcacaaatcgaggcacgccgcccttggcagggtcagctacaggattatcagaaagcctgacatcctttagaaaagtagatattagtattggcgtgctaagccataactaataaaaatacagtgtggtgtacatcataacattcttgtaaatctaagaatcgcagtgtatcaaaatcttgcagttctaactgttcaaacctcatagaaaaggaattgaacatcaatactaaatttcagaataataaacacaaaccattagaaagaaacttgcttactgttaaactcggaaagaggttaagtgaatccacagaaaggacctcatctatctggttagatcctgaggcatttgaaagtgatcattagcaagtcattttgaacttacttgaattaaaggcagttcttaaacagaaaatattatggaaaacatttcatggcgcatgatcaattttcccaaatagataacggaagccagatattacagaaaatatcttagattcgatattttgttatggaatagataagggaagccagatcacaaaaaatacctaagagaagaactcgtagtttttcaaaaggcaaaacagctgcatcgccaagagatcctagtggaggaggattggatggatatgttacatgttttagcatgttcttattcaaatggagctgttccaagctgccccaaaaaagaaggaaaaacatcaatatctacagttctgaaatgcagaagtaacattaacttaagacaaaagcttcagttatacatttgtaccttcttaagtaagatagtttcacaatttcatcccatgaatcaatgtgattgtcttctaaatttaagagtcgcagtgtatcgaaaccttgaacaatatttccaactggagtctagataagcggacacatgatagtttatagttagttcttcaaagctgtttcttaatgtacacaaagttgaagaaggaaaaccttgcactgcaagatttggaaggactacctattcaaatttccaaatggatcattttccagttagccaggggaaaacttttatgaggagtttctgttttactttggatgaataacagtaaatgaagcagtaggcataaaatgcatggcaaaaaaatgtacaagaagaaacgctaaccatcattgcttttatcctgttcgtcattagatggagttcactgagacatgaaaatgagactttaatcttttcaacctgttcacataaataaacatcaacttatactgtgattggcatcaataaatagaagcttcattgtgtcagccaaggggcataccagttcccatgttacaccacagtagttgagaaccaaaacacggatattcttgacagatgaactgtcagtaaagtcattctccatggtattgtttgtcaaatcaagaatttccagtgatgccagagcttcacacagagagaatatatcctgtgaaagaacaaaactgttcagccaaatgccaaaagaaacataacattagcatcaattgtgagaaaacataacaaaacaattgaaagttcaggatatcaagcaaatcgtgacctgtactgtcaagtgagtaaaagatgctaaatgtgctttcaacagaggtgaaaaagataagatggttggtgatgattacatagcttaccaacgcacatgaaaagtattaataatccaatacagggatataccacaagttttacttctaggtcaaaataacataaatttgaataaactccaagcttatgagtaatgaagttcaacagcacaatgtggcaccattgtaatgaagagcatacagccttttgctgtgcatgtttcaatttatgaagttttgtatgttatatccatactaattaaaaattgtgctaaccataatgttagtctcttgaggtacatacttgccactgagagagaagatttccagttaaatcaagctgtctgagatctgaaacgagcaaaactattgtcagtactcatcagaattcaggataaacataggccaagtatgcatgacagtcctgccagcaaatttctaatgaatgtttactagtaaaatcatccctccaatgctcagtgcctactaatggcctaagagaattcatgccattttcaaatagattatgtaatggtgatacaactgaattaggtcctaagggactagtcttaacccagaacctagatgctagaggtgagccaatacataatgtcatctttataggaaatatgagaatattgtagttgaaaatgacccagctgtggggtgaacacatatttagtttgctaaaggaaactttaataagaaaatgcagctaaaaggtatttcaactcagttattgtagatgccgacgttgttacagtcggtcagtacatcgagtctcaaatttacactcaaagaataaaaagtgacacaaatacgaagtactttaggttaccacccttttaattttgcatacgttaagaaactataaactctattccattatctcatttccaatgccaaaatatgcagtgaactaaatgctttagctgcagagcctccagtgacccaaccaaaatatatacattgtgttccctctaaggaaggtaacgtttccaatatataagatcaggaagcttgacatgtatcgctgggttgcaaaacaatcaaataaaagagatgatttaaggattaaaggatagtaagtacttggaaccaaattctttagttcatctcctggcccaattgagcttactcccatgtaggatacagatgcactggtcagatcattgaggtttttcagcttttcctcaactttgttcttgccaaccaattccactgacacgcgcttctgacttgatgagaagacatacatttcatctggacacaacaaaatgtttatatcgggtatcattataaatgtaaaaaggtgtatgcatattgcttttacaagcaacggaaaatcttctgcccttgaaacagggaaaagaaaacagagtagctggaaaatcttacgccaacccaccaatagcacatgattttgaaattttaacacgaggtgtcccatacatgctctcaagcaatgagcaactgtcaaattcaagaactagtacatatacacatgccaacatggatgcttgagcctaagttgtataatgcaacaaaaaaaatgtgtagccgatttctcgaatgctatttacaacgcatagaaggtagaaagtatgtactaggatgaattttagcaaaaaattaataagtggaatgggaaaaaaaaaagaaaaagaagctagctggtggaatgaagagcagcaagatttggatttggaagccgaggaatcgagggatgcggaccttgttcctccttggtgaattcctcgacacggtagcggttgcgtatggcgtcggggagcgtgatcccggcgctgagcgcggtggggcgcgcgaaggaggcggagcgttccccggcggcaacgaagtagcggcggccggcgagcgacccgtcatggcggccgccggcgccggcgtcccagtcgacgcccagccagtctccggggtggccgtcgacagggccgaggtaacgcacggtgccgacgcgggcggggtcgccggcggcgtgcacgcgctgtcccaagcggaaggcgacggcggccatggatgtcgtctcctactactactactacgaagtgaagtgaattgggagttgccgttcatttctttggcccatttagccccatcgcttcactattttgggctgtgggctggccttatccggccaaatttggaagttgcaactgggagagatgatttttttatcaccatcaatcaaaaaagaaaaaaaaatactctactactgtactagatgaaaacaaaacctttatatgtcaagctttcaccagctttacaatctttaactaataataatacaccattggtagcaataagtaaaaaagatctaccacaaccaaaccactttacattatcatacaaaatttcacaatatactgtatcatgcaagtttgtactagtattttctccgtcctaaaataaatatacatgaatatggacataaaaaaaagataaatatagtaattttgagtcacaaatcaagacagcctaactttaatttggactctgaagggaagaaattgactgtgcttagtcacctgtcaatgaaaagctcccagtcctttttgactcttaaaaattcctttttagccggcaaaccgaacccactttgttgtgagttgggagttcctgacttgggtttatggcctgataaaacggatgcgaccgcaccaagaaaagaagcaacctttttgttcgctttgcttccttggttagtttccaaggttgccttcttcttgtgatcctccttccacctgtctcttcctccccttcgctaaaaaacctcgcctttttagaattctagttagtttttcgtcctccaaatccgtcgagacccaacaacccaagaggacgccatgagcatcgagtagtaagttcccgactctccgccgccgcggccgtcgtctccaatttcccctctttgtgaaactgcgattaatggtgtttgcgttttctgatgcagcgattacctgttcaagctgctcctcatcggcgactcctccgtcggcaagtcctgcctcctcctccgatttgctgtaagaaagcctccatcttaatttcgctcggaaacttctcttctttatttcaatagagtagcacagttcggtgtttaattaacttctcgtcctgacaagttccggttcgtttgattcatgcaggacgattcgtacatcgacacttacatcagtaccatcggtgttgatttcgtcagtacaaatcttcctcttctcttgctattgatgaaccattgaattctgcagttgctatcatctaactgaatcaaatttcgttaatttgttagtgaatatgtcaccttttcagaaaatccgaaccattgaactcgatgggaagacagtgaagctacagattgtaagttcattcctcatcgagacaattctcttatgcgagttcagaccaatccattttttagataattgcacgattaattcatgcctgggatgcatgacttttgatgataatgcctagttctagaaactttggaactcaatctactatggattagggatgcttggcttgtatcctcccttagcattatcctgtcaaaacttgagtcataagttggttttcagttccttttcgccggaccggtgttttcagttcttactccctttgtttatactctctggatattctaaaacgtggtgctagttccaataatccaaaattgtaatcttagaggaatacaatgatagaaccatggtgatgggtgtaaaatttaagaattttgccatctgtgcagaatattcttgaatgaaacaacttgtccatgctttctgagttgttgacctgccattttcctcctattattgttgaagggagaatggacaggaaatggagcaattaccatgcaggcatgcattgacaattacccctaaactaatttgaggaactggactgttcagcaactttgtttttggagggaactggtacagttgataggagaggttttcaagatctagctaattaagaccacatagcttagagttatagtcagggagagcttatagttgggaccctaaagaaaagcttagagttgggacaatgtacttgccaagcagctgatttactgcatcagttcacatcagatttagattacacatgcttgccaagtagacatatatacataaacaattggaaattatggtcttaatgtttaattgtttggtgagtattgatgtatcaggacacacattgctttatgaaatatacctttatttgttcagccctcaaattattataatgatgttgtttctttttcagtgggacacagcaggtcaggaaaggttcaggacaataacaagcagttattaccggggagctcatggaatcattgtaagtcctattgagtttttgcagtttataagatctttaaaatcttaaactgatttttttagctgtactgtttttcttccgcgatgtagtactgaatgatttacgattgactgaataggtttacagtttacattggttgttattgaattgaatttcttccttctttctttttgcattatatgttgtgttctacttttcaagatctagacttccacgcatggagttaatacatcttacaatactttttcagattgtttatgatgtgacagacatggaaagcttcaataatgtgaagcagtggttgagtgagattgataggtatgccagtgacagtgtatgcaagcttctagttgggaacaagtgtgatttggttgacagtaaggttgttgatacagaagaagccaaggtaatttatagttttaaagaaatcataggaaatttctgcagtcatgctacacttagaatgtcatattcactgattgttgctgtcatcaacttatcagagatgtctgttgttagcatacatagatcaatgtagtatccattgagcttattgaagggatattgtcatattgtatccctggttgtgaaaatatttccagaaaccactatgtagcatgtaccttcttttgtagacctatatctttgtatgttcttggtatatatcttcctgaatgcattttcagtctctgctcttcaggactaaagactgaacatggtatcaactgactgaaatgttaatgtttaattgcaggcttttgcagagtcattagggatttcttttcttgagacaagtgcaaaggaatccatcaatgtggaggaagctttcttaaccatgtcgtcagacatcaagaaaaggtaggagtaatccatttgttgcacccttggagccttggaggcccatatttttccctagcttaattttgaacttctttctcaaattttgtcatgaacctttccatcctttgaaaggaaattccagttttgcactcgaccatgaaatttgatttcctaggctatgaccattctgaatattgcttctttatagctgatgaaagtttatgacaattatttgagggtgcaaatgaataaatttaatattagaaagttgaaatgttgatttaaaaaaattctaagaaatgctggtgaagaaagtttttaaagaaatggaaccatttaggaacttgggaaacgtgcccacgataatccataattcataagctgaaaataataggaccctcttcatgttgaataataaatgccgatgatgcagtttatgtaccttttgtactcctagttcctttccgtgcctttcaacaacaaacgaggggtctatgtctacctgactgactagtgaatttccttgccgtgcaacctctgcaggatggcaacccaacctgccgtggagaggaaaccaactgtccatattcacatgagaggccagcccattcaacagcagaacagcagcagtagctgctgctcatcatgaactcaacaagacgccgttcctgtcatggcactagccaaatgttggaggattcatttcgtcacaaggctggaaaaaaaagcattggattggatgatactttagcattagacaacatcatcatgcgtgcacaaagtgttcgttacttgccacagtttgtgatatcatcggtttgttaaaacagtttataagcctaaatttaatatatatgatgcatgatgttggaactgaacatcatgatgcttgatgcaagcttgtcactcttgtcatttgctggtgtttggaggcttgtcagtttctgcttattagcaggatgttgactgatgcaaccctgaaaaaatggacaagagtaatgcaggaggaaccaatgatcttgacatgatactactgtatatgtagtaattaactgctttaggtaatatatgactgtcaggtatagcaaggtaaatatttatctgacaaaatgaatcaacgaagctttaataaacttaaaaagaaagaacaatcacaagcaccacacaaggtacacgaaatgacatctgaaactgaaggattcgttctaagttgagcagcattgcttcttttcactattggcatcaccggcagcgacattgatcgtcttcccttctttgacacctccagcggcacctgccccgccttcatctgatgccacgggcttcttgctgatggccctgtaaatgtcaccgagaatcagctggaatgcctcctccacatttgtggcctcaagagctgaagtctcaatgtaggacagcccttctgcctcagcaaacttgtgcgcatcgtctgtcgcgacggcccgaaggtgcttcagatcagtcttgttgccgacgagcatgattctgatgtttgcatcagcgtggtcgcggagctccttgagccaccggctgatgttgtcaaaggttgtgggcttgctcacgtcgtagaccaggactgctcctagagctccacggtagtaagcgctggtgatagctctgtatcgctcttgacctgcggtgtcccagatctgcgccttgattatcttgccctccacctacatcaagtcaaagatttcatgcaaatggatcagtttcaatttttccaacgctaatgcatttgtttacattcaatagagagaactagtgttcagtaactatccaaaaaagataaaattgggaggagaggccataatttggaacttggaaagaatctgaactggctgatgagttgaaggccaaactccaaataagcatgacgcatatggcactggaagtttattactttatcatggtaagttcattagagggtgctatcccaaagtgtacaatttagtacaatctgactagaactgcagactattatatcttcaaagtatcatagagcatggtgtcacaattctctgtgttggtccattttcaatttcttggtcggtatataacaagtgtgtgctgattgtcattagcatttagcagcttaagcctcgcagctagacactgtcaagcctagcaggtacaacaagaaagaaagaaagaaactttaagaggttattaatattactgtggaaagtattacttttgttaaaaggaaattaaactattactgtggacagaggtactagtagctgtcaggcagttgctaagccaggtacagaattgagtgtgacagtgagatgaacgagtagtaaaggtggtggcgcagttgggattatggcctatcaggatatcacaatcaagccattggatcccataaggcacacacgcagctggcacctcgtcatcgcccacatgtatgtggatgagcgctccgctcacacactgttgttattttttaagcaggagctgcagcaacttgttactcctatctccatattattatgtatgtatgtattgagttcctcctctggtttttttttttaaaaaaaaagaagaagaagaagaagaaagaaactgttttctgtgtgttaaacgaaattagtggagtaaaatgatgcaagtagtggagtggcgaggtagatgtggaattgatgaaattggtgatagtagatcatggttgagcagaagcatgtgtggtagatctaggtagcaaagctcacgttttttttagcaggagaaaaaagcagaatgcgacagagaggggattgcagattggatccctgatctggatttgtcaaaataaaaaagaattgctggttgaagagaaagatcggatctaaggtagaggaggggttgcttgcagaaaatggtagatcgcgcgaggagaaagaggaattgaattgattgagaaaggaattacgaagcagctagggtagctagagctagtggtaagtacagtaagcaggaaggaaggagatgaaagatggacatacatggagggtgcgggtggcgaactcgacgccgatggtggacttggactcgaggcagaactcgttgcgggtgaaacgggagaggaggttggacttgccgacgccggagtcgccgatgagaaccaccttgaacaggtagtcgtactcctcctccgcacgccgcgtccccgccatctatccaattcccttcctcccttctcttctgctactgctacttctttctactgcctcttcttcacttcctcctcaacaacaacaactcaactctcaataaagccagctcactctagtctagtgggagactcactcctagatgacttcccagccgaatcaaccacctgtctccaccgttccttccccttcgcgattcgtgctccttgcttgccttcacggcaattcttacatatcacatctaccctatagttcaacaagttgttttactcattcatcgtgtgacacatccaacgatccaaaaccaacagatgaagttgatccgacggctccgatcgattagaaatcgcgcacctccctctgttccctatcagcatcgtgcaaaacgctaccccacccggctcgtagggcgctgatcgcgcaactcctaatctcctctcgcatgcgatcgatcctccgccctcccgtacgcattacggccgactcccgacgcctccgcttcggccaatcgacgccgtcatcctctctcgcctcgcgcgccgtcatccttgccgataggattataaccgggcatcggcgtctgtctcgctgccgtcaccccgcgccgacgggtgtggcactgtggcgtcctgaccgtattcacagttcctcaccacctggatggccgagaaggaggggatcatgatcgaccaggtcggctgcactggttgaattacctccagcctgacgtgtgacgtcaagcactgcaacttcagcgccaaggagcagctgcagaacctctttggtattcaatcctgccgatcccctacctccgtgtcctgggtttcttgagacagttaaattctagcaggggctctagcaatttgcaacttgatatcgtagtaatatatgattgttttttgtttattttacaattatttaaagaaacctgatggattttcttctgtatatataggtgagatgagaattttaaccaagctgattggatatatatcttttcactgcttatgagtggaaaagatagcattacagttcaataatttgcaatgcaaaaattataaatatagcttctcaggataactagaatgtcatattgtgataacaatgctgaaatttctttcaacggagtaagtagtgtgcctattgattgtctgcttttccctgactttcctgaaaaatactgatacgaacttatggctaattctgatattgataccatgatatgtctgcactaccaaagtaccaattcctgatgagtgcacactaattttgaggaaaacgattgcagttccaactaaaattagcttattattatttgttgagtgcattatcataactggttagtctcttctgacagttcaattcaaatgtatatccagattgacctgattcagggttgggcatgcaatgatggtcctgtgactacccgaaggtatttatttctttaccgtgtttcttctttcttctgattgttagccacttctattttgtagcaatctacaataccggagctaattgccactactcttgagaaatgcaaattaagcctcatactgcaagatgctgtaaggcatcgttaatagatagagaatctactcagaacattctccattttgatgtttgcatgcagattgatccttgagaaatgccatgcactataagatgattatatagaaattttggatatttttaagataaatttgcaatataacattgctatggtcatctgatatcattcttatgaaatgttttattttagttatttgtccagctgagcctaaaaaacatgattgagaagcatccgcggaatcaatcgtattatgcaggataaacataatattttctcctgcaatgtagaagaacctccccaaagggctctatgtatttgctctactcattggactaattggagatctttttgatttttcttcagagcacaatcaaacaacatgatgtaagcgccataaagttgacagacttttggccacagcgagaaagggcaccgacaaaaccattgggttgatggtcgaaggtggccagtgccttcgtaggtgagagaaatatggatttgccgatttgcaaaaaagatagtagtgttgctccttctaatggtgaccaggtcatgtgaacaggacaaaataaaagggaaaatgtgtttgatgggaggtgaataggaattgctaattatttatgatttataagaaaaatggtaaacttcttattgtaaataatgaattctattgtaaacgagatataaatcaaacattggatggtgatggatggtgtggacttttatgtctactcactgattatcaaagttgtacattaggaattacatggtttcagaagatggaacagttataatatcattatttttctaaaaaactaaacctatctcattttatgcttgatagccaaaacatataattctcttgattgtttgatttgcattaataaatactaccgtaacgttagtacgagcatattactagtatactatagttgataaaatacagtgataataaatttagcatgcatcatcatatgaagctgacacttgtaaataaatatgacagcttcaaaagtatcctcatgtgaaatttgattctaagacaaacaaacttaggccctgtttaagaccctgtttagatgggattaaaaccttttaatctctattgcatcggatgtttggtcactaattataaatattaaacgtagactattaataaaacccattctataaccctggactaattcgcgagacgaatctattgagcctaattaatccattattaggctatgtgatgctacattaaacacacgctaattatagattaattaggcttaaaaaatttgtcacatgaattaactctcatttatgtaattagttttataagtaatctatatttaatactccaaattcatccgatatgacagggactaaagtttactccctggatctaaacaccacctaaatcccacctcaaaatttttcaccctatcatatcgaacgtttaaacatctgtatgaagtattaaataaatgctaaaaatataactaattgcacaaattgcgactaatttgcgagacgaatcttttaagcctaattacttcatgatttgacaatatggtgctacagtaaacattggctaatgatgaattgattaggcttaataaattcgtctcgcagtttacaaatgtattccgtaatttgttttattattagactacatttaatactttaaatgtgtgtccgtatatccgatataacacgccaaaactttacgctactggatctaaacacccccttagcataagattttgacatatcataattcgtagtgtttctatttagttattatgataatcttatattagatctgtttattttggaacgaatacaatacttgccttagagatacgtcgctccaaaattgtgatgtcagaataaaatgctatgtacgtaaatctatgtcttttagctattctcttcttccacaccaagtcacgactcacgactcagatgttacatacgattgatgtatggatttcactaattcactgccttctataaggtgtgggagaaaatattgcactcctttatataatattttctctgccttaaaatattacaatcaagatgccatttgatctatcctacttccatccagattcgttagattgcaacattttggagcaggggtcaacaaaccaagctatcagaaaccgttacccaaaccgccgagatagttaatttgacatgagagacatttatggttgagagatgtgattcaatcggaatcaaaatgttgagggagatataatagacttattcgtatacatagacattcgtgcaaggagatcatggcctttcttttcagcctgctggctgcttaatctaccgggctttctttcattcattccgtattataaactattttgagtttgtcctaaattgatatttttataaccgagtttaatgtatatttaattaaactaatttgatactctaaatattgctacgtttccttataaacttatcaaactttaaaattaattgacctaggataaacttatagtaatccctccctcacaaaaataagttcattctttttactaattttttaagactgcatgtaaattttcactacccggctttttaagaaagcctgaaacataacagagtcttgcatgaaaacaaactgaaaaggaaaacgaaaacacatcagtaacgctgcccatctccacgcaaggagaaccaaagagtaaacagcaaaaaacctctcctcccagtacaccagtcaacaacagcactatccaatccccaagtcatctggcaaaacatctctaggcccaagttgtgccatctattccattagcttagctttttaacaacgttgttcagcggagcacaatctccttccagcgttgcatcgtacacgacctgcaaaacagatttaggtaatttatcttcaactaaagctcccaacaaagacttgcaatcagaccaacttcacccccccccaccctcaaaaaaaaacttttgcttaactattctaacaccatcccaaaaatcctaatgtgattattcattttctttatctactctcgatatatttatcttctatttttataaactccgatacaattactgttcaacaacgaacttattctagaataaacaggaggggctaaaaatgatcctgttgtgagatggagcggtactgtgcaacggaaggattaataaaccggatggaattggatatacacacgcgtgtggatatattctggcatggtaggcctctcgcgtaaatttatgattgcaacatctaattaacacatgggtagaacatgcatgtatatgcattaataacaagttggaagcagctatccgatcgctagctggtttcttgattggcacatactatatgatgatgggttgatatatgatcgatgataggtgaaaataacttgcaactgatccatcgatcgggattctcccttataaaaaaacctattcatcgatcaatccatcgagaatcgagatgatgatgaccgggtggattatataccgtcaacacaaatataaaatcgttcgtacgaaggagcgcacactaattcctattaacgtatatgctcagactctagctcctttaaagattggctacatcattaattagtggtaggcgagtgacaatcggtgatttggtttagtggatacatcatatatgcatcgatcatttttagacatgcaaggcatattaattatatatataaatattaatacatcatattttaaatatagtaacttttgattatgaattaattaatcacataattatttattagatttatagctaaaattatttgtatgtcgaaacggagaggagtactatattatcatgatggatcgtcaacatgcacctctcactctcgggctattgtctgttcatccaccatatacgtacgcgtatccatatatttatatggtcgatcaatcacgcatattttacacacgccgcctactgatcgatcgatctctctgtctctttcacagggacgatacaaacacgttagcgacccaataaacaaaggaaaacacagtgcatatatataatttgcatcgatcgggattcgggaccaaacatcatcatatccatgagatgagtggccagagcgcggaaacaggggacgagccgaggccaggcaacctcaaatattagtctctctatctcagatattagtatcattttttctcatgtcataatataaagtatatactccttctggttatatattaattgacgttttggataaagttgagattaaacttttataactttgaccatcaataactttaaaaatatttagtttaaagaaactagaaaaacatatatagatttttctttcaaaacactataataaaaataaatatgcatttatttattatatatattataatagaaaaataaggtcaaatgtatatcttgtagagcgtgtcattgtctaaagtgtcaattaaaatgaaaccggagggagtagctattatctctttattctttaaatttgatttattttaaatcctctaccattaaaccccaatcatattacttgtatgtacgcatgtgatctaattaaggaggtaattaaattctttgttggtcttcatgttagaagtggttgagctttatattttgggatgtaggtagtagtgtattagatccctccatatctttaggtctaaatactgactccgccattttgagtaagtggcttgtttgtccatcatcacacattgatcggagagtggattttaaactcttgagggaacgccccctcattgtttacatgttactgaaatagttataaaaaaattaagaagatatattaatatatgatatatcactccacaacatatacaagttaaaattttaacttgtgttcgctaaaaaaagttaaaatttaacttgtacatgtcacaaacgaaaaaaaattgactataaatatacgttaattagttctaatttattttctttttttattgtgatatgtagaagttgaatttgaacttgtatgctgtatgtttgtggagtgacatattacatattaatacatcttttaattttttaaaaaaattaataactattcgattaacatgcaaataacgagaggatatcccctttagagtttagaatagtttctccattgatcgacatatgtcaaaaaaatataacaaaacccaatctacaaagatgctcctcctacccggccgatagaggttgtgtttgtatattaattagtttataggtgtgagtgtacaaattagtatggacatacatgcagggagtggatcggagagatatatagatagcaaaacatgaaaatcgattagatggtggtatcgatgtatatatagagacatgtgttgtatggtgaagtaggtagtgggctccacaattacgcgcgcactgcagggcagctatactatatatgcatgcaggatgcagctgaggccgggcttgagctcaccgtcgacactaacaaaacaaaagaaagcaatcaagaagctatataggtatgggcagcgccggcgtggaggatgcagcggcggtggcggcgttcctggagcggtgcgcgccgtcgggagacgcggcctacggcgagctcaaggcggtgctggggcgcctccacgagccgaccactcgccgcgccgcccgcgccttcctgacggcgctccggcctttctgctccagcggcgactcgctggcgcgctacggattccgcatccacgacctctccctcctccactgcgcccacgaccaccaattctcaggtactccgatgcatccatccatcaattggagtaattagctagctagtcagtcttttgctcgatcgatcgatccatcatctgcatgcatgactgcatcgatcgatcgttcatgcacctccatcggtattaatttttagttactccaatcctaagtagtagtagtagtagtagtagtagtaattagtaaagtaattaaattgactgcctgcgcctaggcctgaggagctagctactatatccatggatcgatcagagtcaactgaactaatataacgtccggcctgttcgtcatcggtccatctctcctctcatttcatctacttcttcttcttcttcttaaaaaaaaaaccaaaacaataagctagcaaacggtccttgtcgatcacttgtacatcatctcaaaagtctgaataatgcagagcgcgcgacggcgacatccgaccaatcacagacatatgcaacttgttgacaaattaacattctacaaggaattaaggcatcgttcgatcatcacaaataataccaaagctagctatagtgtactcactttctagctagccatacatatatatactactgtagtgtacatctatagatcgacatgacaatgcaattagtccctgccatggaatttcaattgcgtgccgtccagtcatctccaacgtactccgatccatccttcgatcagcgaatatttactaccatacctgtcggcccacaaggatccaatcgatccatggaatcatcgatcgatcatgcatatatgtattccacatattatatatggaattgacacatgtctttttctctctcttgtctgccccttatggccttatcaccccccccctccgatccacccatatcatttgtcggtccgtggattattccaaaaacatactagtaaaagattaagaggaaacgctagctatgactagcatcatatatattcatatgtaggagctaccgtacgttccacacatgcaagaaattaaggtcctgtttggtgaagcgtctcgtatccattgctactttcagaatctttagctcccaccatttatattttttttagataagtaccatttatattttgggacttagcagccagaaaaatgtgaagctcaagcatctttacattctctctgtagctaattatactcaccccagcttcccagattaatagagcataaggtaggtccatcaatgattgtgcctagttgatcatacattaattcaatcctcgaatatgtggtttggttttgacttaaaaagttgcagcaacacttaaggatagacaagtagggcatgctacatagttggctttgtagagagatgggggtgactatggtacaattttatcgatatttcaacaatttgaactcgatgttttagacgtgactacatgttggacgttcaatttgtgaaaaaaaaaacatcaggcttgaatttaaacaccgacaaaatttcataaaaatgaatattaaaatggttaaacacaatccaatcacatttaaaacattttctctctaacacacgaaacatcgggtttcattgttgaaacattaatttataaaaaaaaactagaatattagggaaagacctaatatcaaataattaggaggggtgaggctttgaacccaggtcgtttagcccaccaccttatgaagctagccggaagactcctgggcatttctcaaaacattaatttatagatccacgtgattaaagatgaaaaggtaagaaacaccatcaaaatcctgttgcagatttttttatctaactcatgaaacatcaagtcaaaatagtcgaaacataaaaaattcacaaaaagtattgatttatatatggattcttacttcattccgagcagtggccaacgcctgccatgactaaggtggaaaataaggagaaggaattgacaagcactcatgaaatagggaggaaattaattaaaaaacgatgtgaaaaggatagagtgccgtgtcgatgtgagataaatggatttacgttgggaatgggtggcatggcgttagatttttattccaaaaccatgtaccggttagaaacattccccatgattatcccatatattttaaactttttaacgtagatgggttttatttctattttataattataatcatataggatatttgaacgagcaacacatacgaatttatcaaacacagagcaaagaaaaatgtgcagtaagtattttagctaaacaaacagttatatggtgcattcatgccacacatatatgtagcatactttttttttccaattagaaaaaaaaccgagaaaagtgtatttccccatgttatttagtaatatatctttcagcttcaatggagcaagtcttcgagaagatccaatatacctcgcactcatcagaataagtggtgcttaacgtggttagagagctgaggaaaaaaacaataaatcaacatagcaacaagttagcattcatgttcaaaaaggaagaaaaaaccaccaagttggcacctttgaagatttcacctaacccacaaaggccacagccatgagtttcttccaccttcccttttattttggagaactttacagccaaaagcaattgagaataatttgatagggaccaaagaagactactcatgatctactaatagaagtattgaatttaaaaatataaagtttttcaaaaaaaaccctaatagtaatacctttgagaaaataaaaaagaggaaaagaaataatgagaacaacctcatcttttcgcttatacttatacttataagccaaaatttgaatttttaactttaaatttagagttgttttaggctttttgattacaatttattttccaatctttacttttaaatcactataagaacacgtatataaaaattttaatcctaaattattttttatttgtaaatatattgtttagctttttttttcttaaatataagccaaacgatgatcctataaaagtgtaacagaatcgggagtatatactctactcctactcgtacgagaaaagagaagagaagagaaattacggtagtacccctgtctccttcgtcactggccacggcggtatataactccctccgacctccccgccaatttttccgcctgttttagttttcctcctttccacatctcatccatcgattcatccgatccgactccgacctaaccaatccaatggccgccgccgccgaggtggagtccttcctggcgacgtgcgcggcctccggcgacgcggcgtacggcgcagccaaggccgtgctcgagcgcctccaggaccccgcctcccgccccgacgcccgccgcctcctcggcgccgtccgccgccgcttcgccggccccgccgccggggaggaatgcttccgcaccttccacttccgcatccacgacgtcgtcctcgatccccacctccgaggtatatatccaccatctccactcccgcccttccccctcgcggattcaggggtttaggagaacccttcggatgtcttgtcatgtcacccgcccttgcttacttggttgctcgcagattcctccatctgcttctcaataatttttttacagtttggtaactaaatacctttcacgatttactactactctatttgctagtaatttggattcttgctaaaatcttttcttggctgcttggctaattgagtaattcggaactgctatttggtagttggtactactagtagttagttgctagtaatggttttgtcaccactcgcaactgaccagccaagcaagtatgctatcaccacatatagtgagcctctgcctcccatggtaaagaaaagggataacctagattggaatcaacaactgtgctgtgcacactgttctttataaatgacaattgtatactgttggttctggccaaattgcttaccacgtgtgatgctgctgtaagcatttcaaggatgcatgtgctaggacagatttgacccatatgttcagtttctgggaacaattcgtgtggctacttggataatttatgccttctgtttgcctcattaaaataaagacccaccaatccacaatgctctgcctgtacctttttccttttttctcttttcaatttttatttctgctgaaggttattcaccttttctaatttattccttggcagaactacctttgcccaacttatcatcatatggacaaaagcatggcatatgagcctggttcttaacttatctcataacaacaaagttaggacacaagtcaaccaaccatattattataactagtagtaatattggacagcgtagtagtctttaaatctgagcaatttcctagattgtctcattgtctggagtatggacctgacatgaatcctcttctatcgttttgtcattgttatatttatgtgtgttggctcaatggtaaaaccttcctatttttttataccaatacattacccctttttatcccctcttgtatggtatttattgtttggtttccataacttacaaatttatcaactgtttataggattccagcagaggaagaagctaacgatgatggaaatacctagcattttcattcctgaagactggtccttcactttctatgagggcctcaatcggcatccagattccattttcagggataagacagtagctgagctgggatgtggcaatggttggatatccattgcacttgcagaaaagtggtccccttcgaaggttggcatctctttcctgtgtacatttttaattcattgctactgtacagaggtgggagctacagcacttagacatttactaagtcacaagatatgagttttgctaatccaatgatggtctaccttgatttggtacgtctagaaacaactattgaaagtaaggcactgctctataccacagaactgtttcagtcttggtaaaatgttggcgtcctttgagaatgaatagtaaggaaaactaacatgtcatttgatattttaaactgcatgtaccactgtatctaattaattagcacttgctctatgttacctcacttgttcaacctttttttttttttgccacaatccaagctgagcattgcttgtttcttttgaaggtctatggactggatataaacccaagagctgtcaagattgcatggataaacctttacttgaatgcactagatgacgatggtctcccaatctacgacggggaggggaaaacattgctggatagagtagaattctatgaatctgatcttctctcttactgcagagacaataaaattgaacttgatcgcattgttggatgcataccacaggtacagtcatgctaatatattcttttttgaaaggaaattatagtaaaccagacggaaggaaaactcttactccccaaatcctcccttttcagattcttaacccaaatccagaagcaatgtcaaagatcgtaactgaaaattccagtgaggagttcttgtattcattgagtaactactgtgctcttcaggtaaactgaagaatattttcagtatattcacctcagtgaaaatgaataaatatgcatgaaatataatccattcaatttatctaataacaatggtgaattatctccaagctattggaatataggaccaaggcgtgaacttctacacttgatagatcttcatattctttaaccccagtaatccactgcttgttatcttagtgcacaccttattgcatccagggttttgttgaggaccaatttggccttgggttgattgctcgggctgttgaagaagggatatcagtcataaagcctatgggtattatgatatttaacatgggtggtcgaccaggacaaggtgtctgcgaacgactatttcgacgccgtggatttcggatcacaaaactgtggcaaacaaaaattatgcaggtagtgatgctgttatgaatcagatgctggtattatgcaggtgtctttcatgctgacattatgggctggtttggtcaagaaattgtactttatgtttcacaatatcttttactaggcctagacttttcatcgatgagtttatgcttttacatcacatgtccattttatttaccatcgttagtcatattactaactagttgggttaattgcaggctgctgacacagatatttcagctttagtggaaattgagaaaaatagccggcatcgctttgagtttttcatggatcttgttggggatcagcctgtctgtgcacgcacagcttgggcatacatgaaatctggtggtcgtatttcacatgctttgtcagtgtatagctgtcaacttcgccaacccaaccaggttccttgtgtattctttagatttctaaaagcaatgtaatgacaggaaaaatactaattcatataactttcaggtgaagaaaatatttgagtttcttaaagatgggttccatgaagtcagcagctccctggatttgtcttttgatgatgattctgttgctgacgaaaaaatacccttcctagcatacctagctagttttttgaaggagaataaatacaatccttgtgaaccaccagctggttgtctaaacttccggaatcttgttgctggatttatgaagagctaccaccatatcccattaactcctgatgtaagacttggtgtctgttatagttatagttacattcactcattagaaattaaaataattgatattttttatcgtcctccagaatgttgttgttttcccttcccgtgctgtggcaatagaaaatgctcttcgattattctcaccagcgcttgcgatcgttgatgaacatctgaccagacacttgccaaagcaatggttaacttctttagcaattgaggtaccttaatttctctcttttctgtgagtgagtcttgtgcacattgaccagaatttgtttggcgcatctgagctctactttagtagtctctgtcatcttctttttctttgttttactttcttttgttttaaaaatatctttttcataaggaaaagtggagaagaaagtatggacaagactcataagacactcattctattatagaatgcaataatgttgatgctgctacctccttttgaatttcagggaaaagccaaagatacagttactgtaattgaggcaccacgccaatctgatttgttgattgagttgatcaggaaactgaagcctcaggtggttgttactggcatggctcagtttgaggctatcacaagtgctgcttttgagaacttattaagtgtaacgaaggatgttggttctcggttattcatcgatatttcagagcatctggagttgtctagtttgccaagctctaatggtgtattaaaataccttgctggaaagaccctaccttcccatgcagctatactatgcggtttagtaaagaatcaggtgcctgtaactattgcagcagctaattttaattgagtgagcttaaatttctctactatattgttttcttttcaattgctttatcttattttggattaaatccttgcaggtttattctgatctggaggttgcttttgccatttctgaagatgcagctgtttatagggcattatcacaaactattgagctattggaagggcatacgtctcagatcagccagcactattatggttgtcttttccatgagctactggcatttcaaattgctgatcggcatccacaacaagaagtaaacatgacttgtctcttattcttaatctcacgcatccttatggtgatcttggatatgtaatggcagaaaccagctacttcttaatttatgaattggtcttcctttgttggataaaacacactatagtaaacagctaaattttttagaagagtttgatgtgttttttacttattttatcttatgtctaattataagcgaagttaataattttccagtggactatttttgtgaacttaaagtatcttttttggtttgtggtctttatttttttttcttgctctttttcagagactgcctgcagaagtgatacctcagaagatgataggattttcaagttcagctatgtctaccctaaaagaagctgaatttttcattcctgactccaaaaaatccagtgtcattcatatggatttagatcgcagcttcttgccagtgccttctgcagtgaatgcctccatttttgaaagttttgttaggcagaacattactgagtctgaaactgatgtccgttccagcattcagcagctggtgaaagatagctatggtttcccagcagatggttgttctgaaatattatatggcaacacctgtcttgcactcttcaacaagcttgccctttgctgcatccaagaccagggcaccttacttttccccttgggcgctaatggtcactatgtctcagcagcaaagtttgtgaatgcaaatacgctgactattccgacaaagttagaatcaggcttcaagattgaaccacgggttctagctgacacacttgagacagtatctaggccatgggtttatatttctggccccacaattaaccctactggtttcctgtacagtgacagtgatattcaagagctcctttctgtttgtggtaaatatggagctagggtagtaatagatacctccttctctggtctggaattccaaactgatggctggagtcgatggaatttggaaagatgtctttctgctgtgaattgtccaaaaccctcgttctctgtagctcttctcggagaactgtcctttgagctgactgctgcagggcatgactttgggtttctgattttgaatgactcatccttggttgacacatttcacagtttcccaagcttgagtcgtccccacagtacgctgaagtacactttcaaaaaactactgggcctcaagaatcagaaggatgaacacttctccaatctcattatggagcagaaggacacactaaagagtcgtgctgaccacttgataaaggttaccttctcataacattctgaatgatacttccaattaagctttcattcacaattctgatccctttggaagtaagatcaacggcagggcttaaaatatgaaattagtaactttatgtttccatgatattatattcaaaaactagctagacctatcttgggacattgaaatgatctggctagaatttgctaggcatactttgcacaatgctgcaacttactagacatactagactctgagattttttttttttgactgaaagactctgagatttttgcagctacgtatggcggtttcttcatctctctgttttttttgctatgaacagacacttgagggctgtggctgggatgttgctggcagtcatggtggcatatcgatgctggcgaaaccgactgcctacatcggcaaaataatcaaggtggatggttttgatggcaagctagatggctgcaacatcaaggaagccattctcaggtccaccgggttgtgcataaacagcagctcatggacaggaataccggatcactgtcggttcagctttgctctggagagcaggaattcgagcgtgcaatgggctgcatagttcgcttcaagaagttggttcttggaagcaaggcttttcatcagatcaatggtaactaaatgaaatttcccatcgtcgtggaaactgaatcctgaagaaatgtagccactacatacatattattatccattgttagcctgtcctgttcggggctgattgaacatttttgtgcttagaaaaagaataatgagcacaggaaggctggtatgaatgtagtagcaaactggaattaagtctgaacgacgtattggcatggcatatttctccagaagatgatgcttcttttattttctgctatctttatgcttacgtttcatccatatttatccctactcgttaagatggcaccacaaatatgcggatgagattattgtatttcctttatggtagtattattatcacttttttctttaataatacgaaatatcctgatgtaagtttgctgccttctttttttagtaatcacaaaaataaaatgtctaaacaaaaattccatggcattgatttattgatttaaaaaaggaacaacttttccttagactagtaatatctagtaacaaacaaactttagaaaagcataaatacatgaccgtgttaccttttagatatatatttaattatttgtttcattaaaaattgttgtacaaatatgaaaaatgtaaatcataatcaaagtttttttataacaaaacgatatgcaagaaaataaataataataacatatttttaaataagacatggttaaatatatgttacatattaacattgtcgtgtattgaagaaaaagaaaacaataatacttaggttaaaatatgtgaaaaatcaaaggcattatatattttaaaaaacaaacaaaggagtgtaatcaagcctggtttagttccctaaattttttttcaaaaatatcacatcgaatctttggacacatgtatggagcattaaaaatagattaaaaaaactaattgcatagttaggggggaaatcacaagatgaatcttttgagcctgattagtccctgattaaccataaatgctacagtaacccacatatgctaatgacggattaattaggctcaaaatattcgtcttgcggtttccagctgagttatgaaatttgtttttttcattcgtgtccgaaaacttcttccgatatccgatcaaacattcaatgtaatacctaaaaattttctttttgcgaactacacatgccctcaatggccgaaccaactcctagattggttaggcggtagtctagtctgagctttttgtcgccaggcttggatgtggccgttagggggtgtttgggagagagagaccctaaggacttattttttttagagctcccaacccccccccccagttgtatcattggctaggtaggggttgtttggttgttgcttaagattgacatgactcgcttgccagaagtgtgacataacacacataacatagtccacacaagtatatcaatgtttggctagagaataagacctcatccttttccttttgcatatgcttagcggccaaaatttaaaattgtaatcttgaatttagagctgattttgaggttttttcgtcgaagtttatttttcagcctttgtttttaaattgctataagaacacatatataaatattttattcataaattattttttatttgtaaatatgtcgtttagtatgatatgtgagcccatggagcaccaattcgtggccttccaaaattaaaataagcaaccaaacattgcgacatggctaacgtataatgtgtgatcatgtagcaatatgtggcactcaacaagataggacggtaggattacttgttgggatggatcgtctcctttttttggtccttggggatgacgcgttctcagattacatacaactccaagttccaatcaatttcttaaagaaaagaaaaaggaggaagaagtgttcaaaccgaagcaaaacgggaaggaaaaccaaccaaatccaagaagctgcttctatggcgacggcggcggatggcgtggcggtagcgaggcaagcggagctccggcggatcgagggcaactcctgcttcaacaaggcccgcctcggcgccgccatcgactgctacaccgaggcaacctccctctttcccctccccctccccaatccctagctccccctttccctttccttttttcaatctttggcaaccgatatgattaactccacgatctccaggctatcgctctttgccccgacgtcgccgtctactggctcaaccggggcctctgccatttcaagcgcaagtatttctctcccttgtttcttcccctccctcactatctctttcttgggggaaaaaacttgattcttttttaatgtgatacagggaatgggctaaggtcgaagaggatagcaggagagctcttgcccttgatgacactctggtcaaggtaacatcatctcaatgtcccttgttcatacataaatcaagtgattgttacaggtcttcaactttggtccagggtcactatttgctgggatgtgccatgcttgagaaggaacaatgtgctcttgctatcaaggaattcaacaaggtttgttattatacttctatggcccttgtaagtttgcttcagcttcttctgaatcatatcctgagctcttcaccatgttattgtttaggacaaatcttaacataaacaaagaattttggaattgagaaatagcttaaatgactttgtttcccttcattttactacattggaaaggatggctcatttatttgtgaaaggggtagaatttttttggctggggcaatcatggaagaaaagatgaaaaaaaaaagcctaaagtgacttgcatttacaaaaggcttgagaagactaatactacttacatttggaatcgaaggggatatttactaatgaatgctaatgttgtgtcttcacgcacctacatattgatattttgttgctacattcatgttgaaatgggatgttgatctcttgccatgctattgctaataccatgcttatgttatcatgtaaaacaggctttggatcttcttaagtcttcgaatttgggggacaaaatggcggaggacatttggcaggttcttgcgaaggcaaaataccaagattgggaaatacactccactaagagagtttggaagatgcaaagtttaaagtatgttatgcatgaaaaataattgcaataataatgttccataattgtgttgcagattaactgtagtgtgaatcttgggtattggtggccaatttactcctataacaacctggacactccctttattatctaaaatttatgatgctttaaactttctaacaccactgtgtcacatggacaattagggaagcatgtgaaaatgctttgcaggagcaccactttcttagtggcacacttgtgggagatggctcaaccaatgagtatacagaccaactgaaattgttatcagaagtcttcaccaaagctacaatcgacgatacaccaacagatgtaatattattatctatgttatctcatgttcaacatctttgtgctagcatattttttttctctgtgatcttaggctgttgctacctgaaaatctaggtgcctgactacctttgctgccaaataacctttgagatttttagagatccagtgatcacacccagtggtataacgtatgagaggtccataatccttgaacatctttgcaaggtacacctcccttgctaatttgctatctgtttttcagaaggtttttggctctgcatatctttagatgttgttgctaatatttcactagaaggaccatgtattagctggctacatctacaaataatgtctccaacagatgaaatacttgattgtataattaaaaagaataagtcaaaatcgaactagtttttttttttgaaaggaacacagcagggaggcccaaaaaaatcgaactagtggaatatttgaatcagcacaatgctgcaatatttaaatatgaaactgctgtagttcatatattgggtggattatgtgtcaatgatctaatttaagctatagtaggattcaatctaaacacaaactataatttaaattgaaattaaatgagaataatgtgctcagtcactgcaatcttccttttgggttttaggtgggcaatttcgacccggtgacacgagagcctctgaaagagcatcaattggttcctaacctggctataaaggaagcagtccaagcctacctcaagaatcacagttgggcctacaagttgaactgatgatgttgctctgtagttgcttagtgctaacaacaggtgttgataaaatgttgggttgtcaagggggaattctttgcttttctgatgtaatgtataagcaagttcattcgtgccctcatggaattgattgattcttgggcaacttctgacgaaccttggacaattgtacataaaacatcatagcagaaccttggacggtttcagacataccgtgccaaaatgacaattctcagtgacaaattattcttttgttcggtaattcactgttacagcaaccagcgaatttaacatgcgtgatactagtaaataccatttgcaactgatgaataatatgaattgaatacttcactagtacatgttttgtttctcccttgtcaatagcaaacatgtaggttgtatgttattttgggttcggattgcctctctgttacccgaaggattcaatggccagaatgggatatctgaagagtaggctgtctggtgagtgacatcaggaagatcagtgtcgcttgtacttttagagtaagactaataatacagccgacctgttggctataaagttctttgtagtcttctttcagcctgtctatataatagttactccatccgtttcacaatagcattttccacattcatattgatgttaatgaatctagacatatatatctatttagattcattaacatcaatataaatgtggaaaatgttagaataacttacattgtgaaatggaggaagtagctatttacaattaatacatggtccacttgtctctctcacagagtttattggttcttgtgtccaaaccggctgtaagtttacagcccgcttctcctctctctcctccacctcagcatttagccggcttatagcctactattatacttgctcttatggatgttaatcgcttgtacttggtggcacgcactttagttcgtctgtctcagcctaagagcaagtataataatgagctataagtgtactataagcttatgtggaggagagaggtagaaaaaaacaagggtgttggctctcatgcaagagctagcttaacacaatctccaagacaaatacattaaatgtataagtgagagatagagagcggagaagaaaattgtagccaaccttatagctaattattatatatattgactttaagatgaactaatagtaggaagtgagctatactattattatcttactctaatagctatctactgtcactcgggagtttattcgtgagatcctctgtattgatgctacttaatcaatgaagtgccatcgttatcttttttttttaaaaaaagtgtgcaaacatgtaggagccctattggttactcatatgtaaaaagaataaattaaagttaaaatttgaattttaaaactcaattttaaattttattttaagatttttcaatatagttttttcagcatttacttttaaatagctaagaacatatgaataaaagttttattttttaatcgctaataaaccgttacgacttataataagttttgggcaaacggtggggcatgtaaaa

SEQ ID NO: 79235 - DNA, 3812 bp, Oryza sativa
ttgagttttgaagaaagagattatgtgtatattcgtgagcacggcttttcgaggagttcatcgttttcacaccaaaggaaaattggcaccgcgttttgtgggaccttataagattgtcagtagaagaggagaggttgcttatcagttggagttacctcaatctttggcaggagtccataatgtgttccatgtgtcgcaattgaagaagtgtttaagggtacctaccgaagaagctaatcttgaccagatagaagtccaagaggatctgacctatgttgagaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaatcataaatatataaattgttgtttacatggaatttttagaaataattttaaaagtcttgaaaagaaaatctatttttaattaataaattccaatataaaatgggcccagataaaatttcattaaatactttgcttaattctataattcctagatttttctgggatttatttgagctaagaaagtatttttaataaatggaattgcatttaagaaataatttaaattgaaaaaggttttaaaaagtcttcttttggctttgggccgaaagtcggcccaaaacctctcttctctctcctcggcccagccggcccagtcagccgcgcgagcgcgccctcgcccgctgacaggtggggtccacctgtcagggtcgtcgtctacctccggccgccgccgccgaaaccctagtttcgcgccgccgccgtttccttccaaatccggccgctcctttccttctccggccgaattgatagaggggaaacaatctccgggatctcctctaccttttctcctttggaatcttcggctaattcgttttggaagtccgtggaatcgagttcgattcggatcggcctttttccttcaagccgcgaatttccttcgccgttgccgtcgccgtgggccttcgccgccgcctccgagcccctttaaaaggacccccggtgtctcctttacccgtcgccaccctcgccttcgcctctcgtcgccggaatcgctctagcgccgtgtgccctagtttcgccgtcgccgccgccgctccagccgtgcgccgccgtcgtttcagccgtcgccgttgctcgggaaggacgtcatcgtggtcgccaagtcgtcgccgtcctcgtccgtcccttcgccgtcgccggagatcgccggagcatcgtcgccgtcgtcaacccgaaggtttccgccgtttcctcctcgtcgccgtcgtcgtccgttgttcttccgccgccgttttggtcaccggtgtgttcgccgcgtcgtcctctacgtgctggtgtcctccgtttgcgtccttgtgccgccgttcgccggcgagcgtgcgccgcccgagccgttcgctctgccgagccgccgccgctgtcggtgacgtcaccgctgaagtcatcggggtcgtccgccgtgagccggtcgtggaccgttcgatctcggccgtccgttttggattggatcgatctcggccgtccgttcgtgtgaaccgccgcccgtgcgcccggtccaccgaaaccctagcccgctgacgcaataaatcccttttccttttcaaaaataattcattattgcgtcataattcaatttaaaccgatataagtgttttaatccgatttaatcttcaaaaattcataactaattcatcttagctccgatttagttggttcaagtctctaaatttttctaaaattgagatctacacattaaaaatatccacatgtactgttcatgcttgtttacgtgctgttttggtgatttggttcttttctgcttagattccgtcgtttccggagagtccgttttcgccggagaaaagtttgaagagttccaaggccagcaaggcaagtcacacagatcccaaacaaccctttgagcatgttgatcctaattaaagctattgtttcttttcaactattgcatttattttcgaatgtcattgggtggaattaacctattctttgttatagcccttttgttcttgattaccttattccttgataccttgggttattataatttgactagttgagctttatttatattggttcaactagatattagatataattgcttagccctgcttagaaacattagctcacttatgagataactaatgattcactattatttcatgatggcttaatgatagttcacgatggtcgatcgtgattagttaattaattaatgtgccaactaaaacctgataatggtgggttgtgagcacatggttttgatggtcgtgctcacgacaattaaggaccggttcacgagtttcggttgtgaaacatttatcgtgccaaccacaagccagcatgggcaacggctttatcttttatatagcatggttcattgcggggcaccagactgagaagtggcggagataagcccacgggggtcgctggggagtccatgccttgtttataagggggcgattacgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcaccatagtaaaagatgcttaaattggtaataatttgattagctcctggtttggaatggtacattcctggtttggagatagaactgtgcagccgagatggttgttcagaatggatgggcctatacaacagggtatgttgtatagtgttggattaatactgcctaattaatacttaactgttttattaaattctcaaatgtttgttaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctttattgattgagaggaactatctacctctgtaatgacattttattcgcttattaattagagtaataattgtactctattatcaatttgttattgtgtgtctcggctgattcctggacgagggttcacacacatgtaagcgtttggaattttggatagaaattccgggcgtgacaattactttattccttgataccttgggttattataatttgactagttgagctttatgtatattggttcaactagatattagatataattgcttagccctgcttagaacattagctcactattgggataacttatgactcactgttatttaatgatggcttaatgatagttcacgatggtcaatcgtgattagttatttaattaatgtgccaactaaaacctggtaatggtgggttgtgagcacatggttttgagagtcgtgctcatgacaattaaggaccggttcacgagtttcggttgtgaaacattaaccgtgcccaccacaagccagcgtgggca

SEQ ID NO: 79236 - DNA, 3785 bp, Oryza sativa
ctatctacctttgtaatgacattttatacgcttattaattagagtaataattgtactctattatcaatttgttattgtgtgcctcggctgattcctggacgagggttcacacacatataagcgtttggaattttggatagaaattccgggcgtgacactcggcgtctcctgcggctaccttctttctcacgcgcgtgctgcagcaggtagagcacggggcggcgcggggatggccgggctagagcacggggcggtgcgccaccactaggagtcctccctgaggctccgcttcggatggggctgcggtgaagtgggcggcgcggccatcggccaaaattctctctccttgcatgaccggccgccacctacgaccaaccgatctcctcctccgttgctccccttcctattccctttcaccatcggctctgcctcaccgaggagagttcatttttcccctttcccctctccctccacctcttagtcaggccaccaccgccgccaccatagccggccggagctgagctctttgtgttgtcgttccagccatctccctctccccctttgcttgacaccaccctccccggatgcgcgtcgcccgggaacatcatccgccaccagcgtcgccgatccccggccaccggagcatcgacgccctactctctccctctcctctgttactcggctggaaggaggagaagagaaatagtgtccagtggcattttggtacttacactactctttctctctccattttagccgaaaataataaaataatgtgagtagtgtccagtagctaattaccacttttttacagtgttctcgaaaagattcacgatttttgggtgtctcacagcaaaggccacaatatttcagtgtcctgttgcaaattttgcctttttttaattttagaaattgaatctatcacctttaatttcagttgaaagtttttaattaagttaaaagttttgaatttggagatgaaagttttcaaatgtaagttgaaaattttcaaatcttaagataaaaataaaaaattgaaaactatcgtgtcaaaatatgaaactttcaactcaaaattcaaaagtttttaactcaaattttgaaactttcaagtcaaaatttaattcaactcaaaattttgaaacttttcaacttgaatttcaaaactttcaattcaaaatttcaaaacttccatcacaaatttaaaagctttcaactcaaaattttaaaattttcaactaaaatttaaaactttcaaatgtatttttaaaactattaactaaataaattatttatatacttttttaaattagtggctaggacgacacggacgtcggggtgccgcgtgcgtgctacgggggaagctagctggcacgtgtgcgcccgcaacacgcacttccgcgcgtaactaactcccttagttaacactaatgatagtaattagaaaaaaagtgaagattttttttactagtagattgaaaaaattttcagttagatttgaaaactttcaacttaagatttaaatttttaaagtcaaaatttgaaaactttcaactcgagatttgaaaactttcaagtccagatttgaaaattttgaaaactttcatcttgaaatttgaaaattttcaactcgagtgtcaaaaactttcaagtccagatttgaaaatttcgaaaactttcaacttgagatttgaaaatttttaactcaagatttgaaaactttcaactcaatattcgaaaactttcaaatctagatttaaaaactttcaactcgagatttgaaaacattcaactcgagatttgaaaactttcaagtccaaatttaaaaatttttaagttcaaatttaaaaattactagtaaaaataggaaactaatcaatggtaaaactaattacgattgttctcctacccatacggcatcaaactgcgaaaaaagcaaaaaagaaaaaaaacggcggtaggaaagcgaaaaaagaaaaatcgtgcgcgcgcaccgcgtgggccgtgtgggccgggagtgcgggctgtcggaccgcacgtgtattaggattctcggcgggggacgctagctggcgcgtgcgcgccagcgacgccacttctgcgcgtaactaactcattagttaacgctatgacagtaattagaaaaaaatgtgaagacttttttgaagattttatttactaatagattggaaattttttcatttagatttgaaaacttgctacttattgagctggcgcgtgagcgtgcagtaggatccctgtaggcccggccacctcaatgaaatattttactaattaatcaaataattatattaaccacttgattaatttggccccttcaaggcttcaactccgatcgcatgcaagtcgtctagctttcttggcccttcgactggacgggaccagcacatggctgagattcgttgctgacattaggcaattaagatgcagctatcacacatacaacaatttgggcaatatgccaactaaattatcgagagtccgtggtttaatcaggtggctgtgttttaattggtgacatggcttaatttagagaaacttttgcactctcattaatatcacggacagagaatattagtggaataccttttgaaatgttaaaagaaaagaagagcggaccgaaatcatagaattttcaaaccaagttttcagacggtttaaacttttgatccatttccacatatccagcacgaaattctacctaatttcgtaattttcagctagctagtgcagtagtgtacttcctagcaggatccactgataaatccaaaattttgtgtgcttttagcagctcgttggcttataaagttacgaccaattttcaacttagaatattaatattaatatgtgttattctgattattttctatttttcagccttaacatctatctatctatctatctatctatctattatatactaaaagaccattaaactttctacaaacgcctctaaacgtggcatggtacgctactacaaacgctcctaaatagccacatggcactttaataaatcgggggacccactattctaaattatttgattatcttttaaaatagagaccccacaacccagcccaccatctcctctcaccggcccacaacccaacattgcacgcacgtacttacgtacctggtacgaacgtatgcctccctcctttaatccgatctcacaccttgctaatatttatttcgagggtagcaaataatttaaatatagaaaaaaatattataaagaaaaataaaaaacatcttaccatctgttttctcttaaattagtggaccttaaccattagaaataaacgtatagataattcaaacagcaaacctattaaatcaagaaaacataccctcctaattttagacttaactttagactgttgtcgtttgcacgacaacttaaataggaacaaaacattaaaaaaataatatctattatgtcacctttgaatcattttatataataaaagtcgattaaattctccaaagcgcttttaagtcaccatgtgtgacgttttaaatttagaaagaacttagaaattcaaagaaaagaaataaaatataattattggtttccacctaaatgaatataccattatttttaaccatcatatcttttttaagaaatcttaagccgcaacatgtcatgttttagaatcacagaaatatgagaaaataaacaaaccatcagttgcacttagcagttagaaagaatagaaataggggctgtttgattcatatgataaggttgtatgggtgcagga

SEQ ID NO: 79237 - DNA, 5598 bp, Oryza sativa
catgtcaccccttcctatctctcatacgagctctatgctattaatatctctccagtctcctcttcgtattatcagctatcaaactaaacagagaaacaaccaataattttatatatatactaaaagtacaaaaactttaagcgacacacatgatttctattctaactgttgctctatttataattaaactaacaatttaagatccatatgtctatattttgctatttaaaaaatacgggcacactcaacccgtgtgctttgcatatcgtatagcaacataatatcataaagaatcgtcaatatatttgttttcatcaacatcatctgcaaacatgcatgattaaatttaatcaataatattgaataagtataaaaattcatatttcaatcaaatttattatcgataggacactcctaccattttacatgtcaccctaattgcgattaaaaactatgaaacaattcaacaacgcatgtcgcacaatcacatattgttttgcaaacctatataaaaataacttgggggcacaaacacaccactgcctttttacctgttatccaaatttctataaaaaaatatcaactaattcaacaaacacatgttgcatcatcatacatcgttgcaaatagacagctaaattagatacatactgtacaagaaaaaaaacaatcgaacgtgaagagtttaggctattgtataaagaaaactggtgcgtttagttagagaaaaaaaatctgattatttcataaatgttttttttctaaattatatgctcaataatccaaacaagccaaacaatattttacgtaagtgctttgaatatatgttatgtaccatctaatcgacttcagacgatggtaccttttatataaagccaccacatgttactcttgcaaatgctcctaggccaccacatgacactctaataaattatagaaaaccctaaattttttgcaaaagtaaaacatctcgctatgcttatcatttaagctaatggactaattatttttaaccattagatctaaacaatgacagcctctatcggtaattcaattaaaaaaataaaaacgacttacttttattctagaacattatttggtagatgtgctctaaacaaaataagtctaccttgataaagaagattataaatagttatttattacgattagttaagtagcaatgctgatggaaaaaatgtggagaaatcatacatttgaagtgtggcaaatgttatccggtttatattccgttttgaagcacaacacgatgcatgcccgcgcgaatgcgcgggctaccttcctagttcatttaaaccgctaagagtggaagtacatatgttatactttttttttcatcggttatgcgtcacggattaattataagtgtcagccgaaagaaagaagatctcagccaagcagatttttcaagccaccttgcttgacactttggtcagctttgtcaaaaatgtatcggtcttcacattgttgcacggcatatgaaagaaacttggcggacttttaagcgcccgttacccaagttctacaatataagtccacatatatacagttaatcactcgaccgatcatgaccagcgccatgactgtgccgacgatgttgtggtccaccctagtaccattggtgctgcttgctcctctcttctccatcccccgccattgccgcgctcaggtgctcatgaactactcctgcaacaacggtagctcctacgccgagaactccacctacgactccaacgtccgcgccgtgctcgccacgctgtccgccagcacgcccaacgccaccacaggcttcgccaccgcgtcggcagggcgcggcgcggacacggtctggggccttgcgctctgccggggtgacaccgaccatgccgtgtgcgcgtcctgcgtcgccgccgtgccggctatcgccttccaccagtgccgcggcgtcagggacgtgaccgtcttctacgaccgctgcatcgcgcggttctcgtacggggacttcacggcgaggcccgacaatacggaggtgctcatggtaagccccagcaagtaccaagccaccgtcaacgcaggccacttcgacgcgctcgtgacacgcctcgctggtgcgctggcggactgggcggcgtacaactcgacgttgaggtacgccgcaggggtgatggcctcgagcgacgggttcccgtcaacaacggggtacatggtgcacaacatctatgggctggtgcagtgtgcaccagacctggcgccgccggcgtgccgcgcgtgtctccaggcgctcatcgtcgacatgccccaggcttttggtggaaggattggggggcagttcaatgctgtgtggtgcaaccttaggtatgagacatcggtcttctacgacggtgacccagcggtgaggctcgtcgcgtcgccatcactcgagggtcccaacattaatggttcaacaactctgattataggtgagttgttcaacactacaaggccggataaccaaatttctagcatacctgtcgtcctgtcctctgattattctgaaataacggcacatttgcattttactgcaggaaacaggagaaggcgcccaaatgccgcaactgttgttgtatctgtccttgctgctgtaataattgcacttctgtctgtgctctccatttacctctggagaaaattgcaagcaaaacaatgtgagtgtgtcttcttaattatccgctccattttctgttccaaattaacgactaatgaaattgcaaatggtcgtccacttactctatgccttacaatgaactattttgtgacacgctagctgagagctaaacagaaccgactgaaccgagagccacccatagatttcggagcaaattaaaacaactaggctatgaggcatgagacaataatgctgttatatttgttccagcaagtacttaaggggagtgctattgggcggctgatcgttgtgggcgatcgggcatcccccgtccctccgccttacgcgcacactcctccccttttttcccttcctaccgcaccataatttttttaagaaaaacaagttagaaaaaaataaaagaaaatagaaaaaaaatctattacccttaaaaatatattcatgtgcatatgttttatacttataaatatatacagtaaactttataagtataaactttatgtactatacaaaaaatatttaaatccgaatttaaatttgaattgggtatataaatttttgacatatgaattttaggtgcgtaaactttaggtatataaatttatccggaaagaaaaactatatggtgccaaaagaaaagaaagtgatgaaaaaaaaatcgccccaggcgattgaccgctaattactaattagcaatctagagtacttaacggtcggtccgaaccaactcatcattatcagttcctatacagttctctatagaactgacaacgattatactattactactggttcatctatttttcttgcccaaacattaattagcctagagaaaaccgcaaaaaaatactcattattattaagggtgtagtatgtctaggggaattttaaatatttcccatctctctcttgtacaaatatattttttctctttgagcctaattcttcaagagcaaaatcctcaatttctcccataaagtgacatggtatcagaacctatatcctagccaccagccaccgaacctccgtcgttgcgagtggcaggctcgccgctggcggccaccgctcaacagctcatcgtcaagcaagcagcaagcaaacagatcaagcagcaaagcacatacaaatcaaaacaagcaagtaagatctagcagcaagaagaacgtccaaatccaacaagcaagtgcacgagcagcagtagcaagtcgtcaccttcgtcttctggctgcagcagccacaagtttatccatcgtgcttccagatctcgtctcggccgtgcctccgcgccgccagtttcatctgcccctcctgtcaagcagctagcagcaccagccgcccaaggtcgatctgtgaagcaacatctagcaggggaaagtgaattcatctctggaggatatcccctcgtttcgtacatatcatctaaatagtcacaaaaaatatataaaaaattagcaatataaattaatatgaaatatatcacttcacaaacatgcaattttaaattcaacttagttgtaacaaaaataacaaatatagttgtgaatgtgcgataactattttcagtttaatttgttatttttgttgcaacttatagaagttgaatttgatcttgcatatttgtggagtgatatgtttcgtactaatctatgttgtcattttttttaaatttttgataactatttaaataacatgcaagcaatgagagaatgttccctcgagggatgaaaatccacatcccatctagcggaaacaaacctcatgtcatcctggagctcattcgtcttcgagcatcagcagcagcagcccagccctcgttgtcaatgccgccggctcccatctctgccggatgcaccatcatcccggctgaatttctcatcaactagtagtagcagcaaacaaacaacaaacaagcatatctgctcctttcatcctcttcttcgttccaactagatctcgtaaatttgttgtcctcgagctagatcagataagcctctggtcgctgtcctcgagctccattattcctcgtcttcaagtagcagcagcatgccagcatccgctcatcgtcatcttcgatttgcaaatccaccattatcttcaagaatcttgttttcctatgcagtttctgttccatcacatatgcaatccgttgtcgttcttatcggtcgccatcatctattactatttttcatcactactactatgttatgctattgcttgttgtggctatatcctcggtagagatggcaatggggggccgtcctcgtttgcccacggagaattctcctattagagggaagggatggttagaataattggttctccttgagatattaaatgggaggaatcatatccctctcaagttttgcgggagcagggatgatccttcattcctcacccccccccgaccctcttaggagtgaaagttcattgtttttttacttatcttacgtaattatcttacttatgtttctttataaatgataatcttgtgttttatcatgtgaattagtggatatatattgatgtattaatataaaacatgatatatgtgttgtattgcatgtatgatttggtacatatatattgttttacgtgggacggagaccccacggggactaattccccatgtggggacaggaatgagaagaaagtatcctcattgtatttcgtgggtacggggacagggaaagttttggctcacccattgtcatctctattctatggtgtcttttactagttcatcctactgctagtttaagtcatttggcaatccattcagtccaccaatgtcattatatatccttcaattaatcgaagtcgtgctattcaagtctatctctatcttcaccagagttaaccatcatcgtagcttcctgtcgaagccgaatcatcagtttgcgaaggtctgtcatcttcttcatcatcatctctgaatc

SEQ ID NO: 79238 - DNA, 1032 bp, Oryza sativa
acaaccatcggctaccgagccgattgcaagacgaccagcagtgattcctcagcctcacactcagcagccttcagggcagccgattggttctcatacaatcaggccacaatactgcatccaggagccaagaacattttcattttagcaagctccagggttcaaccaatttcaaactccaccaccacatcggcagtttgcttcaccattcattcaaaatccacttcagccgataggcaatcagtttgagcaagtccaaggggtcatccaacaacagcccttggctggcatgattgcaaatatggtgagagaacaatttggcatcaagccaaaagacagcggtatcatgtatcagaacccatatccagaatattttgataagatgccattgcccaactgatataagatcccagatttcttaaagttcttagggcaggatattgtttctacatacgagcacatcagccggttcctagcacagtgcggtgaagcatcggctgtagaagccctaagagttagtctttttcctttgtctttgtctggatcgacatttacttagttttcttcattaccatataattctatcaagtgctaggccgatctaaaaaagcagtttcacaagtacttcttcagcaacaaacaagagagaagcggacccgagaaaactctttgtattctcatttatgttaaaccttgaccaccagaacatggcttcttatgttcacacctcagctaggagggatgttcctagtataaatacctctctactctatccattagataactttatttcaattgtaaacctcatgtatgagagattgctgaagactgcataagtgtcttacccctttgttcttgtgagttcttttggacttgtgagaaggctcctctggtgctccctagtcttgctctacatcttccagttcggctgcaccgtattgtgtggattagtcccggattgtggttctgtgattgctcggtttgacgggttgaagtccaggaggcttcggatcgttcttaccctcaccacttcgt

SEQ ID NO: 79239 - DNA, 18388 bp, Oryza sativa
ttcccaaacaccacctcagtgtagtatgcatgtaatatgggagggaaatttggtttggaacttaaatataatataagctctctatcatagataaaaaaatattcctttcaaatatggcactgtttagtttcaggggtaaaatgttttggcgtgttacatcgtatatacgaacatacatttgaacatttgaagtattaaacgcagtctaataacaaaacaaattacagattctgcctgtaaactgcgagacgaatttattattaagtctaattaatctgttattagcaaatgcttgctgtagcaccacattgttaaatcatggcgcatttaggcttaaaagattcgtcttgcaatttacatgtggtctatgaaattagtttttttctatatttaatacttcatgcatatgtccaaatattcgatgtgacagggtgaaaaatttttgttagggactaaacagggcctgtataggagtactccctccgtcccataaaaatccaacctagtattggatgtgacatatcctaatactacgaatttggacatacaatcctagattcgtttttttgatagagggagtactcccttcatcctctaatataatggattttgatattttgtttgcactgcttgaccacttatcttatttgaaaaagttgtgtaaatataaaaaacgaaaagttgtgtttaaagtacttttgataataaagtaagtcacaaataaaataaataataattctattttttttaataagatgaatgattaaacaattcaagtgaaatgttaaaatttgttatattagaggacggatggactactccctccgtcaaaaaagacaaaccacgagtttccgtgtccaactttgactgtccgtcttatatgaaatttttttataattcgtattttcattgttgttagatgataaaacatgattaatattttatgtgtgacttatctttttaatttttttcataatttttttaaataagatgaacggtcaaacgttaagcacggaaaccagggtttgtcttttttcctttttttttttttttttttcggagggagtagttacgaaggggcacagggaaatcatcaaagatggggaaattgtactcgtagctctgtaagggctggatcacgagctgcataggaatgtggtggtactagcgcaaaagcagggatggtagtggggtgcaacgtgcacggctgcacgcaccaaaaaaatgtgtacgcacatcacctcaccagcgtactgtatggagtacagtaacagcacgcaagcacacgcacacggagacacgagtcgcagagataggcttttggcgggaagcgggcctctgccattccctcccgccatcttctacatcctgctctcctgtggccttctccttcctccatcgccatggttggactggatcactggaaattggatgctaaagctttgtttgcttccaacgacatgcatccaaaagaaagggcgcctgcttcccggcctcttgttctgcttgcttgcctgccactgtgccactgccgaccaatctcctctcttcttttcttgtgatatattcctatataaagtgttactttttgttctatttgtcaatgaactatatattgtgtgattattactgctctccattactaatattcaaacaagaggagaaaattaatgttcaacaaactcgtcacaaattaagtttgttatgtttgtccgcccctctgcctgtcgggatgggatgcatatggatggagtatgaacaaacctgatctgaagtagtatagttggcaaagtcggtgagatttgagacaagggtcaacaaagtacttgaggtcgttgcatgcgttgatgagtcgtattaacgatcacttcttctctttatttattgatgaagcctgctatcttttgcaggaagccggtcggttatccgccgccgaggatgaagagctgttgaggaggctgcgactgctgcggccattccgccgccactggaaaaaagatggacgacgacgaccatgaccaccacggcaacggcaacacccccttctccttggccttggcgcgctcctgcggtgaagttcatctcatcgggccggcttgcagtttagcccagcccagcaaggcccattggcccactgggagtgggaggaacaggaaaccgacctcctcatcctcgaagacgaagacctctctctctcgctcgcctggcgccgccttcctccaccccactctctcctcctccgccgccgcatcctcaccaacccccaacagccctccctccctcctcgccaaaggtaaaaaaaaaacttagccggatctctcatctggagacttgctcatccttatctatcttttggggatttcttcatctcattctcatgcatggtgtaggccaaagtttattgcgatggatctgatgtttgcttacatcctttcctagtcaatttcctactctgcctaggagtatattagagcgagggagtctttttacaaaccaactctgaatctgaacaaaaaaaaacaatacagagacctgtctgtgccgataatatgaaaatctttgctttctacacaattactgcctttggtttttgggtaccactataaatccagtataaaaggagctctgagatatttatgattttagtgtactaacatcatcagtagctgaaacaggtgatgatgagtttctacgctctaatactaaggcccttcactctgaatatgatagcttattttttattttagggagatcaaatactctccctaaacagtaaacacccgaaattactagtctagccaaactccaaccatcaaacctagtttaaatctctaatctttctttggtctaaaattattaatctctcaaaatttactgctgtgaggtaagtcttttccttttccatgtccaaatcaatctaggctatgttctggtatggttcaatcccctccccactgctaagtaagctaatgttatgctctcgaacttgccattgccagctgcacttgtagcagatgggttctgtccaggattgatattctagcactgactagctcgagtgttttctagtataatcggaacttgtattacaaattcccacttttagttatactgtgatttaaagacaaacactagtttaggtggtgtttggatccagggacttaactttagtctctgtatttagacactaatttaaagtattaaatatagactacttacaaaactaattacataaataaatgctaatttgcgagacaaattttttaagcctaattaattcataattagagaatgtttactgtagcatcacataggctaattatggattaattaggctcaatagattcgtctcgtgaattagtccaagattatggatgggttttattaatagtctacgtttaatatttataattagtgtccaaacatccgatgtgatagggacttaaaagttttagtcgcatctaaacagggtcttagtcttgaggctacatcagcaaaccatatctatcttcagtttaaattcatatatcccatatagctctgtgccttggctaaaggtcaactggcatcagtgtggcaccacttcttcctgtttctgtaacattctcttcttcagtttctgcaacaaccggtgcaaactaaagatggcgggattcggcagcctggcacccaagaccaagaactttgtggtggctggaggactgtctgctttcgtcctcggcgtgtattactacaccatgagagcggtgggaggcacagatgagctgcaggtcgccattgataagtttgaagacatgaagaaaaatgatgctgggaactcatccaccgcgggatcctaagaacagggtttagaattggctccatgtccgcctctatactgaactgatgacacttggttttgatcctaagaacatggtttagaattggctccatgtccgcctctagccctctatactgaaccgatgacacttggttttgtacaataatggctcgatactaggttttgcttatgctttgatgataggctggaataatttttgactgaatgatggctgcagagttggattgcagttttaattttctgaaagttcatataacagtatgatgacctgtgtaacttgaaggtttctatttgtgtgtgggtatgcaaaagacaacaaaagtgtagcaatgttatgggactattatcacgttagattccccctcttgtatgatgtatcaatcacctttttattgagtagcccaacgacatatagcagttcacatgttcacatttatttcttaaaggatgaaataatatatttgtaaccggacacaaaagaatgggttgtttggttcatgtgctatgagaggacaagcgtatactaatatcctcttctggaaggaggaagaagaagatgacaaggtccttctcctccaagaagctgtagtattattcaggtttaaggtactgatctaatgaagacaatctatcatcaaattgagctttgatctggtattgccaatgccatattattattccgaggactttgtagtttgacctacaatatgctttacaataatccaatgtactactccatttaaaaaaaaaacctaatatagtattcagattcatggtactctagtactatatttgttttcctttcgaatgaagggagtattattatttgcccttatcaaattaccaaaatgcctctaaacttatcctaaggccttctttggttaatcccatcgggattaaggtgcggaattaatcctactcaatcccttctaatccctgtctcacgcggaataatagaacagtctagagtgagtaaccaaaggtgcttggacatgaataaaaggatagtaaaaaaaaactatcaactatgaaaataacacacgtgatcttttctgcttattcaacgtattattgacgtggattatttgctctatacttctaaaattacgggctcaaacaatgttcttatagtacattgcatatacaaacttaggccatgtttagttcccacgaaaaacttttcaccatatcacatcaaatgtttagacatatgtatggagtattaaatatagacaaaaaaaattaattacacagattgcgtgtaaaatgcgagatgaatctttaaagcctaattgggccatgatttgacaaatatggtgctacagtaaacatttgctaatgatggattaattaggcttaataaatttgtctcgtagtttacatgcggaatatgtaatttattttgttattagactacgtttaatagttcaaatgtgtatccatatatctgatgtgacacgctaaaaattttcacccccttgaagtacacagggccttatactatattcccctacatttctccctcacacacgggagtagttgattcgaccctttttttcttgtgatgcgtattcgttgctgaccatatatatcatgtaagtcaggctcttctagtgtggctacgagctgagtccgacttgagtttattcttgggctattcctcgactctaggttgggtgagagacttgtttgtcacgagatgagatggaagtagcactaatctttggctaagaacaagtttgagttggacttatcacgcaatcacactagatgagcacgatctagcttgggaatgagcaattttcaaagcgacagtgttggtttttgcaatataaataggtttcgaggtagaatatcaaaacaaggatgattaaagttgaggcagtttatgcaattttgtgataaaaaggaaatgggacggattaaaaaaacgtagtggcagtgtcgtaaaaaaaataggattagaggggagcgtgggaaaaaagaaaacgggtaatatactgtctaacttcaacaggtgaccgtctcagattgagatctccccttggcctccctgccccgttaataattacagtattctattctctctctagcaaacaagtaggagtaattttcctctttctttattctactagtctagggaaaaaaaaaaagtagtcgatcgatcgatcgagaggtttaatctgtcctccctctcgccggtcgccgccctcgtccccgccgccgccgccgccgttagattgaagcagagctacaggcaggaggggcttctcctcgcgcgccgccatggtgcttggcaacgtcgccatcctcgtcggctccggtgagtcactttccgccgtctgctccctcctgaggtccacccgcagccctagctagcttctcgtcgcccagcccagccggttgactttcgacttggagattgatagatagataggagtagatgccacttgcaaccatggcgcagtcatagatagattaccaaaccaatccctcccacttctagggaataccactaccaaatcccaacttatttgctcatcttgtacggagtattttgctttaccagattccaatacatagattgatctagccttttagggccggggccggggtttgtttagttcaactaagctttcgcttcaaaccagaggggaacttattacctgggtatcccactgctacatgaaacaccactgtcaaatcccccccaacttagtggcttccccagtacataggctgatcctgcctttctttttatcttaagtataattacgccttcactaaataactatactagttttactcggtaccaatgtttatgttgtttgcttgcctgcaggaattcttggatcagttcttgtaggtggtgatgccaaactccctagtgccggggaggtactttctggtgctgccaaggtattgtattattgcccctccatgccctaactatcaacccagaatactactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacaggagatacaatctctaggatcaaggcctgttacagttgtcaccaatgctgctagatcaggtaagttcctgctgactagttactatgttttagttacagacttatgcatgggtcacagatcatacaaacataaatttcacatgacactagactttgtgtatgccccgatgtcgacatctcttgctaagaattaatgcgattttagagtgttagatatttctattacctttcgatttttttttcagacttggtctgttgtttttatatctacatgttcgacagagctacaattgcgttgtctgttcatatacagagtataccattttgcgattcagttcacatgttcttttctttttctttccttattattatttgtcatggtcttggctatgcactactgattatcattatattattcgctgcattataaaggttcttggacacgtgatagtttttataattgctaataaactttcatcatgctcttttgcctttaaacatacacaattacatatgtttgcccctctaggttacacacattctttctcaaatgtccttgaacgacattcatgtaaatccttcttctgtaggacctggtacatttactataacagcggtggttgttgctggggctgttggctacgcctacattaagtggaaggtaatgtttgattctttcacctcaatggaagtacagaatgaggaggacataatctttgattattctagttgctatcttgatgtttattgttctgtccgtcattctagatcatggacgcaagtgcatattattacaatcctatctgcttgccatttcttgtttcactgttctagctagtttctaaagttacatagatttgcagggctggaaactttctgatttgatgtttgtcacgaagcgtggcttatctgatgcttgcaatgtagttggcagccaattggacaaggtttcagatgatgtcactgtaagtttttaacttctttcagcaacgctgaactcaaatgtgttacttgtgattccatgttttcattgttccaaccaaaacatcttactggcctttgattttcactattcagtctgcaaggaaacatctcgctggaaggattgatcgtgtggatatcagtttagatgaaacacaagaaattattgaagggacaagggatgaggttggaactgtttttccttttattttttgtgtttacttttatagtttttgatgcattttcggcgacctaatggcatttcatgactgacttgtaggtcacagtcatccatggggatctgagtgctttccaagaggatttacaatcagttaaccttgtagttcggagtctggtatgtgcctcgtaccggaacagattctaccttatttactgaatatccagatttctaccttatttactgaatattactcgtgtacattttttgtatcttgtatcatgcaggaatcaaagcttgtgagtctggaatacacccaggtgagtagaaagctcatgtttttttttttaggaaaagtagaagctcatgttaccactacatattaccaacaaactcatcgacatgctcctaatgctatcttcttaaaatccttttaggatcatacggctaatggaatatctgacttggttgagttcacccagaaagccactattcgccaggcaagtttgaatggtctagtgattccttaatgccatgcttcttctatgctttatttaacaaaaccagttgcacctcaactataagcatattcttttcctatatgcttattctgaagagatgtttttattttcaggtcccagcagcatccgttcctccagctattggatcttcagagcgagttgttaggagggtaaaggcttgcacttttcccagctttgtcatggtcggaacatgccccagtttgttgacttgggttcatgtgtttctggttgcaggtttcttcgttgcctcaatctactgctcttccagctctgccgacaaccgcacctgcagctgaaccatcacctagggcagaggtgccacaggtgtggtttcagtttgatgttgcactttgttgcatgcaatttcagtttcctcttgcgctttccatgattgaaacgagctattgctggacttttgcaggaggaacagtggggttttgtgagcaaagcatcatctagtagggaaggattagggcgtttgcagcagcagcggagtgttgtgaccagaacgtcgtctatgagggaaggatctcctgaatcttcaaatggagcctcatcctcaactggagcaagcacaggaaggaacacaagcacaggaacaaacacaagcacgggcagatttggtgggctgaggcttcctggacttgggtttcttgcaagttcgacgagttagttgatgaggtgtttttatttaagttaaaagatggtgctgccaggagctctccattgctttgcttgtagttttaggttgtacagtaggagagaagagataacagtagcagtgatgtgatggaacaacacatatacgtgcggggctgggctcgtttgttcttgaggaggccaaatttttgtagaaaaaagagaggaaaacatgtgcacctatgtatctatctatctatagccatgaatgcatcatccagggcaacaccttggtctttgatgtcgagatttttaacttaaaatgccaagagtactagtacttggttaattaattttatgaagacgagtcaactggttggttgcctttgttactagtatcttgtatgacatatgccgatatttcatccagcttagggccatgattcgtttcagacttctgttactgtatatatgtcatatgatatatgatttgcttggaatttctgttaagatcccgctactgtatctcgtatgatatacagtatatgattcgtttggtatgtctgttaagatgtgctactgtatcttgtatgtgacatgctgatatttggtactccagtagagatcttataacaggaaaaaaatatgaaagaaaacaaacttacaaaacagcagccgcctgatatgatttgatgagaaagagaaggaagaaaaagaaagccgaagatatgggccgtgtttatatgggcccaagccctaagaggagagtctaggcgacgggacgggaggcttcctcctcctcctcctactcgagactcgacgccgccacctccacctcccgtctcgtctccagaagcttctggaacacccttccggcttcaattcccccctgctcgggtcgggtagctcccttccatcatccatggccgacgccaccgccgccctctcaggtacagtaccatcttccaactcaactgttgacctagtactagtactgaggtctgaggtctgaggtcgcttcgaattcattggctgcagctcggagcaaggtgcaagctttcctcgaagcggctcgtgccggtgatctcgactccctcaagagtaggtgcccccatgccttcctctctctctcctttgctttccttgcgtttcttctcatctcctctcctcatgcgccattgcagagctcgctgcggcgctcgacgaggagggcaagggcgtcgccgccgtcgctgctgccgtcaaggacgccaacaagcgcaccgccctgcacttcgccgcccgcgagggccgcacccacgtctgtcacttcctcatctccgacctcgccctccccgtcgaccccaaggacgacgatggtactactaactatcactatctcttactctcatctgatttcttcacaatctctcatccatcagtttacatccactccaccaggtgaaactccactcatccatgctacgcgccaagcccatctccaaactgtaacctatctgcttcaccatggagcagatccttccgttgcttcttccctcggagccacgccattgcaccatgctgccggcataggtaaaattcatcatctatttgccatttcacttcattctttccatggattgatggtctatactcttttcttttttctcccattttgattgtgccaacgcctctataaatgcgtccaacaccactctccttttttttttgtttgcatctgcagggaacctggaccttatgaaactatttctctccaagggggttgatgttgaatcagaaagcgatgccggcacacccctcatatgggctgctggtcatggacagcaagaggcagtcaaacttttgcttcaacacgatgctaaggttgctcctcaataaatccactatctcctatctcacttcatatctcactgatttaacgaacctgagcttctagtcattctgttcagaaatcttcattatgctgaaattttaatatgtcgccttttaatattgtcaaatactagtagcaactgacactttaacagtaaccaccaagggttctcaagcttgctattgttaagaagatgctatcttttggttctaatagcatctgtatctattatgtttctttgaattggacaggcttctctttgtttagcactcaaccacctttcaatcagccgttcatgtggcctttccttaacttttttactgaagctagttattgcttggcagccaaatactgaaaacgatgatggtattacgcctttgttgtctgctgttgcagcgggttccctcccatgcttggatattctaattcaggtacacaaatctaatttcaagagtaaaataccaaaatctgttgcttttactttaggatattatccacttcgatgccattcattggtcatatggtttctgtatgctatatttccttgtttagtaatctggcttgtgcaatgggggttcagacaagctcatttttcgtgttattgattagattgctgcatggcaaatcatagtatgtcacgttcttatatgtgtgctacctatatcaaaagattttgataagaggatcaaagtgtctgttcttacttttgtcatatgctgtttctgttcttggttttgtttgatgctctgttgcttctacaccccttacatctatgattcgtataaaaaaccgatcatataatctgctacacaggcaggtgcacatccgaatatcagagctggtggagcaaccccattacatattgctgcagatggtggaaacatggaaataataaattgtttacttaaagctggaagtgaccccaatgcatgtgatgatgtaagttgtacattaatcagaattccagtgtatcattaaatatttaaatgtcaatagccaggttcatgtgcattgattggtcaaaatgattcgtaagagggtgtcaagcgtttgctgtttgttccacaccatgtatgataatgaatatccctttcttggtcagcatgtgttactctgaaaatttccaccgtttcattatgcagtgaataactattgtaaccctgtagtgtattgtttagctggattggcaactgcttttgcaattccatcatctgtcctttcttgcattattattgagcaaacagcactgggctgcataatttcactgaaggacatgactgttgattttggtgtagcagtagagctaagtaatgctaatggttgaataactattatattcttctacaggatggactaaagccaatacaggttgctgctttgaggaataaccgtgaagttgtggaacttcttttacctttgacatcaccaattccaggtgtttcgagttggagtattgatggaattatagaatacactaaatcagtcgaggaaaaggtgcaacttcaatcttctcatgatctattactagttgcaagttctttgtcgatcccaatggttgaataaattttgcaggcacaggtaaaggaagctacaactcagaaagcagacagattacaagtaccacaacttgttgaggtgcattgcaatttactttatagttttattcatcttcaaggctccaactatttaataactgtaagactcaagatctaactattgctgcaaatggtgctttcctgacactgtacaggtgtcatctgaggcaaaagagagatcattggaggcaaaatcgagaggtgatgatgccttcagaaataaagactacctagtagcagtagatgcctacacacaggtaagaaccaaaccgcaagacagcgtgtatttttagaaaaggcgcataagtttatcatatgaactcaaattcaaagagtagaatggaatggaactacatttcaggctattgagttaaatccaaacgacgccacgttgcattcaaacagaagcctttgctggctacgggcagggcaagctgaacgtgctctggaggatgcaagagcatgtcgagcgctgaggccagactgggcgaaagcttgctacagggaaggcgcggcactgcgcctgctgcaggtctgttgatttcagtgataagtttgggaactgataggcagttgtgattacctacctatatatttgttgctgaagttgttccggtgataccaacagaggttcgaagaagccgcgaatgccttctatgagggggtgcagcttgagccagagaacggcgagcttgtgagcgcgttcaggtagtaaagccttcctctgtgagcaaagaaaagcaatgaattcctccgttgtttagcaattaacatagacatatatagggtgtcgttatgattggtttggaactcatgtgtgtatgtgtttgttattccatgcgacaagtgaagttgattacttaaactgattgacagggaggcggttgaagccgggaggaaattccatgggacggacaagaagcaaaaggcagatgcatcaacgtgatgtgtttttggaatggcttagacctatacaaggaggaatcactgaatctgtaccactagattagtattagtttggcttggccaagaaacggagcagctgaaatctgaacacctcttttgatgttgctacaaatttattatattagtatcaattactatcagattgaattctgtttgtgtcgtggctggttctagattcgagtggctaaactgtacccatgttcttcagcatttctttaatctacggtattgagaaattcatatcttcctcatcataggatgattgattacctaaggagctcccgcgtccctctgaactcttggcatgtcaagagacaatggaattgatggcatcacgcatggcattaatcaaagaaaatatcatgagtgaatacacagtactatgacgacgataaggttggggggggggaaatgtttttagagaaaaaaaaactccataacaaagatgttggaaggaagaaaaaaaaatgttgggaggaagaaaagaaaaggtctcagtctatatatatatatatatatatatatatatatagagagagagagagagagagagagagagagagagagagagagagagagacgcaatggcccaaagaagaaaaaagcccaataatagtaagtagaaagcccgacacagagacagggcagaggaagaggaaaagctgttcgtctccccaaccccaaccgcgacgaactagggcgacgggccatcgccgtcgtcgccgccgccgccgcagctcgcgctcgctctcctcctctggcgccgttcctctttctcctgcgtcgccccatcgacctcgaccgctcaggtaagcatccgctcgatcccctcgccaactatcccttcaattacctactttttaggacgttaggatttgccatcggaatcgcggtgttgccgcgaatccggtaattgatctctcgcccaccttcctgcacatgcactttttatgcaaagaatcctcctaatagccaattgtctaggcagatctggcagccgaagaaacaaagatagatgatcttgaattaggggatgactcctccttttaaaataaaaaaaatcaagataaatgccactacactgtttgctctgatttaacttggcacacagtcatgcctagtttacagcttcttcttctatgctccatactctctgtcagtatcaaccaagctgtataaatgtttctcatcttccttcacatacaaccagcacaatgtgcttcattgtattatgctaacatatatgatgaacatgcgctttttacgactgcatttcaatacctcctgtgtatgtgcttgctgcattgtgttactacttaagtaaacttcatgctgatgcctcaacctggtttccttttggttacttctattgcagcgtctgtttgtaactttctgttatgggtgactacaccatccagattagcaccaagctaatcgaccagcttgctcgtgatgacgagaagatcaaaaagaaaaccaggaaacccaagcctaagaagactgtcaaacaacatcaacaagagccccaggacaactcaagggaactcccagcttctgaacccaaggctcctcctggctggccactgcagcctcccatgtatctccccgtaacccctgctcctccaccacccccacctgctttttcagagctggaagccatccgtgccgttctggaagagagcgaaaaggttcaggagaagctggataagcagcatgctgggatgcgtgatgaactcatcaagaaatcaaaagacctgcgtgacaaggagttcaagctgccgtaccaaaaccccacgccatgcactgaggagaggtcaaactgccgccagtgttacgtgagcaatgcacaggacccactcaagtgtgctgaggcagtcaagagatttgaagcatgtgttcgcctggcgaggcaaaggggcaacacaaaagttgctcagtagccctggaagatttgtgatgaggaaagaactgatatacgattttgctttgctgtgatgatttaataacctggaattttgatgagacctaagacatatttctacaattctaatggcatcgcaccaggctaggtgaggaagctacagatccttgagtttagggattctgtattgcaaatattgggtaaaaatgaaacatgaattctgggtgtttttctctgattggtatcatgagtgaaagcgttatccatacataatctatgctgttgccatttgcgttttgcaaaacccttattactcgtctgctttttactccctggtttctgttgtggtttagctatgctactgcagcatggttcttcttgtggtatcaatccctgattaaaacccaaccattgatagtcatcttgtgggattgagcattttttttcttactggtaaccgagcaaggcgagcatgcattagtaactgtttagtactgcattgttggcttctccaacaagatgtcttggtgtaaagataagatgtcgaagaactttatggtgtagtagtttcagaagtagatatctgatatcataatgcactattacagtcagtcttaagcattcatggatgtttaagatgttagtctttcagaaatcagaatcacctggatggagtaccttaatttgcctggcttacaatctagaatagtgtttttgcttgtgaaatggtaggtaattatggagacctaagagatggattccatctgtgtaggagttggaacttggatttcttttttgctataatactgtctatgttgctgctaaaaataatccactgcgtgtaatagctacggagtacaaaagcaagcccaatatttttttcagcttgatcaactaggtacaagatggaaagctagtgcatgtgctgtttgcagctaatgtttaagtaatgtatactccattttacacttgtgaaggtctttttaagtgaaatatctgcggctgtcgtgatgcccgtatatacggtcaaatgtattgaatatcagaaagcgaagggtataaagaaatggaggaaaaaagaaggcaagaaagagatgttgcataaacgctctccattaaataattcagctttcatccgtgacgtttcagatgaaagggcagggaaccaaaaggcaggcaaaggtgtgagtgaggctgactagcatttcgcttgctcttatcatcttaagatgatggccggtaaacgttcctgaccagacaaggccccgtgcgaaaattcgatcaatcaatctatgagtggtaacaggaatctatctgatagtatggtatctgtcaagagattagttacttgttgtgcttgtcagcttcatcctctaggtaaagcctgtggtgcattgcatatgtacaaaacctcagcttgaagcttcagttgggaaaacagaatggtataaaacttcagttcagctgggagtacaaacaggtagcgtataaagtagagtagtacacatatacacacacgcagatggagtggttggatggatggatggatcatgagcagtgatgagagacgtactacgcattagcacttgcagtgtcaacgtaaagttgatggcactggcgccttgcaatttccctgtcctgatggactctctgattctacgcttcaacgactttatgcttgatgtggttatccattattataactaaatgttgttgcaacgcctgtgttaatttgtttgcctgtcatacatacatacatacatacatacatacatacatacatacatacatacatacatacatacatgcatatatttttacacttacaccaccgaatactgatcgcgttgatccatttcatggatgattctgagcacacgcctttaaactgtacaactagctaattgaatcagatcgagaacaggccatccaatgattacatttatacaggagatgataataataacatgagtaataagagtagaggctgaaaatttgggagaatatatgtgccaaactgctcaattaagctagctatgagatctgaatttgatagcagtgccaactgcccatgcatatataatactagtagaaaacagtaataatttaaaacagtcttggtttatgcatggtttgatgtgctgaacatcaaggaagcaccatgtagatagtagaattaatatgaggtaggatatatatggaggaggggagaagacaggatgagcaagaaagaagaagatagagattacagagggcagggcagacgaactgcagaaatgaagaaactaaagaagaagtaaaaattaatcggtggtgatgtgtactccgatgacgatgacaaagagggtgatgagggcgaagtagatgatggagtggacgacgatggacatggcgctggtgtgcaggttgccgaactcgacgaagtggtgcctcccggggagctggatgagcagccccggcgagagcagcacgaacagcaccaccgcgatcaccaccggcccccagtctgacatccttcctaatttcctttaattaatgcttgctttgctttcgatcattaatccttcttcctcctatttctttcccgatagagcttccttgttgttgttgtagttgttgttgttgttgttaggagcaggagggtagtaagtaagcgaggcgagcagtagtaggagcaggtaaggtagggtatgcagatgcaaatgactcactcactgtcctagtattggcaa

SEQ ID NO: 79240 - DNA, 22207 bp, Oryza sativa
aagatatgggccgtgtttatatgggcccaagccctaagaggagagtttaggcgacgggacggaaggcttcctcctcctcctcctactcgagactcgacgccgccacctccacctcccgtctcgtctccagaagcttctggaacacccttccggcttcaattcccccctgctcgggtcgggtagctcccttccatcatccatggccgacgccaccgccgccctctcaggtacagtaccatcttccaactcaactgttgacctagtactagtactgaggtctgaggtctgaggtcgcttcgaattcattggctgcagctcggagcaaggtgcaagctttcctcgaagcggctcgtgccggtgatctcgactccctcaagagtaggtgcccccatgccttcctctctctctcctttgctttccttgcgtttcttctcatctcctctcctcatgcgccattgcagagctcgctgcggcgctcgacgaggagggcaagggcgtcgccgccgtcgctgctgccgtcaaggacgccaacaagcgcaccgccctgcacttcgccgcccgcgagggccgcacccacgtctgtcacttcctcatctccgacctcgccctccccgtcgaccccaaggacgacgatggtactactaactatcactatctcttactctcatctgatttcttcacaatctctcatccatcagtttacatccactccaccaggtgaaactccactcatccatgctacgcgccaagcccatctccaaactgtaacctatctgcttcaccatggagcagatccttccgttgcttcttccctcggagccacgccattgcaccatgctgccggcataggtaaaattcatcatctatttgccatttcacttcattctttccatggattgatggtctatactcttttcttttttctcccattttgattgtgccaacgcctctataaatgcgtccaacaccactctccttttttttttgtttgcatctgcagggaacctggaccttatgaaactatttctctccaagggggttgatgttgaatcagaaagcgatgccggcacacccctcatatgggctgctggtcatggacagcaagaggcagtcaaacttttgcttcaacacgatgctaaggttgctcctcaataaatccactatctcctatctcacttcatatctcactgatttaacgaacctgagcttctagtcattctgttcagaaatcttcattatgctgaaattttaatatgtcgccttttaatattgtcaaatactagtagcaactgacactttaacagtaaccaccaagggttctcaagcttgctattgttaagaagatgctatcttttggttctaatagcatctgtatctattatgtttctttgaattggacaggcttctctttgtttagcactcaaccacctttcaatcagccgttcatgtggcctttccttaacttttttactgaagctagttattgcttggcagccaaatactgaaaacgatgatggtattacgcctttgttgtctgctgttgcagcgggttccctcccatgcttggatattctaattcaggtacacaaatctaatttcaagagtaaaataccaaaatctgttgcttttactttaggatattatccacttcgatgccattcattggtcatatggtttctgtatgctatatttccttgtttagtaatctggcttgtgcaatgggggttcagacaagctcatttttcgtgttattgattagattgctgcatggcaaatcatagtatgtcacgttcttatatgtgtgctacctatatcaaaagattttgataagaggatcaaagtgtctgttcttacttttgtcatatgctgtttctgttcttggttttgtttgatgctctgttgcttctacaccccttacatctatgattcgtataaaaaaccgatcatataatctgctacacaggcaggtgcacatccgaatatcagagctggtggagcaaccccattacatattgctgcagatggtggaaacatggaaataataaattgtttacttaaagctggaagtgaccccaatgcatgtgatgatgtaagttgtacattaatcagaattccagtgtatcattaaatatttaaatgtcaatagccaggttcatgtgcattgattggtcaaaatgattcgtaagagggtgtcaagcgtttgctgtttgttccacaccatgtatgataatgaatatccctttcttggtcagcatgtgttactctgaaaatttccaccgtttcattatgcagtgaataactattgtaaccctgtagtgtattgtttagctggattggcaactgcttttgcaattccatcatctgtcctttcttgcattattattgagcaaacagcactgggctgcataatttcactgaaggacatgactgttgattttggtgtagcagtagagctaagtaatgctaatggttgaataactattatattcttctacaggatggactaaagccaatacaggttgctgctttgaggaataaccgtgaagttgtggaacttcttttacctttgacatcaccaattccaggtgtttcgagttggagtattgatggaattatagaatacactaaatcagtcgaggaaaaggtgcaacttcaatcttctcatgatctattactagttgcaagttctttgtcgatcccaatggttgaataaattttgcaggcacaggtaaaggaagctacaactcagaaagcagacagattacaagtaccacaacttgttgaggtgcattgcaatttactttatagttttattcatcttcaaggctccaactatttaataactgtaagactcaagatctaactattgctgcaaatggtgctttcctgacactgtacaggtgtcatctgaggcaaaagagagatcattggaggcaaaatcgagaggtgatgatgccttcagaaataaagactacctagtagcagtagatgcctacacacaggtaagaaccaaaccgcaagacagcgtgtatttttagaaaaggcgcataagtttatcatatgaactcaaattcaaagagtagaatggaatggaactacatttcaggctattgagttaaatccaaacgacgccacgttgcattcaaacagaagcctttgctggctacgggcagggcaagctgaacgtgctctggaggatgcaagagcatgtcgagcgctgaggccagactgggcgaaagcttgctacagggaaggcgcggcactgcgcctgctgcaggtctgttgatttcagtgataagtttgggaactgataggcagttgtgattacctacctatatatttgttgctgaagttgttccggtgataccaacagaggttcgaagaagccgcgaatgccttctatgagggggtgcagcttgagccagagaacggcgagcttgtgagcgcgttcaggtagtaaagccttcctctgtgagcaaagaaaagcaatgaattcctccgttgtttagcaattaacatagacatatatagggtgtcgttatgattggtttggaactcatgtgtgtatgtgtttgttattccatgcgacaagtgaagttgattacttaaactgattgacagggaggcggttgaagccgggaggaaattccatgggacggacaagaagcaaaaggcagatgcatcaacgtgatgtgtttttggaatggcttagacctatacaaggaggaatcactgaatctgtaccactagattagtattagtttggcttggccaagaaacggagcagctgaaatctgaacacctcttttgatgttgctacaaatttattatattagtatcaattactatcagattgaattctgtttgtgtcgtggctggttctagattcgagtggctaaactgtacccatgttcttcagcatttctttaatctacggtattgagaaattcatatcttcctcatcataggatgattgattacctaaggagctcccgcgtccctctgaactcttggcatgtcaagagacaatggaattgatggcatcacgcatggcattaatcaaagaaaatatcatgagtgaatacacagtactatgacgacgataaggttggggggggggaaatgtttttagagaaaaaaaaactccataacaaagatgttggaaggaagaaaaaaaaatgttgggaggaagaaaagaaaaggtctcagtctatatatatatatatatatatatatatatatatatatatatatatatatatatatatatatatatatatatatatatatatatatagagagagagagagagagagagagagagagagagagagagagagagagacgcaatggcccaaagaagaaaaaagcccaataatagtaagtagaaagcccgacacagagacagggcagaggaagaggaaaagctgttcgtctccccaaccccaaccgcgacgaactagggcgacgggccatcgccgtcgtcgccgccgccgccgcagctcgcgctcgctctcctcctctggcgccgttcctctttctcctgcgtcgccccatcgacctcgaccgctcaggtaagcatccgctcgatcccctcgccaactatcccttcaattacctactttttaggacgttaggatttgccatcggaatcgcggtgttgccgcgaatccggtaattgatctctcgcccaccttcctgcacatgcactttttatgcaaagaatcctcctaatagccaattgtctaggcagatctggcagccgaagaaacaaagatagatgatcttgaattaggggatgactcctccttttaaaataaaaaaaatcaagataaatgccactacactgtttgctctgatttaacttggcacacagtcatgcctagtttacagcttcttcttctatgctccatactctctgtcagtatcaaccaagctgtataaatgtttctcatcttccttcacatacaaccagcacaatgtgcttcattgtattatgctaacatatatgatgaacatgcgctttttacgactgcatttcaatacctcctgtgtatgtgcttgctgcattgtgttactacttaagtaaacttcatgctgatgcctcaacctggtttccttttggttacttctattgcagcgtctgtttgtaactttctgttatgggtgactacaccatccagattagcaccaagctaatcgaccagcttgctcgtgatgacgagaagatcaaaaagaaaaccaggaaacccaagcctaagaagactgtcaaacaacatcaacaagagccccaggacaactcaagggaactcccagcttctgaacccaaggctcctcctggctggccactgcagcctcccatgtatctccccgtaacccctgctcctccaccacccccacctgctttttcagagctggaagccatccgtgccgttctggaagagagcgaaaaggttcaggagaagctggataagcagcatgctgggatgcgtgatgaactcatcaagaaatcaaaagacctgcgtgacaaggagttcaagctgccgtaccaaaaccccacgccatgcactgaggagaggtcaaactgccgccagtgttacgtgagcaatgcacaggacccactcaagtgtgctgaggcagtcaagagatttgaagcatgtgttcgcctggcgaggcaaaggggcaacacaaaagttgctcagtagccctggaagatttgtgatgaggaaagaactgatatacgattttgctttgctgtgatgatttaataacctggaattttgatgagacctaagacatatttctacaattctaatggcatcgcaccaggctaggtgaggaagctacagatccttgagtttagggattctgtattgcaaatattgggtaaaaatgaaacatgaattctgggtgtttttctctgattggtatcatgagtgaaagcgttatccatacataatctatgctgttgccatttgcgttttgcaaaacccttattactcgtctgctttttactccctggtttctgttgtggtttagctatgctactgcagcatggttcttcttgtggtatcaatccctgattaaaacccaaccattgatagtcatcttgtgggattgagcattttttttcttactggtaaccgagcaaggcgagcatgcattagtaactgtttagtactgcattgttggcttctccaacaagatgtcttggtgtaaagataagatgtcgaagaactttatggtgtagtagtttcagaagtagatatctgatatcataatgcactattacagtcagtcttaagcattcatggatgtttaagatgttagtctttcagaaatcagaatcacctggatggagtaccttaatttgcctggcttacaatctagaatagtgtttttgcttgtgaaatggtaggtaattatggagacctaagagatggattccatctgtgtaggagttggaacttggatttcttttttgctataatactgtctatgttgctgctaaaaataatccactgcgtgtaatagctacggagtacaaaagcaagcccaatatttttttcagcttgatcaactaggtacaagatggaaagctagtgcatgtgctgtttgcagctaatgtttaagtaatgtatactccattttacacttgtgaaggtctttttaagtgaaatatctgcggctgtcgtgatgcccgtatatacggtcaaatgtattgaatatcagaaagcgaagggtataaagaaatggaggaaaaaagaaggcaagaaagagatgttgcataaacgctctccattaaataattcagctttcatccgtgacgtttcagatgaaagggcagggaaccaaaaggcaggcaaaggtgtgagtgaggctgactagcatttcgcttgctcttatcatcttaagatgatggccggtaaacgttcctgaccagacaaggccccgtgcgaaaattcgatcaatcaatctatgagtggtaacaggaatctatctgatagtatggtatctgtcaagagattagttacttgttgtgcttgtcagcttcatcctctaggtaaagcctgtggtgcattgcatatgtacaaaacctcagcttgaagcttcagttgggaaaacagaatggtataaaacttcagttcagctgggagtacaaacaggtagcgtataaagtagagtagtacacatatacacacacgcagatggagtggttggatggatggatggatcatgagcagtgatgagagacgtactacgcattagcacttgcagtgtcaacgtaaagttgatggcactggcgccttgcaatttccctgtcctgatggactctctgattctacgcttcaacgactttatgcttgatgtggttatccattattataactaaatgttgttgcaacgcctgtgttaatttgtttgcctgtcatacatacatacatacatacatacatacatacatacatacatacatacatacatacatacatgcatatatttttacacttacaccaccgaatactgatcgcgttgatccatttcatggatgattctgagcacacgcctttaaactgtacaactagctaattgaatcagatcgagaacaggccatccaatgattacatttatacaggagatgataataataacatgagtaataagagtagaggctgaaaatttgggagaatatatgtgccaaactgctcaattaagctagctatgagatctgaatttgatagcagtgccaactgcccatgcatatataatactagtagaaaacagtaataatttaaaacagtcttggtttatgcatggtttgatgtgctgaacatcaaggaagcaccatgtagatagtagaattaatatgaggtaggatatatatggaggaggggagaagacaggatgagcaagaaagaagaagatagagattacagagggcagggcagacgaactgcagaaatgaagaaactaaagaagaagtaaaaattaatcggtggtgatgtgtactccgatgacgatgacaaagagggtgatgagggcgaagtagatgatggagtggacgacgatggacatggcgctggtgtgcaggttgccgaactcgacgaagtggtgcctcccggggagctggatgagcagccccggcgagagcagcacgaacagcaccaccgcgatcaccaccggcccccagtctgacatccttcctaatttcctttaattaatgcttgctttgctttccttccttaatccttcttcctcctatttctttcccgatagagcttccttgttgttgttgttgttgttgttgttgttgttaggagcaggagggtagtaagtaagcgaggcgagcagtagtaggagcaggtaaggtagggtatgcagatgcaaatgactcactcactgtactagtattggcaacgtacgtacagtacagagagaatgaaagagaaagaaggtgaggtgcggttcgtgggagtggatggatggaaagcacagcagagaagagaagagaagcgcaggttattaggctcgaattcgaccggtgcctgctctacactgcaactgcaactgcacttgttgatcatgctttcattgccattccatatttctttctgtaccggttgtatgcggttggtgcggcttcgctttctgttgcacatgctgcttgcgactcattgctaccgtttcctctttctccacataatactcgcagcaaccatctactgctgttacttactatactacttctctattcacatcccatctattaatctatagtattattactatatgtgtatgtattatctgcttatatatctcgttgattgatttcatcctgcacttgcagcgattactttggtcgtcaaagtcatcattttgctgattacccggaattaaggacggactcctgtctatatagcatatatactcctgtcacaataggcagcagtaccatcgctcgtctttatttatttatttttacatttattgataacggacacacaatgaatgaatatatataatttcatgctgagctcaactagcaaactaaactagtaaaaaattaaatgcttcttgcatgcctgagcctgactcagctagtgctcacctaatgacactcgatcttcttttcctttctgaacaagctcaaacgcatttgaagagagcactactgctaattgcgtagtaattgcgtgtgctaattagttgctagtaatagagaggagcacagactgttcgatggtgctatctagctagctgcagcagcaggagctcctccctttttgatgcttggacggattagatagagggaactattacaaccaatctcaagcttgtggctctagtaagtgcttgtgtttcatgtctcgctttcagccttttctttctatggccggaccaaaattgcagcgcaacaggatatacagatcaaacaaatttttttttcttttctttacttttgtgcgttgaaaaagaaaaagaagccgatcaaggtcggatacgaaaccaaaagccacaagtatgtctggaacatatggattgagctatcaagttaagttgtagctggtccaggaggaggagatgaccaaatacaatcgatggagtgacctggatatgctgctgccattcaaaagcagtacctcaatcaataatgcatggacattttcataccagtgcaaaacatagtattcatcatccatatatttttgtcctttatatatatatatatatatatatatatatatatatatatatatatatatatatatatggtgtgttccatttcattaatcccccccttttatgacgcattcgtggtgatcgacgggtctgtgttgcttcatctgaatgaaatcataactacttaacctttgctctggaaattaagatgaaaattattaagccagttcttaaaccaaatcatcagatagatgaattgatgagagtaaagcaaggaatctttttttggtgcctaggctgcttgcacaagaagatatatatctccatcagcctctccaactaaccattaatttaagagatgatataatccaactgcatttgtgagatgagtagagacaacagtagtacattcattatcgatatcaggatggaaaatgtgcagctcagtgacgcatgcaatcagccgagatgtcgtgtcagtgtgctaatctcaggccacctttcgtctggatcgatcgcctgcctaattcacttacgtttctccaacctgttgttttccctcttaactgtaatccgcgtaagcatactgcagaggtcaagcaaagcggctggcagtagcaggcttgagcatttagtttttggttagaatctaacaacatgattaacaaatcgattaactttcttcagctgaaactctgattaagatggaccgagcagctgagttcagtttgttcagatgctacgttatgctgccagtacctttctggttatttaatcattattatgctaggcagataccaaatttaattcagttccgggtggagctagcaacgccacaccacaccacaccacacggataaaattcttggagatttgttcaatatagattgtgaaatactacactctatagatgtgtgatatatcctgaagcttggttgcaggaatagaataggatggatatatggatggtcagtcggttgtactgtgcacataatgtgtagcttttgttttgtagctcaacttaatttgacatccatccagttccaggtccaggtccagggcagtcgctgtgaatggcgatggggcaactacttcatgctttccattaccattgtgccacgcaaaatgccaccaaaattcttcctccttgggaccctgctgctactgtactgatgctgccctgcactcccaatggttttggttgcacttgcagcaattaattaaactgcctctgctgactatatgttattagtatctccctattatagtacgagataactcttgaggtttacaaactaccacattaacaattatattgtgttgatgtagattaattgacacagttttatacaaaatataattgtatctattgaaaaacaaggtaagagttgtgtatgaaatctaaaacatattcttaaaaatctattgtacgcaaaatacaattggacgtatagacatagaagctagtggttgtatatcaaatgtaattctactttcaaagatctattgtatacaaaatacaaatatctatggaaacaaaatatatgtgtatgccaaatccagctcttactaaaaagaaaaagaaaaaaattggcttcgcctaattttgcgtgggaaatttgctagttgtaatttacttgaaatgctatgaatggtgcacttttgattttgctacatatatatgtggaggaagaaactaagtaatgagtaactctgaaatcaattcctttgagtcacaatattatgccaagaattggaaggaacacacaaatagtagtacaaattaacgagctaaggtgagtagagatgatggatggaggtgcatatatactgctatacatatgcaattgagattacctagaagaaacaaagagagagaatcagggagaggagccaaggttgatctggacgccgatggcgacgaggaagatggcgtcgagggcgaagaagaggatggtgtggacgaggatggagacgacgctggtctggaacttgccgaactcgatcaacctgcacttgcctggtatctggaacagaagccccggcgacagcaggatgaacagcacccaagatatcagcaccggaccccagtcctgcatcttcttctccttgctttcttcttcttcctcttcttgcttgcttcttcctgttgctcttcttcttcttcttcttcttcttcttcctactgatgatgatgctcgaggctttcctccttgtgaacgaaccaaccaaccaaggattggatatgatgatgatataggagaggagaggatgctgcctactggagcagtattacattcttctctacatacaagtatggatatgcagctgaccacaaggtccactcgatgaggaatgtgcggtggagatatatatatctacccaccataatgtttactatactacactagtacttgctgcctatagtcccatcacttgaattgcatataagaaaaagattggatataaactcccctattttttttactagtaattattatagcccagtttcctgattaaaaattgtagtattattaacccagattaagctgtgttgttgcaagtcaagtcacagcaacactagcaacagccccgttcgaatgtcctgaaaacggtggattaaattttggattaaagtggcatgcttttcaaactgctaaacggtgtgattcgtgcgaaaactttttatatgaaaattgttctaaaatatcagattaatccatttttaagtttataataattaaaacttaattaatcacacgttattatcctctcattttacgtgaaacacttaatctttaatctttaggagattcaaacaccaccaaattcatcggttatttcctcatcagctgcaagcctgcaatgtagtacttaggtagcatcagctagttctttctacctagtgcagtgcccagtataaggccaaaaccagaggatgtacaaagagcaactgaggggtaaagttttacgtgtcacatcaggaattatataggatgtcgcatggggtgtttggacactaataaaaaaactaattacagaatccatcaataaaccacgagacgaattattaagcttatttaatccatcattagcaaatgtttactatagcaccacattgtcaaatcatagagcaattagtcgcaatctgtgcaattagctattttttaacatatatttaatacttcatgtttgtgttcaaacgtttgatgtgataggatgaattttagggtgagatgtaaacagggccttagtaaatactccctccgtcccaaaaaaaaaaaaggcaaaccctgagtttccgtgtccaactttgactgtccgtcttatatgatttttttttataatttgtattttcattgttgttagatgataaaacatgattaatattttatgcgtgacttgtctttttaatttttttcataattttttcaaataagacggacggtcaaactttgagcacggaaaccagggtttgttttttttaggacagagagagtatgcagcaacaaaaggtattgggaaaggagtaactttagtctgcgtatgcacgaaaagacagacatttgatctttcatgaaccacaacattatttcctgaccctcgacaggtaagaacgttttattccagccgaacaatagaggattcttctcaacttagaaatcttggcctcaactcagcatgatctctgactgcgcggagaacatgcgataagttcacagcttactatgaaaccaaaaacagcaaagtctccgggggaagaagattagccctctggcacctattagaccactggaagctccccacactcactgatgaccaccttcttcttcgggcggtcccctctgtcagtctcctgcgattcgatcatcttaacgatgtccatgccttcaataacctgcccaaacacgacgtgcctcccatccaaccaaggtgtctgcattcgcaggtagcagtcagcgcaatgtaattttgagtgagtttcgacactagtacacagtgaacatatcagtacagtgttaccttgacagtgcagatgaagaactggctgccattggtgtttggcccagcattggccatgctgaccactccaggtccagtatgaaccactacaaacattacaagacatataatcagcacaaccacaagataagaagcagaaagaacgatcagattaggtcatttgtcagacgtacatttgaagttctcgtctttgaaggtccggccatatatgcttttccctccagtaccctgaaatattcattttttgaaacctactttatccacatgcagaagttgaaagctgaatgatttgatgtaggctaggtcaaaaattcataattcatgaaaccaggcagctgcatgatttaatttaggccatcaatttaaagaaaaaggatttggtgctaatctccttgtaatctagccatgaagtcaataatcactgcatacacattatgctgatcacaaactaccaattcatactcataatgtacatgatgcaaagcagtataatgatctaaaacaccatagggcaagcactgaagtgcataacacaaagttgtataatgatccaaaacacatatataggtcagctttctatccaaaacagcataaagcgctaacattgataaaacaaatcaaacttttttttttttggagaaatagttggctcaatggtgatagatagaaacaaacacatgagctcattcagtgttgtgagtaatgttacactatgtgactttttccaatagagtttgtcagatgaaacagaggaacaagtgcaacataggagtagattataaagaaagtaaataatgaagacatacgttgcccttgtcaaagtctcctccctgaatcatgaagtccttaatgacacggtggaaactggaccccttgtaaccaaaccctttttctcctgaaaaggaaaagggcaatggtatgtgtatcatgcaccaaatctgggtaatcctgtaaagtagtagatgacagaagagaagaaaagcaagaagccctttgtaccagtgcaaagagcacggaagttctctgcggtctggggaacatcatccccgtataggccaataacgaccctcccaacgttcttcccaacagggtttccgatgcttatgtcaaagtacaccttgtttgtgattttggactggaggtccacttcctgcaatgtatgggagaagtttagcaaaactgaaagaataaatttgaagcgtggtatccagttctcccacatagggtaagaataatcgatacttgcgctgttcttttatgtatgatgttaattgaactaaccaacgtcatatattaaaggaaggaggtagtatatcgtaagttaacatctagtggaggaaaacatgaaagcgcatagtgcacatgggaaaggaaaacccagctttcagtagtacagaagggcacacgtgtttcctcacaatgttgcaggcagtcactgatgatgaataacgtgtttacattcggtgcacatacaaggtaagacctgtaagtagcagaaccctatggtcgaggcaactaaaattattaatcagagcaggtgaatacataataaagcattggtgatgataagcctgaaactgcaattttggtagcataaatttcacctggtgatttaaaaatctgataacaaaatttgacatacaaaggcattactagtattagttttaatttaatggtgttggaaggtcgaggtcatctgtgctaacccaatatctcttcctccaaagaggcaacaaacaggggccggtattgcggaggctgattgcataataatagtccagtaaggtggagtagtaaatttgactgatatactactagacaggattacaagaatggatgcggtgcggcaatagaaagatatatgtagggcagataaaagaagaagatccggggacacagtaccttggggtcagcggtggcggaggagacgaagcgcgcgcggctgtgagcagcggaaagcgcaggagtgaaacctccaaagacggccgatgaggggaggcgtgcggtgccggtgccggtgcggatggagaggagcggcgagggggttttggaggcgaggagggcccgctccgccgccggccgcgcgatggcctgcagtgcaaacacaagagaagaaagagcgacgataataagattgagagctcggtggggaagaagaggagagcagaggccatggatgagtgagcttacgagtgtggcgaaggaggttgcgaccgccattgttgatgttgaggaggagaccctttctctctctctcgctcaggtggattgggattggataggtagatagggcattgcactgggatgaatggatggcatttttgcatatgtgtgcacaggaaatacaataatcacacacaccttcttcattgggggaagtactatattttatttttgggaccaaaagcatctgttaaatcaactctatttgtcccaatccaactatttaaaatttatttatttacagtgtctctttctataatatatcggtaagttatcaattattatacaatataccatcggactatactattttcaaaaatacctaaaatacaccatataaggttaatatttgatttatcctaccataagtttcagaagaaaaaaaatgctagtttatgcactagttttaagattttacatttttatatttttttaaaaaaaattatttatccattatatactgcaagaattttttttttgctgtttttaatgtaacttttttcgagaacatacctcatttctaatgtaaattatcttttgcgtaagtaatttctctctcataaaaaactcaaaaatattttttttaaaaaagtgaaaacttgaaatttatatataaactttcatgttgggtaagtaagctacataaacaattcatatttttaaacccttagatgaataaattaattgttaaccttatatgtattttgagtattttttaaaactaggacctgagtaaatatttttcttgagttttaggttataagacttcacattcatatatgtctagatctattaacacatatataaatatggacaatgctaaaaaataagaataggaggtggtattattttttttttggtagagaggggagggggccgcataggaggcaggaggtagtaaaatgggctgatgggcatagtattcacgggggcccatgtaatagatgggatgggcttgaacacacatgtaatgtaacaatagcctcggtcgaggtgaggtggaagaagcaaagcaatctccgtgagcggtgatggcgcagcagtggcgatctctcctcttcctcctcctcctcctcctcgtgcccttcgccgccgccgccgggcaggatgcgccgttcgtggtagcacagaagaaggttgcgctgtcccgcccgggtccaggcgtggagcgcctcgccgtcaccctcaacctctacaaccagggttccgcgtcagtcccctccccatctcatctccctcttcccccagatttagatccacatctctctctccctctcttcactttgttaacctattattgctctatccgcctttccttattgattaattcgcataggtcaaaaacaacgggaattcctactgttagctagacttgatagatagccgcgagcccatgtttccctttctctgtgtaataatgtcaagctgactcacttgttgataacacaaattatcacgctactattgtgcatatatactactcctacatgacatgacatgattgatagtcacatacacacacatcaatcgctaatccatttctccatctatctaaccacactgctattttagggaaggggaaccggaatcctcattatgggggtgtttacatccagggttgtaaagttttggcgtttccgggtattatatagggtgtcgcattgggtgttcggcactaataaaaaaactaattacagtaaaccgcgagacgaatttattaagcctaattaatccatcattaccatatgtttactgtagcaccacattgtcaaatcttagagcaattaggcttaaaagatttcgtctcgcaaagtagtcgcaatctgtgcaattggttatttttttagcctatatttaatacttcatacaggtgttcaaacgttcgatgtgatagggtgtaaaattttagggtgggatctaaacaggccctatattcttcactgccagtgccatcaaccattcatcttctattcttctatcatgttgtttactactctctctctctctctctctcattttttacaggaccgcctatgatgttagcttgaacgacgactcttggccacaggaggcttttcaacttatctctggaaccacatcaaagattgtggaaaaacttgatccgttagtaacaacacttactagttacttatgctttctcacaccaatatttgccctttgacaatcctttttacctcttgtgctttcagtggtgctactgcttcccacaacttcatcttggagaccaaagtgcagggcaagtttcagggctctcctgccattatcacataccgtgttcccacaaaggccgcacttcaggtacatcaaaattttcatacttacacttcaggtactcatgcaatttgatgcttgtcatatgctttgtttcacaagttaaacttgaattttcgtttcgtgatgctttgtttcacatgccatcacaatcgagtgagtatacctttagtattgagcaccggatgagccttttctaaggactgcagtgtgatcgatctcattattccatggatcatagtgaaaggggctaactttgctcagcttaaatagctcattacgaccctagtacttggtgttctaattatcattttcaccatactattcctgcactattctcttcttgagtttaaactgccaattatttttctcaaggaggcttactcaacgcccatgtttccacttgatattcttgctgagagacctccccaacagaagtttgaattggttagttatctcataccatttgctttcattaagagtaaaacctttcctgattcttatgtctcaacgccttacttttttggtgctggtactcaacttatggatatgcaacttttgcacttgacctttccaggctaaggtactgccattgccctctgttttatgtaaacttatgtgttttatctaagtaggaaataggcgataagaaaagaaaaccatatggctagacattgtgatctaatgtgttaacaaacgtcatctgcagagacttgtggggaaatatgggtcgctggtctccgttgtttcctttgtcggtgtgtttatctacctggttgcaagcccgtcaaaatccactgctgcaaaaggaagcaagaagaggcgctaaatctgttttgttgccttttttttgttgtatttggttttacaagaatgtactctctcaggttttataaggttctcctatgtactctaagggattaactagactaaggcatcatctgtcattttggccttctgtagttgagcatctcgggtgaggcctgagctgactgacttaaaatcagaggtgtagatttgatacatcttaaatcattttagtacattcaaccttttgtgcctggttctcatttcatctcccgtcatgggtcaagggtaagagtgttgtctattgtgattcggatagggcttgaacctagcttcaagcgatgttctcggggagattttgtttgattgctactgtaagcggtaagataatagtgtatgatatggtaagcttagccgtttcttttttttccctgaggagcaggtgaattgtacaaggagcagatgatggattgagaggcgaattcacagggtaatatgtttccctgtctcctgaattgctagttcagatcctattctacgatgtactgcggaaagggaccacatgatgcatgttattgaaaattgacactggtgcatcttgtgttctgcatatctgagccttgatggaaagaaattataattctttgagttagaactaaactgaggtatgaatggctttttttttttggtttttcacggtggggcagcgctcaggtgtgtgttggggggaggagcaaggggatgtaaggaggactctgtttttacaaccgtagagataagtactggtaagtatgaatcaatcatcgtcctatttgtgtgctaaagcttggaaagacaagatgatgcagatgcagtacaaaccgcttactactccaaataacatgatgctggggcaggagccttgtggaagttggcccacccaattaactgcacagaattctagcctatctgcccactatcagtcacataggagtaaatataagcagcagctaggggggctaaagaaggaagaaaagcagatagagacctgaatcctcaactcaactgcaaacaactctttcttacacatagcacatactaggcacataggagttactagagatactactaggagtagtagcaatagagcatcaacataggaggcagcataccaatggagagcttgtgtgggcagcttgagcatgaacatgagcagcagctgcaccaatcctcctcatcttcacttctcccctactgcttcctttctgctccagagcctcttcctgtcccaggcttccctgccggctgcagcaaccttgaagagaaggcagcagcagccatggcggcctatgagtatgagagcagcagctgcagctcccttgaccccacctcaatgccaatggtgtactcaccaatagtgctgcagccacaggagtgccctctttcctttgtctttgacaatgccgctgccgctgccggcgacaacaaatgggtgcctggcattcaaggaagttgcccttgttcattgggctcaactcaagatatggtaattaagctcctactacatgtgctatctttgctcgcactttgccatgaaaatgtatatatacaactagatgaaactgcaaaattcagttatatatatattttttttcacaaagtgtttcagcatacatatgttttttttttacctcaaaggtttagcttcttcccacatgatgcatgatatattgaagagttatttgcttggtgatcatctttatctgaaaaaaatgcggcttcgtcctactagtaccaagtggaaatctacccaaaacctggaactaagtgcatatacatatgtaaatgtagcagtgactgctttctgatgcaagtagaattatcattgatgtttaagttgttaacccctttggtaagtgtccaaatatgtatgatgggcccattttatgttgtgttcatgtaatgatctaccttatgtggtcttgccatttaggatgcaagttggggcaagagtagaaagcacaagaggagcaatgtgggcttgaagggacttgaggagaaaaaggcaagaagggtggtactacatcaacatgatgatgatgtgaagaagaaggccaaggaggcagcaggtggggagccaccagctgggtacattcatgtgagggcaaggagaggccaagcaacagacagccacagccttgctgagagggtcactcactcaccagtcttttgttctcttatctgaatcgttgttatcttaattagtagtaacagctgtttgttagtgcccttcacttaactacaggagtagtaacatctgttgatttgttacttataggtgagaagggagaagatcagtgagaggatgaagatgctgcaaagcctggttcctggttgtgacaaggtcacagggaaagccctcatgctagatgagatcatcagctatgtgcaatctctgcagaaccaagttgaggtgctgctatatgtcactcagataagaattgaaatagcgtaattgagcacgtagtatcatcgatggctcttctgctctgtatatgaagaactgattcattcttttgtgctcattcagtttctgtccatgaagcttgcctcccttagccctttgatgtatgagtttggaccgggcattgatatgcacccagatgttcttcgacaggtaaagtaaaatagggaacaatgacagcatcaatccaaacgcaagcaagcatctctgaagaattctgtgattccagttttgcttctgccatgcatgcgatcaatatctctgactctcttagtacttagtattaccttccttgtttgattaagcttgcaaagatgccacatgagatggtgcagtgcatgggccaaatggggagtacaggcatttcactccaaggactaggaggaggacccacaggctttgctcaggtcaagatgataaccatagtctctctgaatctgaacccaatctgcatgactgcatcagatgtgatgtcgcttctcctgtgttgaacacaaattattccaccaagcactcatcaagagtagtaggagtagcagataaggaaggcaatgtgacactgatcatgcatgcgctgtctgtgcttcacctttgcattgcaggatggcagcagccccattaacatggtggtgatgcaagttggaaagcaaggccagcaccagggctctcttcaccagg

SEQ ID NO: 79241 - DNA, 739 bp, Oryza sativa
cctgcagccaaaactacaaaacttcaactcaagtatatacctttaattacatagggataacacaaccgatcaaactgcactaacaccaagagggaaagctactttctcattaaaattacagggtagactactctcactttattctattagcgaagaaaacatctgattgtgaaattttcaaatatcttctattggtcagcttagtaggctagttgcatttttctaatccagtcatagaatgtttgctacgaagttatactgaaagccatcaaatcagaaacttacattcaaccgtcaaaaaaaaaaaagaaacttacattcagcaatgcaggggatccattaaggccaaccagcagatgtggatgactcctttcaattttttgccgatactccaactccctcttaagagcttcttcacatgtgatagtaggacatgatgatgtattagatttgtgcatgcctgaaggtaacaaatagcacctatttggaagtgccagttgtatgtcagctaacaaagtatccccttccatgccatagaatcgtcaaaaaatgtgctgactttcaacatttataaccaaaggtatttcaccactttctgaaggtgtgcttatatggtccaaagctgcattttgtggaatcatcgatctgccataatataataacacgatgaaatcaataccgtatttggactcagaccaaaaaaaaaggaaaacgtatattatcaagcatccatgagata

SEQ ID NO: 79242 - DNA, 3104 bp, Oryza sativa
tacgcgaagagcgtgaacccggcggtggcggcggtgagggcgacggcgacgacgccggagccggtgaagatcggcgacaagtgggcgcacccgctagtggagccggagaaggggtgcctgctgatcgcgacggagaagctggacgggtcgcacatcttcgagcgcacggtggtcctcctcctgtccgccggcgtgctgggccccgtgggcgtgatcctgaaccggccgtcgctgatgtcgatcaaggaggcgcaggcggtgttcgcggagacggacatcgcgggggcgttctcggggcggccgctcttcttcggtggcccgctggaggagtgcttcttcctgctggggccgcgggcggcggcggcgggggacgtggtggggaggacggggctgttcgacgaagtgatgcccggggtgcactacgggacgcgggagagcgtggggtgcgcggcggagctggtgaagcgcggcgtggtcggggtgagggacttccgcttcttcgacggcttctgcgggtgggagagggagcagctgcgcgacgaggtgcgcgcgggcttgtggcgcgtggcggcgtgcagccccgccgtgctgggcctcgccaccgtcgtcaagggcggactctgggaggaggtgcagggcctcgtcggagagaggagggtgtggtgactgattacttctcaagggtgaccattatgtaattaattaattaattaatctcttaattaactcgcaagtaaagtatttactcctttcagattaatgattttaggcttttagtcatcacggtaggtttaaagagggttgtatttgtatactctgtatcttgtactcttatcgttttgcccaccactacgcgaacacacctcgatgcccttctcgtctccaacgcatacactacttcatactttataattaaagccttaactttcaaatcaaaattctttcaattttagaaatttcagcttagaatgtcaaattttcaatacattctaccactcattttaaaatttctacataaatattggcaagtttgtaccgataaactcaaatgtttaattcacgtaacaaaacaccattgagcaacttggagcctcaaacaccattcaaaagcctcaaacttccaactgaatggtgctcgctttgccaaacaccattgagcaacttggagctcacctgcatctagatccaagagtaagaagaatttgtgtgaagtgacttgctatccttggagataagaggctcgtccatgacccgggggggggggggggggggttgtatagaaacaaacacgtcttatgagaggttcatctgctccgccactatgctaggaacttaattgggctgcacatgggctatatattttacccataatccaaggccgggactacgagcctcagaaagaggatacaaaaacaaacaacattggatgtactatctatctactctctccgtcccataatataagagattttgaatttttgcttgtagtgtttgaccactcgttttattcaaaaaatttatgtaaatataaaaaacgaaaagttgtgcttaaagtacttacgataataaagtaagtcaaagaaataaataataattccaaatttttttaataagacgagtggtcgaacactacaagtaaaaactcaaaatcccttatattatgagacggagggagtatctatctatctattatatactaaaagtccattaaacttcctatgaacgctcctaagccaccacgtggcacctctacaaactctcctacgtcgccacatggcactctaataaattagaagaattaagcaaatgtgaactagttggttttcatttaatctggtggatccattatttttaaccgttagatatatagcatagaaaatgtcaaatagatttattatctttaaaaatccacacatgcgccgtacgtgtacgtgcatgtacgtacatattttgtacgtgggccccacgcccccttttcttttttttctttttcactaacacatgagaaaaaacaaaattcatattccagcccatatagttcggagtatgtacttgcatgtagggccccacgtccccacatttcttttcattttccttttttcactcacataagataaaaaccacattaataattccaacccatagttgtacaaatatatttatttttgagttgtattgtactatacgcacatcattgaaatattcataaaatatctaaataaatgaataatatacattatataattatataattgtatgtcacttaatgacatgtattgttaaattagaattgcattttgaaaaataaaaacaactccagttgtgagtaacattgcaaaaatgattcgctccctactataagaaaatactgttatatcggaataatattattaaattatcataattacactctaccaatcatatacctaataattaaaaaattactaaaaaagataaaaataacttgacaaatattagtgcactaccacattattcataaaaaataaggaaagctattttttattaactatactattaataattttaatgttatgatttaataagtaatattattatttatttgttaactttttttataccgtttagctgttcgagaaacgtgctcgctacaaataagggagtatctaatcctataagctctttagaacacactcttaaatttattacttagatacaaacacaatatatactatacaatatatttggtcaatcctggcctaaaatatcaatcgtaaatcctcactgatcctcatgtatgtaagttttatatataagccattatccactaatcatcaagccatattgcttacgaggcatgtgtgcacagtgcatataacgattagttggcccttgatttacttggggttggcaatgagcaaagataaggtgactaagagggagttgttaccaatcatgcaaaaagttgagaaaaggatggatagctggcaaagtggacactgttggtattttttaacgataatactagaaatctaattcccagcaatggcgcagaaatactcgtagtatattatggttacagatttcatccgcaaacgcacggatattctattgtagcattttat

SEQ ID NO: 79243 - DNA, 1666 bp, Oryza sativa
ttttaggggaaaagaaaaagagaagggaaccaagcacttcttttcttcttttcaggagacattaacttgtcatgtaactttttcatgtctcttattagtaattcctcagattttactgccagataaactactgaactttagaagcaaagacgtagggaatacaaggcaagttaaggatgctaaaacatactttcccatattgtttttttcgttttaggctcagttaataaaaaaactataattctaaataattttattgatggtaattggcttatttaataagttctttctaggagtattctttctaggttttcaacaatatctgcactatggagagtcgatatctgattctgttgaacctgcctcaaaggtggatttagactgggtgacatagcttaggcatgtcacataatatgaatccctcaaaggtgtttaggaacaagaaataaaatgggaatatgcagtgagtgtatccgggtactcacggcaaggtcttgggccttaaagcgtggggtgggccgagtgatctaggcccatacagactgcttgtaagttaagaaagggattaaagataaagctataaatcttatcccatataaataggtggcaggtactcgaattataagggctaccttaccatcactagctggccgacaccgtgattatataaggggcgcgggggaaacgctaaggattgatcattctcccgtatacacgctatcggctattcctacgctgatctgcgcacaccaatacagatctaatctacactgactggactaaggtattaccccgcgctgagggcctgaaccagtataaacaactatgccaccatctctacttaatcttgtgcaccctataaattatattgctaatcataagaatcgatagctggcatgctaaagtaggggtgcgcttgattatcatttcatgaggagatggcgtctttagtagttgtcttcgtctaagcggtagggcgaacctctccctccaacctctaaatatctttgtcggagcaatcggcagcatcccccttcccgatgacttccaaatccactcgggaatagtgggacttcaccaccgccaaggcatgatcaacgtccgaggtggccaccaccttcgacaaacatcgcacaacagtcggcccctctggaagaagtcgtcccacctacgcccacatgcccccctcctcgcgaaaacctaggaataacagttggagcgtcagcttcagggcatcaacaagttcaccccgcattgtcctggtggtctccacctcgtgttggaagtgctcccattgtgcctgattgccttgttgcactcctcccgctcggcaaccttgtaacaccctaaaaattttgaatttaaaatacgaaaacaaaaaaaatggaataatcaaaaatatttttcgaatttccctcatgctggattttttgtttcgaattcccttttcgccggtgccaaatcctaatttataaacataattgtctttttttcgcctcctttactcctttggagaaaattaccaagtctttaaaagaggttttccttgtttgtgaaaaggcctttgtcctaaaaagtctagcctaggtccctctcaccctaaccatctagctaggtcttttctgaaaaagtttattttacgtcccttgctacccaaccccttttt

SEQ ID NO: 79244 - DNA, 1846 bp, Oryza sativa
ggcgcgaggacgaaccgcgagcccgagcgccttcgaccggtacctctacgcccgtggctttgtcgtgacttcactcggtgtgccggtccccggctactgcacggtgagcatccatcctttcccttcccctcccttctccctcttggccgcattcctgccgtgccgccgccgccgtggcgctgtgccgcccgaagggcgaaccgccacaccggctccgtgctttgatcgccgccaaggttgaaaattttggaaattttggtcatttcggccacctccgatacgatataacttcggccgaaatttttcaattttttcatgaatttgggtaatatttgttcaaattcaactaaattttgctcaagattttggaaatttcgggccgaaatttcgggatttcggtgacccccaatcaaaaggactcaaccgatagagtgaaccctggtcgccgctcctaggcccctggaaccatctaccgcgctcgctcgccttgccaagtcccctggccgccggaccggccgcgctgcagaaacgcatgcgcgcgccgtgcattggggcgtggtcttcaccggccgaccgtacagatcgtcatgtttcacctttatatatatttcttgtaagctgccgtgtggtgctttgtaaccacatccgatatagtgaagttttctggctggcgctaaccatcatgctcctgagggacccggaagcccgccgccggccttagcctcccctctccttcaccgcttcgctggtgcgcctaggatccgcaggctgctgccgcctcggtccccaccagccctcgcgccgccgcctaacgacggcggatcccccaagatcttccccccaccggccgccaccacttccaagccgctcaccaccggtacaagcaagccctagcgccggcagcccatgctcgcgcgcttgagagggagagcagcgagaagagagaagaaagaaataaagaagagagagaggctgacagtgggcccaccatgaaaaagttttattttttaaaactagtgaaggagattaagttagctaagtgactaatatattaggctgacatgtgggtcccgtcttctaatgaaaaagtgtttaaaaacatgtttaaaacttgacaaattaccatgtctttttttttcttcaaaatagtttcatttttaatagtaaattccaagttatagtaaccacacactttaacagcacttagctatatacattttggtatatatagaagtttcctaaaactacactaacaacccgcgagatggcgtgtaagagagacacataagctctgtcctttgggactaattagagagagagagagagagaataagttcgattgatgcttctgcttcacttcgagggtcttccaccggccagcctgtttatcttcttgcaccattcaccgagctccccaagtgcagggcacaagtcgcggcgcgtgcacttccatcatctgcccaaatggattatgactgccatttttcttaactccctccaattcatattatatcatatttcgacttaacttctttaattttataacatttataaaactaaattaattttattaaatctaacatagaatatattttggccataagtttgttttgtgttgaacaacaaagctctcgtgcgcattcaacatagcaagcctatgaatacttgatgttgctgtaatcaagttcctggtgtttgtgacatgccaaggcaagactgaggacctggatgattgtgattccagatatcctagtggacctactcctaagtgatttccaagcaattggacttgtcctcacacaaagcagagtagtgaagattaaaaccggcctttttgttttgaaag

SEQ ID NO: 79245 - DNA, 63406 bp, Oryza sativa
catctccaatgatgatcttctccaaatgctcagtgtttatggtgatgtaaaggaggtagctatactgccataattgagtaattgactacaaaactgaaatccacacactatggtaatcatttgttgtttatagatttccagctctcctataagctgcaccaagaagtttgtagagttctatgatgttagagcagcagaagaagcactacatgaccttaataagggtggaatttcaggcccaaagttcaaggttgaacttaaccaacatggagaggcaggatcttggtaatttgcttggctgaatttttttctacccgtttttggtattatcttttcatactcgtgctagctatcaatgccttccttcatactataggtttagtatgttagttacctttgggagatgggataatatcataataaaatatgttcactgttttcttaggtaaaattatgcaaatactcctagatgcaaggaatgtatctcaagttctcattcacggtttttctcatagctttgcagccactaacacacctattggtcgttctttcattttgtggaacagccatatatcaactctatgtcaatcacttgaaccttttaaattttcattaaggacaaaccaactgggcgtgtaacttttttttaagcgttatttgattagtgtggtgaagattttatttatgtacttaacagcttgaggcagcaacattctagagaatggaagcaagacagtttgcctcaccaacctaaaaactcttcacctgggaccattggtacaatatattacttggatatattttggaaattgttgatcattacttattttgccctttttcatgccaaaacaggaaagttgggcaccaaatgtcaggacaacagcactgttcataatttattttctccagttaaccaacaattggagagcccaacccagtgcatctctacgactggtcctcaaattttatcttcacctatcagaattaaatctacacttcagcacaataatcaagcctctgttggcgatcttagtggacctcttggtcaaggaaactttggacgtggaatacaaaccctccacccacgctcattgccagagcatcacaaccgcatttgtaataactctaagtccatgacagtaagtggtaggaatgctagctctagacaagacggagtggatcacaatatccaaaaagtgggccctgctggtttttgcggtcattcttttgatcaaaataatgaaggtaacagttctcagcttcaactgctcattgttggctttactaacctatgtttttattatcataacaacataatggtgaacctttttggaaatattggatgatgtagttgatgaattgaccagcttaatgattttttttgttagaatttcatcagcacagaaattgttttttgcagcatttggctttactgaaattggaagttgcccccttcatggatatcactacacctggaaccacacaaatgtttttccacaaagtccctcagctccaatactgtggtcgaacttgcagcacccaatgcacgtgcatagttatcctggtgtgccgcctcacatgctgaacacaggttcttatcccatggaccagcatcacttgggttcagctcctgacaatggaggcagttttggaaatgtgcactcttttcatccaggatctctcggaagcataggtttgcatggtagccctcagatatatccatcagaattatctgcctttgcatccagcagaggaaattttagggttttcttgttctccccagttggcgggggatttcaatcccttcagcaaatgtgcaatgcaatcaatggtcggaatcctatgatccatgtttccacttcatacgatgctactaatgatcggatgaggagtcgcagacatgatggaaatcctgcacagtctgaaaacaaacggcaatttgagcttgacattgatcgcatagcaaagggtgaagattcacgcaccaccctgatgatcaagaacataccaaacaagtaggttctgcacatcttgccaccggttgccagctgtcttgcacattactcaggtatcttttttttcttctgttgactcaagtcatacttgatgtgatccacaggtacaactgtaagctgcttttggctgtcattgatgagaaccaccgtggaacctacgatttcatctatctcccaattgattttaaggtctactttttttttcttagtgtaaaagattgcaactgtgagtacaatttcaggactgacttttgcaatgttcacttttctcagaacaaatgtaatgtggggtatgcttttatcaatatgactgatccgcagcacataatcccattctataaggtatacatatcatgcatgcattactagttaagcttctccgtttttaatgtaccttccaagatctaagcatagcatatgatataacagtatttttattattgtgttgcattcttttttgtgggaggaagattttttaaaaagtatttctgccctgtagagtactgccagttttcccctggcattttctaattgaaagtatgcataggattaattggacttgacatttgctgcagacatttaatggcaagaaatgggagaaattcaatagtgaaaaggtggcgtcgctcgcatacgcccggattcaaggaaggagtgctttgattgctcattttcagaattctagcctgatgaatgaagacaaatggtgtcgacctatgcttttccacaaagatggtccaaatgcaggagatcaggtgtgaatatctctagtgcttattgtatacactaaatataccatatgagtgaccacttctgactgaccctattcgcacaaaatgattgacatggcggttttatacatattattattttctgataaagatacatattattattgcaggagccttttcctgtggggaacaatgtccggtctagggctgggagaaataggtcgctcatcagcttggacactaaagatgcaagtccatcaagctccccagaccaagaaagcaattctgtcggcaccgcgaactcaacttgccgtacgaccttggagcaaacctaatcactaactggagggcacaagaagctgtaatgataaactagggaattcccagttttgctaagtatttatttgactatcagggagccaaagtttgtgacctgtgagtgtaatgatgaatgaaaggctctgccaggcaaggcatcacctccactaaaattatgagagggatcatcagttttgccctgtgtatggatggagctgtgaactggttggtattgtaacggtactactacttcagtagagcaacaagtgtgtgcgtgtgaatgtgattgactctctgagagatgagaactggaagctgtacagttgatgagttgagtagtcgagtctttggttgagattgaccaccgaaagtacattcattctcttctcagattgactgcgccttgattcattcatttcatgtactactagtacatgtgtctctgactcttgtgccccttcttcaccccttgcacatcacacaactgcatggggaaatagtacacgagctgttggagttcattgcacatcaatctcaaaacctgcaaaaaagagtgctgtgcagacctagctaggcaaacttacaagtctaagggcaagttttatagtagtggtgaatacaacctctaatttaaatatatcatctactcattaattaaaaggtaacaagtgcaatatatcacatataatacacaacctctaatattaattcactctcacaccatcttacacttgttttgaaaattgtggagattacccaatgctcattctctcctaacttctctcattcacctcatcccatcccttaatcttatgtggcaaatttaagagctaacatataggagctctaagcagcagattagatgagatggtttacaagacattgcagcaagaaacaaggcaaacaatgatagtgctaggaaaaggagtagcatgagaatccaaggcaaaccatgccagtaattggaattggaaagttgtatgaggaacatccatcatacatccatacaggtaaaggtaaagcaaccactgtatataagtatatattccttcaactaacaacccaacccaagccatcccaaaagcacaccgcggcagttccagttcaccccttgtggatcaaaagagctagagcaacagcacaaggcaaacggcctaaattactaaatagatagaatatacgaatacgaccccaaaatggctccagtctccgtcttcttcccctctacagccagccaaccagccattcatccatcttcattcaggcttcagcgcgggtagccctcctggtccttgtcgcagggctaccatcagcttcaccgctagccttggcattgctcctcgtcaccctgcgagggctgctcacaacaggactaccgccaccgcctttggcatcaacctcactactcttcctgctgttgcgcttcacaggagttccgccgctcaggggagcatcctcttccgctgctgtctccatagcatcaccacctgttttcatccttttaccatcatttgtggcaacagcatcccccttgcgcttccttgcctgcttcttctcagccttctcagaagcccgcttcgtcgcctgtttcttttcaactgcaatgtccaccacatcagcactgtccatcttcttgtcaccttgttctttctcatcttctcctttgctcttcttaggctgcaggtcctcttccttgattacaaccacagccttgaccactttgccatcatccttcaagctgccatcatccttcaagctgctatcatcctctcccttctctaaagcttcgttgtttccatcatctccagatgactcagcaccattgctaacatctgagcttgtcttggtatctccttcttcaacagcctttctttgcaaggactcaatcaaatccatcatctctcgattgatctgaaagaagcaaacaaagccaagcatgagcaagaaaattacatgtaatagcatgcttcaacaaacataaacttgttgtacctgtggattctctaggaagtcacaaatatcagttggacatgaagggcacttcttcacaatcttctgtgcccttagagtccgcccaccccggcttctctccctcatagacgattgactaccatatgtcccaaccaaacacaacttgcagaagttatgagcacatggagtagtgagtggttccttcatcacttgcttgcaaatggaacatccaaactctgcaggaaacataaaccaatatagagtgagcaatttagtgcttcgaagctacgaacacaagttgtaatagtacatatctaaataacaagcatgcaacagaaagaacctttcagcagcctttcagtcacagacatctgggcacgccttgcaaccctccggatttccttgtcagttgcaggatcccctgataggttaggctttctgctgattggtggaggcttcacccacttccagccttctttctcctgttatgaaccaatagaaatcagaggttagcggtagcatagtatggtgacatggagccaaaataaagcattatatgatgatattgcatcacatagaaacaggcacatacatcaaagtcccatgaaggagttcctttcctctctgatatgtctgttgcacctttcagctcatcaactttggggagtggcctcggacggtcaccataaatatcacttaaaaccaaataacataatgtcagtatgaacaaaatgtgttgctcaaatgaataatgaacaatatgcatgtctcaagtcaaaagtaagcatttcaacgaacctagtccaaggagctggttcattgtcacaacgtacaaagagatacctgcaaaccttgaatttaccctaagagacaagacagcaaaatatccattatgtttccaataaaaagaattatcaactgatgaactgcagagcacaaaactacaaagcaacattcacaaagctgtgtacaagagaatggcgttacctgaacactaatcttcctccaacatttttcaatcctgtaaactccatcatacctcacaccagcttcaggagcatatgaagaacgcttctctttgtgggacctttttttaagggaatgtaatgagttaggggggcatgacaaactataaatcatttgaatagtgaaaaggatatatatttggatcatcaataacagacagacaaacaaaagagaacaaatatatacactaaacagtagtactccatagagcgacagtagtagtcctacaaaaattatctgtttcaagagccaacaaatatctacataactataacagcggcagatcagaattatctttctacagcaagattttaccaattataataataatggaaaggcacagattacaaaggtatgacaatttactcaggcataacattatctccttaagattaaactgctaagtgtaatcatggcagaaagaacataccgcacaaccctgacagggtaacccttgaggcaactaatacgaagagcagcattcagcttctcaaatttctggtctgaggactgctccttgtttgtacgcttgttcccacttagatctcttccaccactgtacaagtataaattatattatagagtgtattagcaattgctcatatcagagatcactgagaaaaactgaatgatggcaaatggtcaagtttgctaaccttccagtatatagaaaccattccccatggtcctcatcatcgacatacccacccgagagggctaccgactgagcaccatgtgtggattggccagcaataccagccacgtgaggaaaatgggcaccccattgcctgcactcaagtctgtcttcccatgtatccccaactagaacaccaatgcttctcttggggtcattctctgcaagaatggggccaaaatggtcgggtgggatagtaacaaagatctggccacttgaagcattagcttttccagccctcttagccctttcagttgtaaaagccttgtcaggtctatcatcatttcgtatgtaatgatacgcagctgcagagacagctgagttggcattctttgaaaccttagccatacggataacagaaactaatgctgagttgattcttggctgctctgccatttttgctggtatttgtgcccggcatttaccacatgtcctttttccgctgtggatccatttctggaagcacttcaagcaaaagttatggccacatggtgtctgcccaagacaaaagtagaatctgatggttagaaacgctacccaaaaaaaaaagggtccaatgaattgacagaatagcaagaacttttacctacctacaatgcatggatcaaaataagaattatgtgcagaaactggaaggttaaaccaataccccaaaagaacaagacagcacttttaacaatgcaaggtattgcatcaatccagaagaacaagcatgtgatggcaatagaagctagctgtaccacatacaaatgtctagtgactgattaggcagccgcttgggtgatgtaatgagctaggctggcaaggcaggacggtgtaagcctaatcctagagcctaggcaggttacgtggattgcctttttagaatactgtttgcattatcagaattgtacggtggatttggtatgagctaaaacaaacatatctaggcatagtaaatgtgtgcatgtggtgaaaattaggagtgacataccagttggcattaccaaagcaaacaattatcatctagaaagggcatgcaatcgatgtgttcaacaagttaaacttgaattgtaacaagcattgcagtctcaattaatagaaataaagaaatgtaagcatcactctacgaggtgcgtaacatcgatgatctggttcatgataatcagttaagagtggtctggtgggaggatgtaagcctagcacctaagcaggttatgtgggtgcctttttagaagacttgttccgttattggaattcaaatggtagcgtaaataagaaatataagaaatgagtagcaaaagcaaacaatatcatgtagaaatggtacatggtcatttcaactagttagaaaccttaaacgataacaggaaatgcaaattgaaccaacagaaaagaataaatggcagcgtcaactcaaaataagattgacggataatcagggatgatacaactctaatgtaagtaatgaatataaatgtgtgaagagaggggataggatagcccccatcatcaccctagcgttaagataaatcatcgtacatataagcaaagcaagtagtaagaggaagaatgggggaaaggccccgcaagagtactgacggtgacggggcgttcgggcagcttcatgcagaaggcgcagctgaagttcttgccgatgacctcgaggacgtcgtccccctcgtcatcatcggcgtcggcaccggcgggcgcggcgccgccgagaagctcctggcggcggcgtgccttttcctggtcggagagggtggcgtcgcactcgatggcgcggatggcggcgacgagttggccggcactcccaggggcgagcggtgccggggccgggggcggggcgtcggtggagtccccggagcagtcggggcaactccattgggcggcgtcggcaagggcggggggcttggagaggcagggggagtgccacggggtggcgcaggtggagcaacggaggagatcgacctcgggaggggaggcgacgcggcagaccatgcagacgccatcgccgtcgcaggggagatcaggcatggcggcggcggcggctagggtttttgggggcgaggaagggagggaatggaggaggttttgaaatctcaaaaattttcgatctcaaaacccaacccgacagcggagtggggtggtctcctcctcttcactcgtccttgctatttgtagccccccagccccagcccaggcgtctctatctatctgtggatcgccggagggagacgatgatggaccccacgcgtcagctgccgtggcttggtgtgaacgcgtcccccgccccgcactcactgccaaccggaccccacacgccacgccacgctaccaaaatgaaatgaaaaggatcccttctttttttggatgggaactgggagaagcgcgcgcgcccccgcacccgcccgctcccgcgcccgccgatggaaattgggaaggaaggggaaatcaaacaagcaagaaaggaaggaaggaaaacgcgcggcaggttgaaatgaccaatatgccccccaccttcctctctagtctctccatttgccagttgtccacaccccaccacccacgtctttcccccttcagcggcgtgacccaccgtcacaacactactccaccccccctctctctctctcctctctgtcacaacttccgcaaacaaacatccatccatcaactcctcacatttttttataataatagattaaaccgccctttacacctaaaaagaatatccctcaccctcacgttttctaaagtcttcttttaacaaaagctaaaccggaccatataaaccaatatatagttttcctttttctggcccatggttataaactttgcttttaaaatatagaaacaatcaaaatatagcataagaggctctacatctttgaacgacacaagataaacatgcatacagccactgtcatggtagctaaccaatctcaacacagcaaaaaacatatgaacaaacacccgtcaacatttttattcttcccatacaacattgacccgatgttatcgaataaatcggaaaccaaggtcctaagtcaacaccgcaaatataattatcgacgacctaatagagaagtcttcccaaattttccatatatagccttacgaatggaatacccaccaccaaagggataaaaagcaaaagactttagagaagccaaagtcccatcaacatctaatcgatctaacctcgtacaagatttattgaaaacctaccgaagacgaacgaggaacttgttctcttcctccttatctccggcgataacgcacggagatgacatggaggggaggggacgaggtggcggcggagtcactcctaacagtcgagttgtgagttccttctgtttgggtagggcggatgcatttatatgcaaccagatgggggacatcttcatccctccttgtctccaatgaggacgcgaggagatgaaaataggggaggggccgatgaggtagcggcggagtcactccagacgagtcgtgagttcttctgctgggggagaggatgtattcatatacaaccaaatgagaggcatgctccattcatccttatctccagcgagaacgcatggagatgaaaggaggggaggggatgaggtggcggcggagtcgctctagacaatcgagtcatgagttccttatgctcgggggggggagagggtgtatttatatacaaccaaacgagggataggctcccttcatccttatctccagtgagaacgcgtggagatgaaagggaggggacgaggtggcggcggagtcgctccagacagtcgagtcatgagttccttatgcttgggggggagggggtgtatttatatacaaccaaaggagggacaggctcccttcatccttatctctagcaagaacgcgcggagatgaaaagggggagggacaatgtggcggcggaatcactccaaacagtcgtaattcacgatattagatccatgcctctaataacgcctcgtccatgcacactgactctttggataccatttcacttacctctattggtctctttataacaatacgtttgcgtattatcccaaaactatccttttatagtatatctagcatgccccgattttacacaagctaagttgcttttagaaagacatcttacttgaatcacatgcttttttttcacgttttagactaatgaaatgggattgatgacagtatccatgttggatatattcgtaacggtaccgatacggagggtactattgacatcaagacaaaagcgcttgcgtcttaggaagaaaataatatagtttggaacaaaacgacatgccattgttgtcatgccaaatcaaacatgttgtgcttgtggtattttatcttctataatattcccatcctatgttccattttttttaaaaaacttcaattcaattatatagagaaggtaaggctgcagcaagacaatagatataaaaaatcaatacaaatattccaataacacgtaggggtgtagagtaaatttgataaaacttatggttataagatgtgaatatctgaaatgtatttgggttaggctttgtttatgaaaccctagccttagagacggacgtctactttcatcgtcgtctcatttcaatgtatccttgtttctatcatcaatttttataaggctgatggaaacacatcctatctccttagtcagaggtgttgctcacgttagacgtctctcttcaaggagtgactatgacgcatcttatatacctcgaggacattaattagtgtcactcttattgatatactcttttgtacagagactaatagtagcatgatatatctcttgagcccgataatgagataggataacaaacatggttttgattgatgtatctcttctagagaccaacaattagattagaattaaatgatagaagtggtaatctttaccgttgatattttagaggcaaccaatatagaattcgatcacaacggatataaggaatgataaaacgatggtgtaaatggtgccttttttttaatcttagcagaactgttgtaaaagtatttgataaactttctccgatctgatctaataaaatgagcgtaacgtaaggaggatgaatcgtgtggtggttaagcacgtttgtttgtgcaaaagctgagagagagagatggttggatttggggcaagacagaaccggactgaagtggagatgagagacggtgtcttacacggactccgaacggaggctgcttggcttgtgggggatgagatgagatgggatggggggtctgacgtgtggggcatggtcccacgcgtcatacagacagggggcccacccctaataaatgccggggcgggggtctctcctctcctcccaagtcccaacccaacaaacaaacagcgacggagaaattattttctatttttttgtttttgtttccggttcgcatccgcatcgcggtcgcagtggtggtgtgccggcggcggtggaagaggaagaggaagacgaagaagcagcagccagcagcaggtatgcccgcgccaagaccatccatcccctaggccctagctaccccgtccatccccctcgcctgaaacttccttcgccgatctatctccgtccatcctccgctcgccgtcgccgtccttgtgcctccgcatcctcgcccaccggtgagcactcaccccaccccgccccaccccgtccctacatctcctctcttttgcgcccccctaaccctatcttctcttccagatctgcaacttattttgccctaataaccttctccactcttatgttctaccactaacgacactagtttcttcccaaaaaaaaattggggcttcaggtccgctctgatgagatccgccgctatcctcctttgtttatttttttattattatttcagtattttttttacctaataacccaacgcccttatacatgcgatttccaatttctttatactactccactacaataatttcgatgctgtttactaccgcccactagtattagtttatattatcgggtagtgaatcaaagattgagttgtgaaatcatcatgcgccttcctcttctcttgtttcaggtctctgctacacactacactcaagagagcgagaggcatggaacactactcgaccaagttcagcaatggaggagggagactagtagaccccatgcccgaccgaaggtcaagattttggcagatggattcccaacccaccgagctcatctgtcccatgcctcgccgcccgtcaccccgccctcctttcctatccgactccatcaacaggtccacccccaaaccctaatcaaaccatattgagcatgggtctcctttttttagctgcaatttaatttagcacatatctactccaggctgtacacttggatgcaatgcattccttccaacaaaggagctgaggctcaccaaaatttatgcacatatggtaccaataaccataccacaacactgcccataattttaattcaattcaataattgtcaaaagattctttcatgcgaaatattattctactatatgcgcacaatagtgcctaggctctagtaacgacagcgagcatgtagcgacaaattcagcaatgggcatcacacggttcacatgtgacgacaaaatatacgtttcacataatgacttagggttattgctgacctgtgcgcgctttttaattatttgcaggacattaccggtgtacagagctgactctgcttctgatgtcctcgacctcatcctcagtaaggtgctttacctgtagcttcttgcggctgtctgtaaactgtcaatttacgctagctatctatgctgcctccatacatattctgaatttataattctccaattgtctcgttttgtttcagaatgaccctgatgttgatactgattcgagcacccaggtgggctttttctgtggctcacctcctgtgcgcgctaacaaccccattgtccatgatccacagtttggtaaaaacataccttccttttctcctttagggagttctttcggcaaaaagtctgctggaagagctgaagtaggttctccatcttgcggggcaagcagcccaaaagttagaattgaaggttttgcttgtgggaacaaggagccccactgtgcagtcacctttgcctgagcattctcattgaccctaacgctatcctgccaccaaaacttgtaaattttccgtgtgctgaggagggcataaattagtttattttgggcttctttttgtcgagttgagttggcattgcccttctgattgtggcttttgaaactgcacaatcgcagagagctttcggatgtacataaatgaagtctcccgtctgtagctatatcatcttgtgtgtgtacaaaaggtagtaacatccaggtccatggtgtcggtcagtctgtaaatatgtgtcggtcagtctgtaaatactgtagtgtactggcatgtaagatgcaatcaatcgatcaattaatgtgaaaaatcctcattagtctgctcgtgcccagttccatcaattgtgtgtttgtgaatgatatgagcctgtgtactggtgttgtaaaaagggaaggtcacctgtgaatccatctagcttactgaaatgttgtactgttgctgagctatatgtgcaacgagatgaataagttgtaaaaagggcaagagtttgttggttcatttcatccaattcaattggcatgcatactgagtgttgtgtgatcaggcagagtcatgttggtgttggcatgcatatatatggttgccttaggtgtaggccaaatttaagatttagtgtgtgttgttgtgcctgacgattggcaccgtgtgttgatgtaactggtattgttgaggctggctaagccctactgaatttgtgactggggagacaaaaggaaggccaaatcagctcagccaggaggcttcagaaagaatgtttgcaacttgaagttaatggatgtattgtttacaattagacaagacaagacttgtacagagggagggaggaagtgtatatacagtagagaattacagacatatatagaatacaattgacgaagaagaatgaactaaaccccaatggatggagcaatgaaagagtgagtgagttagcagcaaagcaaagggctatctgaggatggtcctggagtgcctgaggatcatgtggaagcatggcttgggcgtggtggttgctgccttgggcctgattttgccgccgctgccctgccgctgcttccttttactaggcgtcacattgacaagagacgacgacgatggctcctcttggtggttgctcctcttcctggtgatggatccggcggcggaggagtgcagcatgcccgggggaagggtggactcgagcagcaggagggtggcgcagcgcttgagcacctccaggttcatgcgggcgtcgtcaaggctcctgtggctctgcttgccgatgccgaagtaggaggcgagggtggccatcttgaggtcgccggcgcggcgcccaaagtcgtgggccagcacgttgagggagtcgacgatggccacgggctccggcgctgcccgcccgatggccgcgaacgcctcgcggatgcggtggcagtcgaagcgctggatgttgtgccccgcccacacccgcccgtccagcacgccgaagatgcgctccgccacctgatcgaagctcggcgccgacgccacgtccacatccaccatagcggcgaacctcttggacaccgccgacatgtcgcccggccggatcaccgtgtggtagctgtccacctccaccagcctccgggggcacaccacgatggccccgaactccagcacactacgctgcccctcatccgccgacgccgccgtcgtctccacgtcgaagaacaccatctccggccgccgcatcgtcgtcctcatattattcatatactctagctatctatccgcctcctctcgcctaccctaccctataagatcacagacacagagtcgatcgttaatttgttagtttcccgccccgcgctcatcgatgataaatgtatggggacgattcatccatatatattggctagccttaccaacaaattaacaaagatcgatgatggatcttccaacagtgcaagcaagcaacaaacccagccgccctgcctgcctgcctgcctgaaagaaaaaggtaaatcttaagcttattctactatagctcatttcttcttcagctgcagctaagatatagctagcgtgcatgcctgcattttatgcacaagattattccatgtttatttcacaagcaacctaaaaactaacaagcctaagcgtgcgtctacgtgcatgcagatatgtgcaaggaatcgccagcatgcatgcatcaagcgcaattgcatttggaagggaattaggagcaagatgaattacgcacgcctactgcctctgcatagctctcatctcacccaaaaaaaaaaaaactgcatctgcatacaccaccaatatactactactagtactatgtattagccagcaaactgctggtcaagtaatttaaccggcctcaagtaacaagtgtttgcttgtgtgtctgggtcaccgtttcacgcacgcaccctcccactgcaggcaaagccaaacacacacacacatattctcttcgctctatgttattcttctttctccaattctcctccaaactgcttgtacggtgcttaccaaactctgacgctaactaactatacacaccaccagagcttccaatccttcctcaaaccaatccacacaaaacaaaattaatttaacccctccaatccactctcatttctagtggagttaccaacagtcaggatactacctcatcttaactgcagagttctaaccacatactgcctacttaattaataccagcacctaaattaaacagcacatccaactacccctaatctcccatccatcaacacaataacgcccatcagttacaacagcaagcttacgcacagaattttgcaactaatctttcctgaaaagaatgatcaactgaatgctttcttcattttagtagactcctcacagttccaacatacacaccaccttccttacccacaatactcttgagataaaccaaaaaaaaagctaacccagatctcagcgctttaattcagctggtgaatgtgcgagatcaacttcagcatatatttgtagcaaacaatcaacaggcgtccaaacttcactcctgcatacggcaaaattcccaaacaatatataacactcattaacacaactcatatctcttgtgttcgacaagactctatagaggcgaatttcaccacacgtacctttgtagttacatcagcatcttccaggcaagtgaggcagctcaagagccctgacgatcctgcacctgcatgttccagacaaccaggcaatcagcattctcacccctttcactggatgaaatcaacattactagacaatgacaataacacaaggcaaacacctctgttttctgcatgaagccaatcttgtgagcacatcaaggcctccagtgtatcaggtaaaagcttgctacgctgtggactcaaaacccttccagcaatgctaaacgccgattcagaaactacccttgagacaggaaccgctaaaatgtctcttgctaacatctgcagagttggaaacctcttccccataatcttccaccaatctattatgtcaaagtctactgctctagggataacaggctcgtccaagtatttgtctagttctgacttgacatctgcactggagaacttgaaagcgatatatagatcgaagctagataactgatctggaccctcttcctcccccccacaaggctgcattgcaccgacttttgattggggaccctgatactgtttgatcaaatcataacagagctgccggactctatttatctcattgtatgcctcatcaccaaaaattgaggggaaataaaactgcagtagctcaagcttatatctggggtctaggacagttgccacagccatgagatcatgaacttcaacgcaatatttctcaaacaattcggctatttcatttctcatccttcctatcagttcatcctcacacccaggccatctcctcatggccatccgaattccacaaatcttggggaagtacatattagcagtaacatacttagcctctgaaattagttctgcaatgtcagaaaacagtttcaacttactgcagacctcttttgctaatttccagtcatcatcatcaggagcacaaatatactgttcctctatttgccttaagtgatcaaagacttgcttgtagcttatggcaacatttaacatggataaggtagagtaccatctattattacaatcaagagtcaacttcttgtcgagattaacattcaaaccacgagcaacatcagcaaacactacatctctttcagttgttgctgtccagaaatcaacactggcgcggatcctatcaacagcacctcccatcacacccaggcaactattggcaattctacttagcacataggcgcagcatctcatgttcagcaaagacccacctaacaaaagttgttcggtatccagcctttgctttaagagccccgtaaccgtatcatctgtagaacaatcatcagccatcaccattgataccctccttccaagattccattcgttcaaacaagaagacagagtttcagaaattgcttgagctgtatgcggccatggcacatgtataaagctgcatgtggcaatcaaagcacaataagtttttacattaaaatagtctgaatagaactttggaccgagaaaactgcaactatatttgaaaatatacatacacacatctatgcgctcgaaaaataatgaaaaaggaacacacctcagtagacggcactggaatgtccaggattggtcgataaaatgagctctgacagccacataacctctattttgatcatctgatgtccatatatctgctgttattgcaatccgacctttagcctcccacaaaatttccctggttctgaccctctccgtctcataaatgctgataacatccttcttaagactactgttgggaaccagctggaacaatggttgaagagccctaacaaacctttggaaaccgtaatgctccataatagacaaaggatattcatgcaagataatcattctcgcaagctccatcctggcaacatcctggctaaaggtggagctttctaaagaagcaacagtgggttcctgatcaatatcctttgtacatttggagggagttggcttgctgactttattactcctgcgacgaggacatttgctgagatgatcgtgcaaatgtttggtgccattcttagtgtcccctccgagcctcttatggcaccataggcactcggctttccacttgctgtcgattttcttcctcttgaattctttccacacactcgatgtcagctttctcttactaacatattcttcttcaacagcatgactggaatcaggagcagcagttgagtttttggcagctccaagacccagagggatgtcatctttcataaccaactctgaattctgcaaagtagaacaggcaacaggggtagtgagaaacaaatggcagtagaaagatgataattctccctggattttctttttcacttgggctaatttctcatctctatctctactattataaaaattcaagatgtttttgcggtactttggtacgtcatccgtgtatgagtcggtttttaagttcgtttgcttttggaaatacatattcgtatttgaataggtttttaagttcgttcgcttttggaaatacagaaggagtcgtataagaaatccttttttttaaaaaaatcgcatgctaacttacacggttggactcctaactacagctcatgatttttgtaaaatacatatattcaagcgaatttctacagtgaatttcacctgacttaaaacatataataataataagattaaaatagtcttttcccgttgcaacgcacgggcattttttctagtcatcccttaattgaaaaactagatacaactcatagctcacactctcaaaacaggataaatcttgtccccgtttgacatggttttgagcagcataggaggtgaggtccacttgtcattgaggataaatggtgggcccacacgacaaacgatgatcaagcaggtcccatctccagtttgggtaaaacccctgttaaacaggttggaggtacatgtttttacccggtttcaagagttaagggactgatcatatatgtatattacgcctagtctaaaaggaaggagaaacataaattttcttataatcttattgagcaattgagcaaagctgatgaattttctactagctgtatcgaactagaatgaatacagggaggcgcgagaattcagaatgtgtaggggcggagaggaggagggaccttggacttggagttggagcgagcaagatagtcttggatggacttcattgttgaaaccctagctagctacatgcctctgccgccgcccatcaaacggacagaaagggagcgccgtagctagggggttggatctggccggaggagcgtcggcgtcgggcgatgggcgcggggcggcggcggcggcggcggcaagggaggccgggagggagggagaagcttcggtgcggtgcggtgcggatgaacaactcgatccggtcagttcagtgcaggtggggcggaatgggttgggctgcccggcccaccatgtaagcccataaaccgcattccggccctgtgctgtgtccctttcttttctctttatctttatctttatctttatccttaccaatctaatctaacctaacctatttaaaaaatacttaatttttcgccgcgctttcctccgcaggttcacaattccgacgaaaaccggtcgaattctatgaaatttcgacgtttcgacacggctcggaattaagtttcgattagaatttcaaaggttaaataatagatttggtcaaaatttatcgaaaaccgatcgaaatttatagaaaaccgtgataacaatggaggtcaaaatttagtggtcaaccggtaataaaccatgttcctccgtcgccggcatccgccctctcggtattcttctgtcgtgtgcgcatagagacaaatgagaaggccaccatggagcagctttgctgcccggggtatgtgtctcacacatcctcgacactaagttcgtggtctctttggttccaccgaaaataataaaataatatctcgggagtccaacagctaattaccatatttttaccgtgtctacgagaagatacacgttctttgaatgtttcacaataaagaaattttaccatataataaaaatagaaccccatatttagaaacacgtgatgccccgttttgacagtaatggatccccccaaatccactcacctccaacagttggttccccatctccatcatctgtggggagagagcccgagaaatttagggttgagaggtgagtggcggcggaaggaatccacaagttgcaagggtgtggaggcggaggagtggcctcgattggggatcggaggtggtgaatctcggtggagaggcacaatccaaggcgataagcgtcgatttgcaagggtggttcgtgggcgaatggcgaatcaagggcatccaggcggagggtggcgtcggcgtccagccgtggtgaggaaggtcgccctcccgcagtggcgcaccaggggggctcctcgcaagctgggagtgagcaatccaccaaggctggaggtggagagatgaggggccagatgaacaaaggggggaagctgcagcaatatcgtccagttcagaaggagaagaatcaaactgaagagaagattgcgacatctgcagtgactcctcagactgcaacccagcaaccaactccaccacccaattctcgcactggtatgcaaactaacccacagagaattttctgccacagatgcaaaggttttggccacatggctagggattgtagcaatgttgtcttctgtataaattgtgccaaacccacacataggacagaggattgcatctatgacaagcagccgaggcctatggcaaagctagtagggtatggtgctccaggtttaggttgcatcttaattcaaaacactaagcctgacccacctaaggagcataataatcctctggctatgatctctactgtctttggtggagaattgacagaagctcaacttgagcaaggtttcacgcaacaatttaagtggaattgggtttggaaagctaaagcaatgcctaatggaagctttcagatgagatttcgtaacaagataaagtttgatgagcttgcaaactttgattatttcaatgtcaagggcactgatgtgcaagttaatgtgaaagaatggacccagaaatctgaagcagttgggaagttgcatattgtctgggtcaaaatcactggaattcctgaggaaatgaagggttaccaagctttgtatgaaattgggtcaaatctagggcctgtcttggaggttgatatggctactttcagagctagcaatgtgatcagggcaaaagttggaatgatggagctgggtgttctgcctttgaaactagtgttaacttctcccaagggacttttgttccaagctcatttcagtctagaggaggtggtggaactggggtggtttagtgatcagctagatgacacttttgagaaaattgagatacaagaaaatactctggagggtagcagtcagagagagggtaagcaagttgtggtggtggatcccatgacagaagatcaccatgtcagtaagacgggtaacgggctattgaagtttgtcagaagcaagtcctggtgccagaattgatgctgggagaacataagatcaaatgtgcacagatcttgagagacatggagttggcaatgcaactgcagaaaggagactgtattctgactcagtgctgtgaaggaaggaaagaggttgggaaaaaggaaatgtcacaggagcaggttgatactctgcagcaaccgatgaatcaaaagttggctgaagaattagaaagctcttagacagatgttccaggggataaggagaatagagtcagttttgatatgggtttgaatcaagaagacaaggacaaagtagatccgggggacagtgaagattacatggattctcaggagtctaagggaagttttgctaagaggttggggattaatctaactgaagaagctcttggaagtcaagatgaagagatgaggagaagcaagagactgaaagacaaggaagataagaggtcccaagagatggcaatggaaaggaaagaagcacaaaatgctttcatcaataaaaattccctccttcatacatgaatcaaatgtctctttaattgatattgctagtgttttaggggtcaatctgggttgtgctgttgatgatatagcctctaatattaatctgattagagacttagagatggccagaattaacctctttctgaaagagggaacaaattctgaaggtcaacattgtcttgattcctttgagaattcaaatcctgatttaaatgttttttctgatgatttggattctgaaactaatgatgaggattttaaagaaattgagcatgtgcttaaacagattcaatcttcagctagaaaaatgaaacagagaaaggggaaccttgagattttcaaggtaacccccaaagttgtcaggaaaagaaaaaagaaaactaaagattaatgaagggcctcttttggaatattagagggatgggaaatccagaaaaaataggtcatcttcaagaccttgttaaagatttaaaattagattttgtaggtattttagaaaccataaagcagaactttactgctagtatgttacagagcttgagtggtaagagaaatatgaagtggacttggcttccaccttgtggtagatctggaggtatcctggtgggagtaaatgaggataagttctctatttgaagggagtcaatgggtgacttccacatcagactgcagttgcaaaatgtttgcaacaagaaaatctgggatcttctagtggtgtatggagtagctcaaactgaacataaagctgcctttcttgctgagctgtctaaggaattccaagcctctaggagacccatagtgataggtggtgattttaatatcctgaggaaagagagtgagaaaaataaagctggaggttataacaaatggagtttcctttttaatgcaattcttgaacaaaacagcatgagagacatccaaatgggagtgagacaattcacttggtgtaacaatcaggaaaatcctaccttagagaagttggacagagttttcataaacaatgagtgggaagctgattacccccttacttctgttcactctttggttagggcactttctgaccataaccccatactattagatactggaaatcctgacaaaagaggagacattttcagatttgaacttagttggtttttgagggaggacttagatagcattgtgcaggaagtctggaatgattcttactcaggcagcactattgaaaggtggcagaagagatttggctgtctgaggagaaagctgaaaggctggaacaaaaactgggagggtgaatacaagagaaggaaatatgaaattttgagtaagattgatgttatagactctaaaattgaaacctgtggcatgaattggagggatagagaggaaagaagagagttggagcttaatctgaaattcactattagggaagaaaaaacaaagtggtttcagaggagcaaagagaaagaaactttggaaggggattgcaacaccaaatactaccatgcaaaagcaaatggtaggaagaggaagagtagaagtttttctttatctcaggatgaaggcctttgaaggtcaagctgagctgttgagatacatcactgctttctacaaggatctttttggtcattcaaaactgaacaacataaaattagatatgggaggtgctaccaagataacagaggaagatgcagctttgctgattaaacctttttctctggaggaagtgaaaaaagtggttttttatttgaaacaaaacaaagcccctggtcctgatgggttccctggggacttttacaggaagttttgggacttgattaaaacagattttcttgaacttcttaatgattttcataagggtgttttggacattgagaggcttaattttggtatcatcactttggtcccaaaatcaaaagatgcagcacaaatccaaaagttcagacctatatgtcttctgaatgtaagctttaagatcataacataagtgctgatgaataggctggacaacgttataaattatataatcgcaagaaaccagactgcatttctcaaaaacagatttattatggaggggatagtaatacttcatgaagtatggaatacttctcacaaaaagaaacaaagtgggattcttttcaaagtggattttgaaaaagcttatgataaggttgattggacctttgtgtatagaatgctaattgcaaaaggtttccccacattatggtgtgattggattatgaaagtggtgagagggggcaaagttgcagtgagagttaatgatgagttgggtccttattttaacacacatgaggggcttagacaaggggacccactttctcctctgcttttcaacctggcagcagaagctttgactgttttgatacaaagagctgaagataataagttgattgaaggtctgaatgtgagcaataacaacaaagtgactatccttcaatatgcagatgacaccatctttctgctgtcagatgacttagaacaagccaaacatctgaaattcattctctgcttgtttgaacaactatctggactcaaaataaatttcaacaagagtgaggtgttttgtctaggtgaggcaagagagaaacagggcctctacagtcaaattttcacttgtaaaataggtgctttgcctatgagatatttgggggttcctattgataaaaaaagattgcataatagtgattggaaggctgctgaaaacaagatggaacataaactgagatgttggcaaggtagattacaatcaattggagggagactgattctcatcaactcaagtctcagtattgtccctttgtacatgatctctttttatagattattaccatagggtgttaaggaaaaaatggatttctttcgaagaagacttttgtggtaggaagaacaggggaaaaaagatatcacttggttcagtggcccatactttgttctccaaaagatcatggaggtttaggcattctagatttagatacaatgaacattgctcttctttgcaaatggatatggaaaattgaaaatgaatcaggttggtggcaagatatactaagagataagtatctcaaaaacaaaaatcttgctggtatctctgtcaaagctggtgattcacacttctggcaagggctcatggaagttaaaaacatcttctacaagttctgttcgaagaaagttggtgatggggaaaatacatgcttttgggaagacaattggattggtggtagaccattaaacattcaattcccttctctgtatgacataacttttacaaagtaagtttctcttgctaaggtcaaaaaagagggctgggggattttcaaatttagaagaactctacatggtgacaaaatggactggaacactttaaaaaactcttgtggggaggttcacttgattgaggggtgtcctgataaaatctggtggaatttaaccaagaatggaatctttactgtcaagtcactatatagtgctttgaaaactcaacattatgctttccctcataaaaaagtttggaagttcaagattcctctcaaaatcgaagtctttctttggttatttctaaaaaacaagattctcaccaaagataacttatataagagaggttggaagaaaaaagacaaattgtgccaattttgcagcaataccgaatcacttcaacacctgttttttgaatgtcctttagctcattttttatggaatgtgattgggtgtgctctaaacctgaaaccaattctcaataaagaacaactttttgggagttggttgtcaaattttaacaaacacatgaaatatttggtgatggttggagtagctgctgtcatctgggctttatggagaacacgaaacagagcttgttttgaacatgttttgccatatgatcctatagaaactgtgttcctggcttgcaattggactgaaaactgggttgtcttgcagaagttggaagcaaatcgaagaagattggtactgggagccagactcataaagcaggtggcaagtgaggtctttagttcaagacacagctggagaccaggtgccagaagactgaagatgtgaagaaggaggagttgttgatgtccctgcttcaaagactaaagttgatctagcagtacctttctaccgtagtgatttgtttatcaatctgtcagcagttcttctgtttcttttaaaaactgttacttccggtaggaggtggtttccctaggctattctgaatagcttctgtctcaatctagttccatccttttttttcttttgctgtaatggcttcctgtagagaccttttatcatttctcttaatggaaatgggggcttcaagccctagttctaaaaagaaaaagctagttgtataagaattatgtcaaaaccaaaagaagaaaaaaagagagtgttatctcaatctaccttgattaacaaaactgaatttcatgatcgtggatcaaacataattgaagcaaaaagtgtaagacgcattggaatgattaacctagctataaggctcaaggttcctataaacctcacaaattaaaaggcaaaagaggataagggaaatactccgtattcaaaccttgggataggaggaacaaagaaatacgtgccagaatgcatattacaaaagaaactcctgcatgcggtgtgatcagaatggaattggtggggaaccaactagtggcaatcgcaacagctcatgaaagaaaaataattcaaggtaacacctgaaaagttctcaaaaaaaaaagttacacctgaaaaggggcatgatatatataattgcattgaataaacttacaattcagtacaacgttataagatttttctttctttgacatatatatatatacgcaaagagcaaattaaagaaatcttcccagtcttaagtaaatgaatttgtataataactgctatatactgtacgttgcttaactcgtggtgctgctcgatcaattttaatttaaacctcaagaaacagggaggcaagaaactgtacctgtccatatagaagtattatcgatcctccctaaagaacgtactgatccacccgtggcggtggactgcacgccagctaattgtccacaacgtaccagtaccaataccataattaagcagctagcggtcgaggaggacacgacgaagccgccagcttagcagccggagggagcatccatcgtggtggcccgggcgtccttccagttccagcgaggatcctcatctcgatcgcgcgatccacagccacacgtacacctactatatacgcacgcactctgcaaagtactagctagctaggagtagatcgatcgatatagtatgtcgttccttaattttctgcacccacacccagctggccatgccatattgccatgcaactattgaaggaagctaggatccacctacactgcacgcgcaccttgagcgaacaacctcgtatgtgcgtatgttaattattgtcctccatatatgcatggatgccactgccacccgcaccagcatctatcgcactcacggaccacaatcgtctcctctcctagctagcttgctaccacaatcatgcatataccagtttgcctcattttttttctggggaaataaattagttgtccttgaattatcatcttatctgtcttgcttgctttccaacaaatagattcatgttcttgcgtggcttgtctctcgtcggatgacggtcggagcgcacgtgatgcccggagtacagagcgagaatggagagatttttgctccatctgataaccgacccgttttctgttttttctgagaggaccaaccaggacctagaaccaacctgatggacagtagagacgcgacaaacacattgaacctgaaaccgatcgcatccacaagaagacggacgatagaaaccttacagtacaggtattttaagtaggttaagattaaaattaaaataagataaagataaaggagcaaagtatacttttagttaattaaatttagtagttgccatgtcaacggttagcaaaatatgatattgactaccaagagctgccgccggatccacgctggagggaggcggtggagcctgactgccaaggttgcccagccagccgccgccacctttgctcgcccggccgcctaccgccgacctagaggacgataagagaggagaggagagtaggggtgaaaataatagagtggataggagatgtgaataatgtgaggagagagagagaggagaggaggtgaaaatttgaagtgccttaaagagaaaagagagaggagaggtccctgtctacttcatcgcaaggcatctccagtctcacccacggcttggttaggtctttccattcattccacaacaatcgcaaccgcaaggtcctcatgaacttatccaagtttagaacccccaggcctccctgactggtcggcaagcacgtctttgtccaattgaccttgcattttcctccaataatatctcccgtgctagcccagaggaagcggcgtcgctgtttgtctagctgctccaaggattccttcgtgatttccagggcggccaggaggtagattggttgtgctgaaagtacagatttgacgagtgtggttctcccagctgaccccatgtttttttccctccagcctactaccctccccgagattttgtcgaaaacaggctgcaagtctgtcttccacaacctcccaagtactaggggaagccctaggtattttagagggaaatttgccctcaccgctggaacaccatcaaggacacctgccaagtcaatgctatcacatctaatggccgccacttgggatttctgaaggttggtgacgaagcagtccagaatgtccacgaaagcttttacattgcctcgggtgggattaatgaagatgatggcatcgtctgcatacatcgagatccgtagttgagtcgttctacaccgtagtttcgaaattgcgcccagctctattgccttggaaaggattcgttggaggaagctaaatatttatagctttgactagaaaaaatgtccgtgccttgcaataggtaaagatgttttctcgatgatacaacaactattagaagttgggcaataaattgaaacattacgatcgctatacattataattgaaaaaattgatgaaaatcctaacattaggatcgctatacattatgattaaaaaagttaatgaaaattctttcttagatttgggccagaagctcattccttcattcctctttagtcctacgctaatccgctacctccctctactcggcctgcctccttctgcccatctcgaatagctgcctaccatcttcaacctcccgaagatagtcccataaccatacgatgctggagctgatcttccccgtcaaatccggccgaatgtttctcgatatccaaaattaattgagggcttttgatccaccgatcatttctttcccttttccaaaaaatagagcgtaaaactcggaagaccgggaagatcatggagattaaatccgacgaattaaagccgaatcgaaagggaaaatcatgtagaaaatgatggaaaatcatgtagaaaatgatgagcgagtaatgagaaatcgatttttgtaatcaactggaggaggaaacgcacgattgatacaaccgcggcgggaaggcgcgtggtgcaacagatcggttgatcgggaaaaaacagatagaagtaaaaaaagttgcaacagatcggttaggatcggaaaaaaccagtggcaaaaaaaaaccaagctgcgtatttttttaggttcggcccgggcggcggcggggagacgcgaggtgcatcaatttggatcgggaaaaaccaaggacataaaaacagatagaaacaaaaaaaagtgcaacagattcagtttggaaaaaaaccagctagcaaaaaggaccaaaattaacccgaggcgcctaccaagtagatcggaattgtttcactaagtagataaaaaatgtttcaatcgtttaaaaagctgaaacgcaaccaaatcacctcatgaaacattttgctaaaacgtatgaaacaatggtttttgaagctctttcaacatatataaaacaatgtttcagcaaatagcgaaaggacctttcactacaacatttaatctatatatatagtgaaatatcatgagtatacttgctgaaacattgttggtggaaaaaaaatgaaacggatttccttaataaagcgttatcgtaatatgtgggtgatttgttgcaacgacgcatgtggtggcactacgccagatcctcacagctctgacgggatacctgtgacgggcaaatgatttggtcactgatgaccatcacctttgacgggtcatacgggatgccgtcatcagtgaggcatccggccgcggcccgtcacgggtatcccctcacctgtgacgggctgaaaggcaaagccgtcacaggtgagacagtgatgggttttccaacccgtcactggtatcccctcacctgtgacgggccgcggcattataagccgtcacaggtgatgggccgccacctgtgacggatttgttttccggcccatcacaggtaggtcgataccttcgacgggaaactcaattgaagcccgtcaaagttatgaccaacacctttgacgggtttttttacctaacctgtttgaggtgtgttgggtctataaataccccctaaaccgtcaactgctttccatcccgacaagttcactgttcacaaatcgttgggagggcagggggcgaatttttgctaaaattgaaggtaaaacccacattattctccattcattctcgatcgatcatcatatatttttcttcctatgttgttgatttcagatggattgtagttggatgtaccatgttcatcgttcgtctacagagtatagagagggggtcactgaatttgtcacatttgcagagaatgacagaaaaagtaggatgagcatgtacatattgtgtccatgtagggactataagaatgaaaagatgaaccttgatagttcagaagcgcattctcatttgataacgaatggattcatgaagaaatatacatgctggaccaagcatggagagcaagaggcgcctgatgccgcaactgaagaagtgttggatcaggatgtagagaacaccgccgcagctcgagaaggcatgttcgtatcttctccgttaggtggagagaccatagatttggacactcaatgtctatctacaatgttgcatgacattggagacacagaggacaacgacagagattttgagaagtttagtaagttgatggaagattgttagatgcccttgtatgatggatgcaagtcgaagcacaacaagttgtcatgcgtgttggaactcatgaagcttaaggctagtaatggctggtccgacaagagttttacataacttcttgagttgttaaaggacctgttgccagaggggaataaattaccgcatacgacatatgaagcgaagcaagtattatgtccgttgggcctggaggtcagaagaattcatgcttgtccaaacgactgcattttgtattacaagcaatacgcagacttggatgtctaccctgtctgtgggggcatctagatacaaacgagtaaagattgaaggtgaaggaagtaattcaaagaggggaggccccgttaaggtggtatggtatctcccaattgcggagcgcatgaagagaatgtttgcgaataaggaacaagctaagctagtgcgctggcatgccgaagaacggaaagtcgatagtgagctgaggcacccagcagattcagtacagtggaggacaatcgataggatttaccaggaattctcaaaggacctaagaaacatgcgtttcgccatgtgtacggacgtcattaatccatttggtgatttgagcagtcgtcatagtacatggccagttctgcttgttaactataaccttcctccctggttgggcttcaaaagaaagtatattatgcttgccatgctcattcaatgactgagacaacctggcaacgatatcgatgtgttccttgaacgaggtcaatttacgctagagcttcactgatgtggttgactatgtcaatcggtgtttatgggcccactaagacaaggagtacatcatgtgcgcacacaaccaggagtaagaggacaatacccttcgtgtatattgtttttgaagttaaggttcttattactaacgctacataaccaccgcgtaagcaacattggattctcttagccattgtacctaagtggagtagggttacctaccttaaatccaataagacgaaatattatgatttcattgaaatcaccaaggtcttaaatatggcttggggcccatatgtggaaaagggtggtaggcacaaggagggcaaggacgaactttatcataaccccaagtttgcatgcgcacaacatatcggagaccagtgtggtttccacgtgtgccacaacatgttaacacttctaagagaggtgaaagattttgaccctgaggttgttgttaatggcaaataaactcatttcaataccaacattactattctatacgtgctaacctctgatttattaaacagaaaggtagagatggcttgaagatttcacccatcaatccccttgctatcagaggtgaagtgtacgccttcattcttgcagaaataatgaacaagaaaggacgttttcacgtcaaatagactcgtgaactgggctagatgtgatgtcgtgaacaatacagttatataatttcttgtgatgtaaaaaaagttgttttttatgattctacattatgagtgcaatgtaatttacttttatatgtgcaatatttatggtagtttgctaaattgtcatcaaatttgatcaactacgatttacgttgtactattcatttgttttctcctttttttttctaaatgacaggtcgtggaggtcgaggatattatggctttaatccatttggtaagtatatatgcggttctatgagcaatgaccgaaattgtggcattcaagggtatgaatttgctgtgcaaaattgtggcatttgaactgcatatgtgaatgatgtcaaatcttgagatggacctgtgatgttggggtctgtgatgtttgagatggatctgtgatgttatattaggggggtgactggaatttacctgtgatgtttctatgtttcagagggcatggctagcaaatcctgaggctagctaatatttagcatttatttttttctagaattaacacatcagtgacgggtcgtaaaaaaaatccatcaaaagtaacctcacctctgacgtctgacggactcgcaaacataggcccgtcagaggtgacccacctgtgacgggcctttacttttgggcccatcacaggtgtgccacctgtcacagcttctatctaccggagaccatcacctgtgacggcctttatttggaggtccgtcagagatgtgtcacctgtgacgggtcctaattggtcctaggctagcggagaccaatacgtctgacggccttctagtaacttgtccgtcaaaggtaggtgtcatctctgacggccagccacccgtcaaaggtgactggacacaccagtgaccactgatcactgaccaagcccaaagccgtcaaaggtgagggtttgggcccgtcacaggtgaccttgtccagtgtagtgtggggcgcgtggtgggaacagcgcaggaggcatgggaagcagcgggcgcccgatttttctgtcgctgatcgggcgcccaatcgctggcattttccaaattaactggaagatttgccaaatttttttttattattaggtaggtatagatatagattaattggattggatcataccattaaacttgaggcagcaagtctctactattataaaaattaaagatgtttttgccagtattttgatacgtcagtaggtttttaagtttgttcgcttttagaaatacaaatccgtgtttgagttgtattttaagctcgttcgcttttggaaatacaaaaggagtcgtataaaaaatatcattaaaaaaacccgcacgctaacttgagatgaaatacagactcttgcagttatgattttcgaaaaaaaatatctaagtgaattcccacagtgaattttaccctagctaaaccgtataacaacaataaaattaaaataatatatacccattgcaatgcacggatattgtttttatagtaacacatacgtttttggacctagtccgatcgaggtagccagtaccgttctcacgagttaattattgtcttcatgggccaaccatagaaaaaacatggcaacacaggggatctagtctcgatcgatcatcgtacgtgtttcttaattcgtacttatatgaggagcagaattcagagggcaaggacgccacatgctgattgtgtgaatgcaatgcaatagtacatgcatcaacacgagcaaaatttggtatatgtggtgcactattgttgtgaacaattagtttcatgtgcctgaaagcaccagcatatactacgacgtacacctaattaatttactagcttgactttatatatccttggtatatatagaggctggattattaaaaatccattatctaaaaaaataatttactagcagacgtgaaaagggaaactcttttctttccttaacaagatatatcccttatttttatatgacattctcagataattataatttttcttaaaaaaaactagcatgatagatcaatatgagatatgttacttcacaaacacatgtaaatttaaattcaatctacacatatagaaacaaaataacaaatttcagtatgaatagtacacacttcacagttaattttttttctacttatacaagttaaatttgcatgtatatagagtgatatatcacatattgatctatattgttattttttgttttttttgatgattttataggtgatatctactacaaatatatatgcttggtaggggcatgcccaagtgtccattttatgatgggaatactccgaattcttgatttaaacatcgctcatcatacggctctcaaacttaattaacggaggacacaaagaaaaatccatggagataggtacatagagggagctatttgctagaagtagacaccacccgccctatgaagaaaaagtgacatattcaatcctacgtttttgttttttttttcaacggatgaagtactgtactggtctgtatcgtatctgctcacaaaagttgggacaggggaatgaaaaagccatcggtggaatcggagaaattaattcaataagttaatatgcacatctatagaaaatttaagaaatgttatctatgaacgtttaatttcaagaaatgccatcgtgcaattgatatattttgtcaccgaaatgccactgccgttaggattccgtcctctcgcgccgttaaatactctattcatcataagtattttaagttattaattaattaagacgacacttgcgcacactcacccctatgaacgcacacacgcacaccctacccctatgagcacctccagaagactgggccggtatatcttgagattgacgaagtcaccacagacgcctcgctgtcgatgggtacgtcacctaccattgaaagaataattagccgtaaatgcgagcacccgtgtcaaatctaggatttgaacctgggtaggctggttccaccacaagaaacctaaccagttgagctatgctcacttcgcattgttcaaactataattaagaccccaaactgacgcatgttatatatatatatatattatttatttattaaaataataagaacaatagtccagtttacacctacagtggcgaagccaccgggggtgccggggtgggcctggcaccccccatccccatgcgctgcaaattaaccccccgatgattagccatctaatccatacaattaactcattagctagttgcaagttgagcctatacataactgaccaatagattttagctttatgtgattacctgagttaattaatgtaactaagcgatgtggttgcaagtctccaaaactaaaacggataaatagaaatgatgtcttgtcactcatgtattcagtaaatttggtgctatttagttgcctaattttaaaaaatgattcttttatgttatattaatgtgcattcggacatacaccttccatcctaaaataagttgttttagttttttacatgaatctagaagaatgtgttgaaatatatccaaagtcatatcaacaatcaatttatttacatattagtgcaaattaaccacaaaattcaaattattattatacgagggacgactacgtatattagagcgaacaagaggtgaggtgaggccaacatgccactcagcatgaactgagccatcaagatccacaccgttgtctatcgaagcgctggcgagttcttacatttcgtggctagcacccctattactaaattctggcttcgccaatgtacacctatatatatcttcgatacccaattaaagttaatttagttaagtggaagctaattaattaagtatgtactatgtaatttaacagtgaaataattaagtgtgataccggccatcaaagataaacagtaaactaattaatgctctagaaaaaatggtgtgattattatttaggccttgtttagttgggaaaaatttttgggtttggtcacatgggcggacacatatttgaagtattaaacgtagtctaataacaaaacaaaaactacagattccaccagaaaactgcgagacgaatttattaagcttaattaatacgttattagcaaatgtttactgtaacaccatattatcaaatcatggtgcaattaggcttaaaagatccgtcttgtaaattgctggcgcgtacgcgtgtgctaggatccccataatcctttactttgatttaggaagaacaaggtatacaggcagtcattattcctcaagagatttaaaatccattccagtcacaacagatttatatatgttaattacaacacaaacacaataaaaacgtatttataataagataggaggatcacatctagaagagaaattgtggcccgggccggcgtccttccacttccagttccagcgaggatcggccactcgcagctcgcgcgatccacagccacactacgcctacgcgcgccgagcaagcaccttgagcgaacaacctcgtatgtaccactgccacccgcaccagcatgcatcgcactcacggaccacaatcgtctcctcttctagctagcttgctaccacaatcatgcatataccagtttgcctctttttttttctggggaaataaattaattagttggccttgaattatcatcttatctgtcatgcttgctttccaacaaatagattcggacttggcgatgcatcttcttgcgtggcttgtctcccgtcggatgatggtcggagcgcacgtgatggccggagtacagagtgagaagggagagatttttgctccactgataaccgacccgttttctatttttttctgagaggaccaaccaggacctagaaccaacctgatggacggtagagacacggcaaacacgttgaacctgaaaccgatggcatccacgagatgacggacgatagaaaccttgcagtactgatattttaagtaggttaagattaagattaagataaagataaaagagcaaagtatacttttagttaattaaatttattagttgccatgtcaatggttagcaacacttgataatgactacaagagccgccaccggatccacgctagagggaggcggtgaaggaggtggagcctgactgccgaggttgcccagctagccgctgccaccgttgcccgctagaggagaggagagtaggggtgaaaataatagactggataggagaggtgtgagaagagcgggagagagagagaggagatgaggtgaaaaattcgaagtgccttagagggaaaagagataggagaggagaaaaaaaaaatctatagaggaggtattttcgcttgcggaccacttaagaagtctgcatgcaaaaatctatttttgcattcagttctttaagataattgcatgtgtaaataggcttatttttacatgcatccacttaataggtctgcatgcgaaaatcgatttttgcatgcatacctcttaaggagccacatgtgaaaatggaggtcgatttttgcatgtgaaaatggaggtagattggttgtgtcgaaagcacaaatttgacgagcgtggttctcccagctgacccaggttttttcccctcctgctaccctccctgagattttgtcgaaaacaggctgcaagttcatcttccgcaacctcccacgtactaggggaagccctaggtattttagagggaaatttgccctcatcgctggaacaccatcaaggacacccgtcaagtcaatgctatcacatctgatggccgctactgaggatttctgaaggttggttacaaagcggtccaaaatgtccgcgaaagcttttacatcgccttgggtgggattaatgaagatgacgacattgtccgcatacgtcaagatccgtagtcgagtcgttctaccccgtagcttcgaaattgcgcctagctctgtttccttggaaaggattctttggaggaagctaaatatttatagctttgactagaaaaaatgtccgtgcgttgcaatgagtaaagattacgatattagaactgagcaataaattgaaacattacgatcgctatacattataattgaaaaagttaatgaaaatcctatcttcctatatagttggtacccaccaaggagaatttactgctataaaacaaggcatgcaagaagccacatcatcaataactctaagccatcggatcgcattagtacatagttatcagtcgttggatcaagaagctactcatccatctaattaatcattgattactcatcctgtcacctccctttagatcataatcacgcgtgacattgttatccattctgcacataatactatgttttctcctcccaagtcttccaagataatgcaaacttatctcctttatttagtacaactcaaattattgtataagatgtgagttttgttttgttacaaacaattgaataacatagagtaattatgcatcattaacccaaaccaatttttgaaacaagcttgagataaagcaaagatgtgcaaactaccctaattatgacgatatccgaattgtgcatgataataactttcgtatatcataacaatataaaatgtcgttttttttaaaaaaataaaacatgaattgtattgtaatagcaaaggctatatatgaagccacattatcatttattttatatatatatacagattaacatctaattattcaaaacattaattttatttgacgataaaactagcaaatcccgcggcaaggcgcggggtgccaactagttctttcttagttttaggccagaagctcattctttcattcctttttaatcatacgctagttcgctactcctttttagtcctacgctagtccgctacctccctctgcttgaccttcctccttctgcccatctcgaatagccgactaccgccttcaacctcccgaagatagtcccgtacccatacgatgctggagctgatcttctccgtcaaatccggccgaatgtttcttgatatccaaaattagttgagagcttttgatccaccgatcgtttctttccctttttcaaaaaattagagcgtaaaacccgggataaaaaagactaggaagatcgtggagattaaatccgacgaattaaagccgaatcgaaagggaaaatcatgtagaaaatgataagcgagtaatgaggaattgattttttaatcaactgaaagaagaaacacgcgattgatatggtggcgaaggggaggcgcgctgtggaacagatcggttgatcggaaaaaaaacgggggggcgccagcagcgagcactccccctctccccttaagtcttaactactatactagttaatatagttaacactaatgatagtaactaggaaagattctggagatattttggagatttttttactaacagattgaaaatattttaagttagatttgaaaactttcgatttaagttttaaattttatagtcaaattttaaaaacttttagctcagatttaaaaactttcaacttgatatttgaaaactttcaactcgagaatcgagattcaaaaacattcaagtccagatttgaaaaatttgaaaactttcaaatcgaaatttgaaaattttcaaatcgagattcgaaaacttccaaatcgagatttgaaaattttgaaaactttcgactcgagatttgaaaactttcaagtcaagatttaaaaactttcaagttcagatttgaaaattttcaactcaaaatttataaactttcaaactcaaaacatgctaaagattaaaaaaagttagaaaaaagtgggaaagaaaaggaaaaaaaggttaaaaaagaaaaaaaaagtgcggagaaggcgcacgcgccggcgcagggtcttctgggcctgaaacgcgtgccgccggcgcgctcgctaactagcattctcgaaaaaacagattgacacaaaaaaaattgcaacaaatcggtttgaatcggaaaaaccagcggcaaaaaaaaccaggctgcgtttttttattaggttcggcccgagcggcggggagccggggaggcgcgcggtgcatcggtttggatcaggaaaaaccacggacataaaaaccggacagaaacaacaacggatcggttcgattggaaaaaaaaccagcgaaaaaaaggacggtaaaaaggacccagattaagaggaagctttgcagaaagtttttattatttttatttggtaggtatagatatagattaattgtattggaccataccattaaacctgaggcagcaagtatatatacgtttgtggactagtccgagctagccggccagtaccgttctcacgagttaattattttcttcatggataccatagaaaaaacttggtgacacaggggatatcgatcgatcatcgtacgtgtttgttactcctagtttctaaatgtttaacaccgttgacttttttaaatatatttgaccgttcattttatttaaaaacttttatgaaatgtgtaaaactatatgtatacatgaaagtatatttaacaataaatcaaatgatacgaaaagaattaataattacttaaattttttgaataagacgaacggtcaaacatttttaaaaaagtcaacggcgtcaaatattttgagatggagagaataattcgtatcaaattatatgtggagcagaattcagagggcaaggacgccacatgctgattgtgtgaataatgcaatgcaatagtacatgcatcaacacgagctcaatttggtatatgtggtgcactattgttgtgaacaattagtttcatgtgcctgaaagcaccagcacttccgttcaaaaaaaagaaagcaccagcacatactacgacgtacgtacacctaattaatttactagcttgactctatatatataataaaaattcattataaaaaaaataatccctccagtttttttatatgacattggctacttcaaatttatactagccaacgttatacatatatgcatggaagtagtaatttagaaatgtgaaactcttttctttcttaacaagatatatcccttatttttatatgccattcagataattataatttttttttgaaaaaactaacatgatagatcaatatgagatatgtcgttatttcataaccacatgcaaattcaaattcaacctacacaaataggaaaaaacaacaaatttcagtacgaatagtatacacttcagagttaattttttttatacttatacaagttgaatttgcatgtatgtagagtgataaatcacatattgatctatgttgttgattttttttccaaattttttgatgattttataggtggtatgcataaaacgagaagatatcccctcgaaatgaaaatccacctcccatgtgaatatctactacaaatatatatatatatatatatatatatatatatatatatatatatatatatatatatatatatatatatatatatatatatatatgcttggttggggcatgcccaagtgtccattttatgatgggaatactccgaattgctgtttctttcttgatttaaacatcgcccaatcatatcgctctcaaacttaattaacggaggaaacaaagagaggtccatcgagataggtacatagaggaagctgtttgctagaagtagacaccatccgtcctatgaagaaaatttgatatatcataatacaatgaatttgaatatgtttttatccagattcattgtattaggtttaatcacattcaatcctacattgtttttttacttgaatttgaatatgtttttattccgattcattgtattaggtttaatcacattcaatcctacattgtttttttacttgaatttgaatatgtttttattcagattaattgtattaggtttaatcacattcaatcctacattgtttttttactacggatgaattactagtctatatcatatcctcctcacaaaagttgggacagggaagtaaaaaagctgtcagtggaatcagagaaattaattcattaaattaatatgcacatctatatatttagagaaaatccaaagaaatgtcattggaagcgttcaatttcaagaaatgccatcaacaagtacatacatgttccatgaaatgttattgtacaagcgattttgtcctagaaatgtcaccgccgttaggttcccatgcatcccgcactattcatcctatatcatttaacggagggttgctaatagaaccctaacagcgatggcattttatggaactcacactggttgatggtatttttttggaattgggagcttgtcagtggtatttcttggattttcacatccatttaaattcaatttcaagaagagcacgtagtacgtttcgctaattattgaattcaaatttttggaattgataacttaagtattttaggttattaattaattataagacgacactccaatacatttaattacaactagggtgctatcctatatatctataaagttcatccccactaaatatagtagtgctaattttctcttctctcataaagccacatcacataaattgtttttagcctttggataattcatcaagggtgtaaattgcatctcttccctaaaaggcacaccatacaactcaaccgtttataacctatggataattgataaaaattaaaaaaaataaacatatgaaaaataattgtatattaagtaagaaagaaaaatttggaactcatatctactatgttctcacacaattctcctacagcaacgagcgaggtacccatctagttcattctaattttttgaattgttaaatatattgcgcaaaatataattaagactccaaattgacgcagtcttatatatattatttatttattaaaataataagaaaaatagtccagtttacacatatatatatatatagtaaatttgtttggtgctccatggtgcccggacaccattgttgaaattgagtatatacccaattcaaatgagtataaaactttttcaattacttaggtattaacattaactactttactaactagtttaaagcaagtttgaattgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaatatttgaaaaatttgagtgattttgtgcattagataccatggtgccatatatatatatatatatatatgttcgatacccaattaaagttaatttagttaagtggaagctaattaattaagtatctatgtaatttaacagtgaaataattaattgtgataccgccaatcaaagataaacagtaaattaattaatgctctagaaaaaaatcgtgtgattattatttacaaatgaagcagtcgtcacatttgttgtttgcaggtgacgtaacgtggatgtctctataagaattgacttgtcaaatttgtaagaaccacctgacacctgtctagcaacctgcatatcgtcgtggtcgtagtctaactacgcttgggcctagtgtatacatgtagggagatggattttcatcctcgggaggtgatatcatctcgttttcttatatgctatttataggttatgaaaaattattaacataattaatataaaatatatcatttcacaaaaatacaagacaaatacatttttttacaagttaaaaggaataaaataaattgaaaatagttaacacatatttataattatttttcttacaatatatgtatattatatccgtattaatagactattatttatatccgtattaataaactgaaaatagttaaatacatttagtggttaaatgtatttatttattaattaattgaaatattattgattaaaaattaatattaaaaattttggggaaaaaatatattttagcgcgaatatttttccaggtagctagactagcattttcgtaggcggcacatcatgctctcgttcacctaggaaaattgatcttcccaatcggatcggccggctgctgattgttttcgcatgtctttgcctacaggtggactggccgtccgcctaggaagaccgttttcatcagtgtagaaaaatggtgtcaaattttttgaaagaaaaatattgataaatgcatacgcagtccctatatggctatatatatggtggtaaactggcatgtacacatgctgttgtgagtagtgattagctaggcggctattagcagcagcaaccagttctttttgcgtatgatagatgatgcagagtgcagctggagcaatggagctgctggtggcgtcgcaagaagcaggcggcgttgtggtggtgggcatgaacagtggcgacgccggagagctgagctacgccaacaactcggacatgcagcggacgatcgctgcggcgacgaggaaggagcggcaggagatggcggcggccgttcggcgcggtcggcggcaggcgagagccatagccatcgccgacctcgggtgcgccacagggccgaacgcgctgctgatggccggcgacgccgttgaggccatgctgggcgacgcggagcggcagcaggaggcggcgcctgcagagttccacgtcttcctcaacgatctccccagcaacgacttcaacagcgtgttccggcagaagcagaagctggtggtgccgagcaataatgccaatagcagccggtgcctggtgtcggcgtggccggggtccttctacgggcgcgtgttcccggcggatagcctggactacgtggtgtcgtcgtcgagcctccacttcctgtctagggcacccgcagatgcggcgcccaacgaggggaggatgtacgtgtcggcgtcgtcgagctcgagctccagctccagggtgctgcacgcctacagggctcagttccaggccgacttccgcctcttcctctcctgccgcgccgaggaggtccgccgcggaggcgtcctcctcctcaccttcgtggccaggcgggaggcggtgccctcgccgcacgactgccacctctgggacctgctcgccgaggccgccgccgacgacaggaggctcgtcgactccttcgacgcgcccttctatgggccctgcccggaggagctgagggaggccatccgcgaggaggggtccttccaggtgacgaggatggagctcttcgaggtgagccgctcccgctcatgccaatcccaagcagatctagatcagctggcggctcagacaagcagcaccatcagggcggtggttgagcctatgcttggaccacacttcgggtgggacgccatggacgccctcttccggaggtacacccacctgctccacaattactaccgccacaacaacgaccagctcaccaacgtcttcctcgccttgcacaagatttgacttcattcatcccatccttccttccttcaaccatatatatataccacattccctacagtatcagtatgtattactgtatttccaaaacgtacctacaatatataccacgtgtcagttctacgatatatatatactacccggataaaatgatagtatcgtttctaaaatcgggataccaactgtttcatgtactagacaatatttaaattcaaaactatttaagtgtatttgtgtttatgtatcttcaaaatcaatcttaaataaaattattagaactagtgagtggctttctcttgacaaatgtctcttttcatgtactattctatttatttagaatggctatatatatttaatataaatattaaattaaacttaaaaaaataaaatattatatatcccgatactacgatgcgattaaacaatccgatactactcaccttctacatgttcaaagtgtatagtacaacttccattctagcagtatattatatactagtatatatctgttcaaagtgtatagtacaacttctcttctagatgtgatcctcctatcttattataaatatgtttttattgtgtttgtgttgtaattaacatatataaatctgttgtgactggaatggattttaaacctcttgagggataatgactgcttgtataccttgttcttcctaaatcaaagtaaaggattatgggggatcctagcacgcgcgtacgcaccagctggaccccgtccccgcatccctcttttttcgcacttttttgacgcgttttcttctctttttttcgcttcttcctttttttaatctttcgcatacctctttataaatgtagaattgaaaatttttaattttgacttgaaagtttttaaattttagttgaaagttttcaaatttgagttgaaagtttttcaaatttgaaataaaaagttgaaagtttttcaaatttgacttcaaaaaattcaaaattttgagttgaaagttttcaaatcactagttgaaagttttcaaatctgagtagaaagttttcaaatctcgagttgaaagttttcaaaactcgagttgaaagttttcaaattttatcttgcaaatttaaatttcaagttgaaaattttcaaagtttgagttgaaagatttcaaaatttgacttgaaagtttaaatcttaagttgaaagttttcaaatctgacttgaattttttcaatctattagtaaaaaaatcttcaaaaaaaggacaatcttatcttaattagtgtcattatctaaaactaacttagttagttaggcttaactactcccgtctctcgtgaaaacgctcgcgacttgctgatctcgcgcgtgcgcgcgaattagccatctcgacgtttgttactcctacttggttcctatactgatttgtatttcgaaaaggtttttttttggaaggacaaaacctagatattactgcggagagaattaagcagtttgtattagaggagaaaatcgttgtggctgatttggccacgtcttgcgatgcccacaaaaataggaacaaattgtggttcacatggatggtccgctagtagtatttctgcttgctttttgctcatggaaattattaaaggactaagcaactggacatttaaggggtggtaactagcaagcatgaagcatgggctaactcgaaggggcgcagctaattcgcgcataagcgcctctatgttaactcgcgcgcactaccacgtggcacatacagcgaatcctcccatcgcgcgattagcataacggtgattatagatctaattacggtgctacagtaatttctcaataaaaataattcatttaaaaaattcgagttgaaagttttcaaatattgactttaaatttttcaaaatacaatttgaaagttttcaaatctgagttgagagtatttcaattttgagttgaaagttttgaattttgagatgaaaattttgacttttgagtaaaagatcttaaaatttgagttgaaagttttgaattttgatatcaaagtttttatttttgagatgaaaattttgaattttgatttggaagttttcaaattttgagttgaatgtttcaacagtgagttgaaagctttaaattttgagatgaaatttttgaattttgagttggaagttttcaaatttttagtttaatgtttttcaaccgcaagttcaaagtttttaattttgagatgaaaattttgaattttgagttggaagttttcaaaatttaagttgaatatttttcaaccgaagttgaaagtttttaatttttgagttaaatgtttttaaatttcaggttaacaattttattttttttgggtatgacttctttttctagagagttttaaattttatgtatagatttttcaaatttgtagttgaaaaggaaataacctttatgtgaaaaagaaaaaagaatgattcagatcgtgattatcaaaatctaattacgctagacatgatcttatctgatatcatgcgtacgtgcgcgtgtttctaccttcccggtgttgcgtggtaggccgggccgaaacagctgtgtgaggtcgtaggccacaaaacgcgcgtgacttagcttgctaacgcgtttgcacgacacagcgacatctattgcggcaaaaaatcaagttcgaaatcaaacaacactttgagaaaaaaaagagaaactaacatttatttaaaaaaaatcataattatttgggtggtatttcaataaattaacgaggatcagaatagttccccttcctatcagttgttgtttttccttttaccttttgtcaaagtgtatactttatccgttataaatattacttatatttaaaaaaacatatataggaataatgaaatattactatgaaatccgtcattaaataacaggttcgtataattaaaggaggctctatccccgatatggaataagttcatctgaggtcccttaacttgttaacgaatctgattttcgtccttcaaccaataaaccagatacaacgggtccctcaactgtcaaaaccagtgcagattaggtctctcggcggttttggctgacatgacgtttatgtggataatttgactcagtcttcatctgacgtggcattaacgtggcgcttacgcgccaatttgatattgaaaaataataaaccccgtgggacccacatgtcagtttcacacataaattaattaaaaatgatggggcccacgtgggccccacatgtcattcccactcctcttcttcttcctcctctctccccatcccctctcctcgcatgacggagagtcagctactggggtgaatcggcaccaccaccaccacgcggctgcgagaaagcggcggcggcggcggcgctggtattcccgtgcggcggcgtcggcgacgagcccaacgtgtcgcggcgaggcccaccaagcgtcgcaccacgggaataccagccgacgcgcccctcgcgcccgcgcccccgggacggcagcctccgagcgcgcgccacctcgatatataccccactacccatgccgccaccgtttcaccgctctctctctctctctctctctctctctctctctctctctctctctctctctctctctctctctctctctctctctctccaccttggttaacctgagccgccgggtgcttctgcatcgcttgccgtactcaatcattcctgcgatggcatctcgaggcgccgtgttgctcgccttggtcgcggcggtggccctgatgtccgcgtcggtggcgtcggcgcaggtggacggaggcgtgccgccggcgccggcacggatcacgagcgcggccgcggggggcgcggcgtcggcggcgctggccgtggcgtgctatgaataaagatggatcatgtgtctcgtctcattcgtcactaatttctgtgtttcagatcttagctattaacgtcgacacaattccctttttgtgtttcaaatcaggctctcgatttcgaacacaattcgatttcacgtcagtgatgcactgatgcctcgtaacgcggcggatgagttcccattccgtctgtcccgaaggcgctgcgagcgccgagcggtgggtcctgggacgctgcggcgctgccgttcgggtcgtacctcacgccggcgacgacgagaacgacagcggcgggttgtaccgcacaccgggtccggctactcgtcgggatcgccgccgacgccgccgcaccggaataccagcgccgcctccgcctccgccgccgccgccttctcgccgtcgtgtggtggtggtggtgccgattcccccgggccgatgactctccgtcgggcctgcaaagaggaaaggggagatggggagagaggaggaaaaacaagagtgggaatgacatatggggtccacgtgggccccatcattttttattaatttgggtgtgaaactgacatgtgggtcgcatggagtttattagggcgttcccaacccaataactaggatagtgtccatagcattaaataagttgccacctatgacaaaaaattgatgtggcaagtgaataaatgagaaaagaaaagaaaaccatgtcttgcatgagacatggtttctatacaacatccaagacatcatgtgagataagtagcattaaattgaagtatggaatagtggtgtttacattggaagagtagtgtctagtactagtttcttgatgatatggagtttatggaaaccatgtctagtgttatgggttgggactgcccttatttttccggatcgacttgccacgtaagcgccatgtcagataaagaccgcgtccaattaaccacgtaagtgccacgttagacaaaaccgccgaggaacctaatctgtactggttttgatagctgagggacctattgtatctggttttttcggttgaaggacgaaaatcggattcgttgataagttaagggacctccgatgaacttattcccccacattgtggtgggatacaaaataaacattttccatgaattttgaccgtgttaatatctattgggccaaacggagaccccaagccttagcccatttctacgtccgccgcccgtatgtggacgcatcacgtctgatctactctctgttgttccattttaaatatagggtccgtttagattggtaccaaaataaacctttgataaattggtaacattgtcaaaattttaataggattatcttaataatgttgtcaaaattctatacatattgccaatatttggtaacaaactaaacgtagccatataattatcaattttaccaaataatggtatgattgaaaatgtcatcaatctgaacaggcccatagttgtatgtttatgtgtctaatatttcatcattcgtcttatttgaagaatttatataaaaatagaaaaagtcacgcataaaacactattcaggttttatatgctaataacaataaaaatattcatcatataaaaataaatgatatggacgatcaagtattagatataaaaagttataagcaccgcacaaaatgagatgaagagatgaggtagcacgaggcatcttcttgacatccgtcaatcctctttttcctccgacaggttgaggtggaagcctgcctgcctaccatcgacattggccatgcatggctgctgcggcaagctcaagtctatgtaaaaacattttagcacaaaataaatatatttaaaaaatacatcacgcacgtggcctacggggggcagagttaggcgcttggaatattgggagttcatctaattgtaaatttaatgaaactaattactttttttattgcagatattgttacgttctgtaaacttggtaaagtttaaaaagttggacttaaaaatataaaacaccgtacaatatgaagctaactaggagtagtaattagccataactcaatttatgcctccttttagaagtttaaaggatttgtggagggattgcaatatttctatatgaaaattttctatgtagtcttttgaaacatattctcaattcatatgacatttcataggaagggctcaacgagggtagattttttaggaaaaaaaacgagagttttgacctgttgaaaaaaattctctaaatctatctctggatggttatttatgtatttttgttgtatttttaattatctattttgcgtatacattagatataaaaactttgtgattttcctatttttaattaattgtcgcgtgcgaagggaccttagtggtaggatgatgatacatacccctccatttctaaatacttaacaccgttgattttttaaaatatgtttgactgttcgtcttattaaaaaaaattaagtaattattaatgtttttcctatcatttgatttattgttaaatatacttatatgtatacatatagttttacgtatgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccaaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttccggagacctgctctcccgatcgctggtgcacgccggcgagcgggatggagtagtctacgagcgacggcgcagtacagagtaggaggcaaaccctagattgattttgcgtgtgctgcgtgaagacggcaggtcggtttatatagagaagggtcgcttgatcagggcgcccgcacgatctctactgcgcgtaaccgaaccggataagtcgcgcgtaacttatccggactccatgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccaggccaggccaggcgaggcgaggcgaggcgaggcgagcgagcgcgcgcatgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaattccaagctacacttactcacaacttgaacaatggactacgccttgaattacaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagtcaacagaactcattaaggcatagccaacctgccttgcagctcacgagagtacatgcatcttcacttggagagggtatatatattgatactctcctctagtttactaatggtttgttcttctcaggatctaattcacgggatctccgatcacatagactgggttaccaccatagtataactcatatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccacaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagcgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacttacaagcacaaaataactccctcacccccaccatggcgatagtacacacatttatttgccttattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctaggaaagtagcacacgaattgtggtcaatctagcaacaggtgagtaagtgtcaaagaaatattcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagatggttggttcgaaccactatgtgtatccttcattgggaaaaagctctcaaagaagatagcatcacgagactccataattgtaccaacatgcatgtccgatacctcggatttaactactaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcatctcatgtatgatgccatgttcctcacagaataagtcaaactcgttcgagaaaaactctccaccatgatcagacctaagcctttttatctttctgtcaagttgattttcaacttctgccttataaattttaaaatagtctagagcctcgtctttcgttttcaacaagtacacatagcaaaatctagtagcatcatcaatgaatgtcatgaaatatcgttttccacccttcgtcaacaccccattcatttcacaaagatctgaatgtaggagttctagtggtgccaagtttctctcctcggcagccttgtgaggcttgcgaggttgctttgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccctagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacattaagagacgcaatcaacccctcaacggagtattcctgtctcttgtgtttgagtgcagtaccgaaactcctccaagatggaggtagttttgcaataatgcacccggccacaaagttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcgacaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccaaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttccggagacctgctctcccgatcgctggtgcacgccggcgagcgggatggagtagtctacgagcgacggcgcagtacagagtaggaggcaaaccctagattgattttgcgtgtgctgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggccaggccaggcgagcgagtgcgcgcgtgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaagacccattcattaattccaataacatatttcataaaattttttgaataagacgagcagtcaaatatgttctactatagtagctaaatatttagaaacggtgggagtactactatagtagctatagtagctagagtagatgtgttgacaagggattgagtgagtgcgttgtaacggtgggcatggagtggccttgtagctaggcttatcatgatgattgatgatatcggagtagaatttatcatcaaggcccaattaaggggcagggctcgatcagctgtttgtgtagttggagcgcgcggtggaagatgaacaagctcagcaacctagctagctagtcgtataccgatcgatcgatcgatgaatatggagtccctggcagcaggagcatggtgggtggttgtgcttcttctactcgtccttacaattgtggcctcctggtaccggtcatggtggaagacgaccgaagcgggggggccgctgcttcctcctccggcagctggtgcaggtccatggtgggtgtgggtgtggcagtggcgggagacggcggccttcctggcctcccatggcagcgggcggggattctaccacttcgtgcaggagcgctacaagttgtacaagggggagggggagggggaggcaacctgctgcttccgcaccgcgctcatggggcgcgtccacgtgttcgtgtccgcctcccaccccgccgcctcccaactcctcaccgccgaacctccccacttgcccaagcgctacgcccgcaccgccgccgacctgctcggcccccacagcatcctctgctccacctcccacgcccaccaccgccacgcccgccgcgccctcgccaccaccctcttcgccaccccttccaccgccgctttcgccgccgccttcgaccgcctcgtcatccgccactggactacgcttcttccgcctcataatcaaaaccaagtcgtcgtggtgctggacgccgctctccacataagctaccgcgccatctgcgagatgctgctgggcgccggcggcggaaagctgaggccgctgcagagcgacgtgttcgccgtcacgcaggccatgctggcgctgccgctgcgctggctgcccggcacgcgcttccgcaggggcctgcacgccaggaagcgcatcatggcggcgctcagggaggagatggcggccagaaatcaccatcaccatcaccatcaccatcaccacgacttgctcagcgtgctcatgcagaggcggcagcttggccatcccgacgccctcactgaggaccagattctggacaacatgctcaccctcatcatcgccggccaggttaccacggccaccgccatcacctggatggtcaagtatctcagcgacaaccgcctaatccaggacaagctacgggtcaactatcttcttctttctttctttctttctttctttcttcaaattttcaattcaatcaatacacttacataacatataggagtacctcacatacatgggcataattaattaattaattgtactgtgcaggcagaagcatttcggctggagcttaagggtgattattctcttactatgcaacacctaaacgccatggactatgcgtacaaggtaggtactccttctcccctgcatccccttgctaattggagtagtactagcaagcttcttaattaattattcctacttcttactgtaaagcttaacttcagctgtgagtacataatatttcatcaggcagtgaaagagtcgctgaggatggccactatagtttcctggtttccaagggtggcgctcaaggactgccaggttgcaggtgactggagtagtatcttacagtatactattattaatgtcttgctcaatacgaattcaaggaaattaattaagcttatactactactctctccgtttcacaatgtaagttattctagcatttctcacattcatattgatattaatgtatctagacatatatatttatttagattcattaatattaatattaatattaatgtaggaaatactagaatgacttatattgtgaaacggagaaagtagtacacttgacatgctgagtaattttgacattgcatgtatgtatatacagggtttcacataaagaaggactggattgtaaatattgacgccaggtctctccactacgacccggatgttttcgacaacccaacggtgtttgatccttctaggttcgacgtacgtacgaatttctttacttgcttggttgcctctacatttttctactatctgaatctgaattaagcaactgttgtagtgtctgcaggaagagggagagggagatgatgcgaagcttgggcgtgcacaaccacagaagaggaggctgctggtatttggagcaggcgggaggacatgtctggggatgaaccacgccaagatcatgatgcttatcttcctacaccgccttctcaccaatttcaggtaggttaggtactggagtaccagaaaccagatgatgctctctatctcgtcgactcttgtaatcgattacaacaacactgctgtgctgatttcagatgggagatggcagatgacgatccaagccttgagaaatgggcaatgttccccaggttaaagaacggatgccccattctgctcacacccatccacaattcttgataatgttccagattaattagattcttcatgatgacttgtggaccgtggctgcctagctactttatctgtttaattagtaaggtagtattaacaaaaactgctgtcaatttattcgaaactagcggtattgtactgtaactaatagcctagagatggaattcggaggaaggatattcctttgttatttgtaataaataaaaaagacctgctatctggagtagatgtatcaagactattcatggtaaatttgcaatcggtgaggaagaagaaagaaacaaatagttggacacgtgacgatggtggcggaggagaagaggaagcatagcagggtgcgggacgcccatggccaaaataaacagaggattttcagtatttgccatccgattcagagcactttcatgatatgctatttaattcgtaccacttttgactttgctactaaaactgcaaatttcttcaatccatatcacttccatcatttagtgtcagttctctgttctcacacgccgacgagttcattcgtccaccacgaaaggagctcctctgacttaaagttagaaggatatgagtccttgacaggtgcggcccacctttataggcccacatgttagagatgcatgtccctttgacttaagttagaggagccttgtcggtccaccacacaccaacactggtaggacagacaacaatcctccacaccgcctgcgagagggtcctcttcctgtcttcctggccatcaaggaggagagaatcaactccacatcttctcgggtgacctctttgatagctccttcggcgagggatgggtgggcggaagtcaaggaggctgttcttgaagacggaaaagagaagtaggggcc

SEQ ID NO: 79246 - DNA, 1379 bp, Oryza sativa
tcctgcagccctttccttttaatgtcccggaacctctgtaggctgatcaaccatactggcccttaaattctagagcccctcagttataccacctctgtttctttattatataccgtcgtttttagatagtcacgtaaagaaaaaataggtgcaccctagctatcgttggatttttagagggtccgtatgtcatccatgcaaccccgttctgcatggatgatacgtggaccctctaaaaatctaatgaagagctccacttggcttgatgtgtgtgacgctccttttgactccctctaggaggctcactccgaattccagagagtgcaggcactacttgaaaaagggctaaaggtgccggttcctaaagtgccatatgtgccggattttcatccgacaccaattggtcgacaccaataaaagcaaccaacacctataataaaaatagaaccggcacctttaccattattcaagccaaaaaaaaaggaagagagctggctcgaatccgagccgaactcaccaaaccccaaaatcatcacccaaataaaattgatatcccaaccccaaaatcatcaacaaatcatcacagaatgaacattaacatcacaaaatgaacatattcaacaacaaatttacacaaacatcacaggggagggcgccgtcgcaacccgtcgcccgccgccgcaactcgccgcccaccgcctgcggcctcccctcttgccagatctggcggaggggagggcgccgccgcaacccgccgcccgccgcctgctgcctcccctcccaccaaatccggcggagggaagggtgccaccgctgcccgccacctgccgtcacccctcccgccggatccggcggagtggatggtgccgccgcaacccttcgaccgccgccgcctcctttcttgcgccgccgccggccgcccgccgctcgccacctcccgtcttgtgccgccgcctgccgcctcccctccagccggattcggcggaggggagggcgcggccgccgcggttgccgcctccgtcgagccgccgcccgggcaccgccgtgcgcgcgagagagatagagacgagagagctgagagagagagaggcgagagagatagagatgggagaggcgagaggataacgttgacttggctgcgtcggctcatataggatgtgtcggcttggcagctcggctcagattggataggtgccggttattataaaaaaccgaggtgctggtttttaattaaccgacacctataacatatcaaaggtgctggttttttttaaaaaaaccgacatatactataggtgtcggtttttctttagaaccggcagctatagttatttaaaggtgtcggttttacgtgtttctagcctgcggggctgcaggaa

SEQ ID NO: 79247 - DNA, 8576 bp, Oryza sativa
ttcctgcagccctaagcaccagcgcgtgaaaaaatatatataaaatctaataagtttatgatattattatcatactagtattattaagacaaatctagatgataacatcttcttgtttaaattaggtgcggagtatgtttgaagttattgatggccaagtaaataaatagttatccgagatatctactcatagagttataattaacaaatggtttatagaaaaaaaattatccatgcagcgtacatggcatataatctagagtaagttaatttggcattagctcaaaatttggagataagcgcgcagtgatcaaatttttggaaggagtgaaattggtttggcgggctttagctgcggcaaagagctgtatagatacgcaaaatcctttgaccgccccttcgtctcccttcaccgactcccaatccccaatgtctgcctaccagcccccttccctcatcgtccttgccgccggttctctcacagacgcgcgcggcaacgcctctacctccccgacgaacacctcggccagatcctcgtgacgctctcccagtcccttgcccatggcgtggacgaaccgacgacgcctctgtcgctctcaccgcgcgtctcagcgtcaccatgcccacgagcatcctaccccatcccggtgccaaccatgacaagcacccctacatcctcgcggctgaccaagttggcctcctcatcagtggtggtgctcccatcgatccacagtatctcccctttatcccgaggtcttctcccctctctctaatccccaacccaatctctttaattatagaactaatgcgagcagttttttttttcgtgtgtgcgttataggtttggcctatggttgcaagcagagggaatgtaagttcgaagctatcagaagaggtgtgaagttattctctttatctcactgtcctgtatgtagtatcttttacgcaaaatttgccataggacactcaaaaaacatgtaattggctgggagacaccgtaaaaacatgacacggctgatggacactataaaaattatgtaattagctgtaggacaccggaggcaatagtttataattttcaggtcagaaggggtgagaaatttttcgaaatgacgagattgcccctggcgctgctcctctccagctcgctcatctccgccgcgtgagatctcgttgctgctcatgccgtccacaaccacgacctccttcttctgcgtcgccagtggggacacacaccaccgtcccggcctcttcgccgacgcccgcatcgcgagattctacggctccttcccgggcggctggctcgccgccgagctccccgagtcgcgcggccacgcgctgctcaacctctgcaccggctcgcgtatcgccctctcgacatgactccgctacagcgtcaacgcccgcaggagcaacaagtactccatcatcatccacatccacgccgtcactctctccgccgccctgtccgacgatcacccgtactacgccgccgccgtaatgtccagccagtcgaacatcgatattgtgttctggcgccccagcatggactactgaacggtgaacgccaccgacggagaattggggcgcgaagttagaagattggcagaagctgacatgcaatggtccaatcgaggacgtcacatactacatcggtccgcttggcgagggcttctatgtcctcaccaacaaggaggacctcctgctgtacacgccgaacaccaacaacaaccccggcgagctcaccatgtcgtccatggagatgtacagcgtctgtgatgtttgcgtcggccatgtttgcgcatgtactgcaagatgcggcggggtgacttctgctgtccgacgtgggtgacgacggacgcccggaagctcatcaagatgctgctcgaccccaacccgggcacccgcatcaccgtcgtcggcctcctcgagacatgtggttccagaagaatgcgcccgtcccgtgccccatcactgacctcgggctggcgccggtggacacgcttggcaaggccgacgacgacaaaagacgaacctcccgaggtgctgaacgcgggcggcatcgctgggacgcatggcagcgccatgcccatgcacgggacgcagggggcggctcgccgtggcgccaggggcaatcccgctatttcaaaaaatttctcaactcttttgacctggaaattataaaatattgtctctgatgtcctacagccaattacataattttgttagtgtctatcagccatgtcacgtttttacggtatctctcagcaaattaaatgtttttttagtgtccggaagcaaattttgcctatcttttatgatcaatcataatatcgttcatttacactgtcacactgccaactatcgagcaatagaagcattgaactctagttctgtctttgactgcttcggacatttcacaagccaagccagtttcatgcattaggtggattggcccaaactcatattgaacttagctgtttgctgatctattaaagataacttttgaaggttgtcaaactaatgtttggcagttgatgcgaatatggcatctagtcacagttatgatcaggacttctattgatgaatagtgattacctcaactggctctgctgtttctaatcttcattgtcatagaaggaagctgtgatttggtaaagcagcaatatctatactctgtatgacaaatatatgcttacaagagaatatctagagaatatctagagtacttgccctctggagttgtttatattgctggaaaaactgagacttctagatgttgagtgtgatattaacttctgaatttggctattacttttttggctaaattggaatatgctgaaatgtatcagattttttaactgaggaaatgaaccaatcttttatggaacttgcttttatgaaatgatagtgattgaccacaatgatggtacaaacagaattggcaagtgcttgtgttttcttaagtgatatctggttttgtagtactttcttcggttccatttattttcttgactaatggttgtattttttttttcagagcgctgttatttcttcaggttctaattcagaggttcagataaagtaaacatttatgtttgtaatgcaaattatatacagatatatggaaaacatgcatcaaggtatagttacggcctgtatactctaatcatgaaatagttttaattcaattttgtgtacatcatataactagtaactagttcaatgctttgcattacaaattagaaatactctgctatgatcttaaatctctacttcatgaagtcaatgttgataaaaataaacccctaattctcattccaaggaaatcaatggtcttgttgctgagaccactagaatttatttttaagcttttcttttctttgttcaatcaggcttcttgattgttttctagactatactcttgagattttgtgagaaacagagcatccgtgatattttaaccaaaacaatgtttaaaactgtagctatacatgccttagatattatcatttgattcaacaggatgtgcactgaatgcttttgttcatttatctgcttaatatttataatgcacattaatttctaatggctaatagctaaatatcgtgtttctcaactacaggtacttgcatagcatgcgaggtgtgtgtgcacacttaaaagtagatgacaagttgaactcaataagaaatggttgttcagctgattgcctcatcaagtcaccatgggacaagcggcatgcaaagatgcatgaagaatatagaaatagttatatattttgatttgagcactagaatttggtttttgtattgtgcatgttccctgtagatgtatataacagtatacttcaatgtaagcaataagtcaacaaacgtatggtgcataataaagatttctaataattattttaatatatagcagcaacaagcaatgatttcttaaactatattgctaatcatgctattaatgtgctgctacaattaaaaatggttttactactttcttgagaacttgtatttgtacttgtgttactagtgccaaaattttgttttactcgactatgtagcaacacagggcgttgtgttacaggagataaacaaaggtgttcctagctaaaaacttgtaacacctattcttatcaattggaacacttatatgtgctacaaggatccatgtgtagtaacacggccaacaagaacacatatcagttgtgttactagaatcctcagtaacacgtttctggagatatagtagcacaaagacgtgttactataaccctgtcctgcagtagtgtgatacagtggcgacgcttcttttctcggctggcaccatggcttccaagacctcattccctcttgaaaactaatcaaccaaccaatccacccatccaactagacctcaaattgatgacacgaaacaacgaaacaaccaaaccaataatccattatcggtggagaaggtcacacgaaaagaacgagtccagggtgctactaggggcggtggcagcggcagatgaggggaggcggtggcggcagcggcagatgaagtagacggaggagccaatcgagccgcgttggcacttggcagaggcggattcaacctggatgcaggggggactatacccaccgtacacatggatacccccctgagttcccccttcaattttttcaccatggatgataaggtagggtgctgaaggtctccggatggctagaggttggagaaaccgcgtattgggccaacgatccgcataattgtgccaggcagccaagggcataaaaattgcctattgcctattgggctttgaactcactcacatagacccacatctagctctctatgctccgcccaacccccaatccccattcccaatggcaaaccctagcttccaaatccaactaatcgaggtagcttaggcaggcaggcagcgagcggcgccgacaagttaacggcgccgtgcacggaatgtgtgacggcgctaccgcacgagcgcgggctggctagcagcaccgcggcgcacagtgccagcgagcgatggcgcattggcgcaaggctgcgagcggcactgcggcagccggcagccaagccgcggagcgtcggagcacgcgacgacacgactgcgcgagcagcaggctgacggcggcgcgatgccgcgagagcacgctagcgggactgcaagaggagcagtgtagcaggctggcggtgccacgggagcgagcagcagcagccagcaggctggtggaggggccggagcgagtagggagcagaatgtcataaaaaacattgttctgttaaacaacatgcatgtattaatgtatatcttgcctaactgatctagctgagatttagattgttagtttagataagatgtatatcctttagatcaaatctgggctagattagaggctatataatcctgtaatctcagcgccgattggtacgccaatataacacgcagccgtcgcaccgaaacaaagggcgacgttcaacccatctcactttcgctgttttacatggtatcagagcgagagaaaaccaattcaatctagatggccagctcctcctctaccgcagtttccaatccgctattcggggttcaagtctccgagaaattgagcaagcagaatcatgcgctctggagagcgcaggttctcacggtgattcgtggcgcacgcctggagggtcacatcaccggcgaaacggcagtacctgccgcacaactcagcaagacggtggaaggaaaggaggtcaaattctccaatccagcgcatgacgaatggattgccgcggatcagcagttcctcgggttcctgttttcctccatgacgagggaaacgctagcgcaagtcgctactgccgcaacggcggccgaagcctggaagacgatccaacggatgttcacagcaaaaacgcatgctcaaaccatgaacgtgcggctggccctcatcactatgaagaagggtaatctttcagtttctgattatgttggtaaaatgaaattgtttgcagatgagatagcaacagtaggcaagtccatggatagcgatgaactgatcgcatatatcctcaatggactggacgaatgcagccagcagaaaccgtgggggcttctcctcgtgtggtggcgcaggaagaggccggaacaccaacagcaaccgcggccgtggctccggccgtgggcgtggtcaagtcaacagcgcggcaacgacggccgccccttatgccatgtgtgctacaaacgtggccacgttgctgcaaattgctggcatcgctatgacgaagactacgtcccagatgacaaactcgtcgccgcagctacatacagccatggcgctgactcgaactggtatgttgatacgggtgctaccgatcacatcactagtcaactggagaaactcaacacgcgggaggtgtacaagggacatgatcagattcacaccgctagcggtgcaggtatgaaaatcaagcacattggtcatgctatagttcataccccaactcgtcctttacatcttaataatgttcttcatgtgccacaggccgctaaaaatcttatatcagcaactaaacttgcctctgataactctgtttttgtggaaattcactctaagtattttttgattaaggatcgaaccacgaggagcacggttcttaaggggccacgccgccatggtctctatccgcttccgtccacatcatccaccaagcaggcctttgcagttgctccatcgcttgagcggtggcacagtcggctcgggcatccttccattcccattgttatgaaggtcattagttcaaataagttaccgtgtcttagagaatctaataaagagtcagtgtgtgatgcttgtcaaaaggccaagagccatcaattaccgtattccaattctatgagtgtgtccaataaacctctagaacttatttattcagatgtatgggggccggcctccacctcttttggaggaaagaaattttatgttagcttcatcgatagctatcgcaagttttcttggatatatttcctcaagcataaatctgatgtctttgaaaagtttcatgactttcagcagcttgttgagcggctttttgatcgcaaaattatagctatgcaaaccgattggggaggagaatatcaaaaattaaactccttctttgaaaaaatcggaatctctcatcatgtgtcatgtcctcacactcaccaacaaaatggttcagctgaaaggaagcatcgactcatagttgaagttggtctagctcttcttgcatatgcatctatgccacttaaatattgggatgaagcctttcttgctgccactcatattattaatcgcattccctccagaattcttcaatatgacacacctctagaatgcctatttaaccataaacttgactattcttctttccgtatttttggttgtgcttgttggccaaatcttcgcccttataatgctcataaattgcaattccgctccatgcaatgtgtttttcttggcccaagccacacccacaatggatataagtgccttgacatagccacgggaagaatctatatttgtagagatgtcgtctttgatgaaaatgtttttcctttatctaaatttcactccaatgcgggttcaagactacgcagtgaaattgcccttctaccctcacatcttttatctcacacttctcatcaagggggagaacataacaaccatatgcttgatttttataatgtttcatctgatcagactgatgagaatgcagatatagatggaggaaatacgacagatacaactaatgatgatctgggtacgtcagggaatgtggatgtagcagcagactcgggttcggcttcgaaaattgggtagcagactgacccaacagaccaacctgcgcatgacacgtccgccaccggcgccagcactcgccgctcatcatcgccgtgccaaccaggaggcgaaacgcggctgcacaacagtgggtctccggtgcatagcactggtagtcaatccacacatggagacagatatctacattggcaggtaatcaattgcatgaattgagatcctctgtgatgcaggacatgcactttggaggagaagcagccactcatgccacagaagatcaatcaatggtcgcagcaaagcccagaacaaggttacaaagtggtatccgcaaggaaaaggtatatactgatggaacagttaaatactcatgttttacttcatctggtgaaccacaaaaccttcatgaggctttaaatgataagaactggaaacatgctatggactctgaatacacagccttaatgaagaataaaacttggcaccttgttccagcaaaatcagatagaaatgttatagattgtaaatgggtatacaagattaaaagataagctgatggaagtctagacaggtataaagctagactagttgctaagggctttaaacaaagatatggcatagactatgaagatacattcagtcctgttgttaaagctgctacaataagagttattctgtctattgctgtatctagaggatggagccttcgtcagcttgatgtaagcaatgcttttctgcatg

SEQ ID NO: 79248 - DNA, 1656 bp, Oryza sativa
tggcgcccccaaaaagaccatttcagtggtctatttgcgaaataagtttttcaaaaggacctattaagagtgaaatttggtaagccccgaagacatcatcgacctagagccagtattgtcttcagaatcccggaatcggccgatgagaattatcacgtcgccaatagtcggattccttctatattcggttaaggaaattcatctattaaaggaagcttatccagaagtcaccgagttcaaggaggatgcggcatagcaagctatctattaattaggaatagttttttagtttcctttatctttcagaaagtgtgtttagtgtcttataaatactctaagttttccttttatcttttaggaaagcttctttattttcctacaagtactagtatctccccatggatataaatatgtacacctggggtcattgtaaactatctcgacgatcagtacaatttaagcgcatcgccaccctttttacttttctactttttatcatccgacagaacttggcacctaacgcggggctacatcggctttcgatctccggcgaaggggtaagtcctacgttccgcaggctcaggcaattatatcatctacattggtgtcattcaaggctgcatcagtacatttgacctcttggattgttccggtttggaagacatatttgcttgcctatttatcatataagttaatctagtttggcaactcgatttacttgtatcggctgagattcgctttagggtttatgccggtatcggctaaatcgctttaccaggttagattagctaaggtattcaccactctgaaaattaatcaaaggcttaattttctagactttatgtttcttttcatacttagtgctgcatcagttaagtttgatctaatcagtcatgcttagaatcataaagtctagcctatctttgattataataagggtttcattgggatttcagctgatgagttatctggacattgcatcggtttacaaggattacatataagttggattcaaccgatgataacaaaggtttcattgtttatctaatcttgtggattcaatgtatgctttaaccttcgaatcagtgcttattctatcatattgttagctgattggtttctactggattatactattgttatatcatattattatcagtcgattgtctttgtttacctcaagtgtcagattctatatcaaatatatagctgatagcttaaaaccctatcgttatcggctggtatcgtcatcggctggactactccatcgccttatcagccgatcggctcattaatctgctatttatatatcttgtcaattgcaggaccaaactgactggtacgtccgcatctcaccaaccttgggaactgcactggagctaagtagatctcttaggccgttgtgttcatcaacttagttcgcgccaacacagacttgacaccattcgtcaagcacggatttttcgtcaacaggaccaaattgtaaaaaaattcagcaatgtgattgtgtgaatctgaccatagttcctcctgccgcaacaccgcacgagcacaacacaagtacacaactagtaaaggcagcgcccaagcgtccttattttgatcggaaaagctaaatggcgcaaacgtggccaccctgcaccagctcgcttgcta

SEQ ID NO: 79249 - DNA, 4901 bp, Oryza sativa
agaggggagggaaccagaccatacggacgaaaaaaaagtgacgaaaggaaaaatacgaatcttttaataagttaagattaagataagatatattattattaggtaggtatatatgtactatggggtgttcttgtggtgtacgtattagggcgtgatctgagcgtagtggacctgaacgtgacatgggctttttttttttgggaaacatgacatggggctattaaggaggaatcggacagaaaaaatcgtaaactacacgcggagggaatcggattaaaaaatcgcaacaatcacgctatatacgggagggaatcggactaaaaaatcactcgggacgatgtacgaaaattcatgggcaaaaacatcttaaacttttataataggaaaagatttaatgataaaacaaatcacagtaaaataattaatacttatgtacttatactacatttattgataaaataaatcacaaaataattgaatcctaacgttcacaggcctctcatttaagcatcaaagatttccaaataattaagaatttttggggaaaaaaagtggcatgaatcgaacaatccccgccttgcatctcttatttacctccaagcagctagccaagtctagtttttctccctcttatcttgccccaacacctccccttcctccctctcccgtgggcctcttggcccgagaggcccagcccgcccgtctgtttttgtccctccctcgttgccaagtggccctcgctacagtgtcgtcttcaagctcgcgacaagaccggactctgccatggccgccatctcctcctctaaaaccgacgcagccattgccccctaattaaatccgagcccaaaaaggaatcccctcaaacacctcttccttttggactcggaatagacgcaagagagcgaactgggagttttttttttctccaagtcgttgatgaatcagacttttttttctttttatatgtttgaatcggactaaaaaattgggacgacgtacgaaaatctaagggcaaaaatatcttaaacttttataataggtaaagatttccagccaaaacggaaagagaaatattggttaaagacaagtttgcccatgggcccacttgtcaatccctctttctctctctctttctctgctcatcttcctcccgcgtccccggggtgtggcgctgcgacgaggcgtggaagctgtacgaggctgaggacgagaacgacccgttcgacgtcatacactcggagagcgtgccgtgttccaccgctgggtgcgtggcgtgcccgacctggtcgtgtcgtggcacggcatctccctcgtggcgctgcactcagggatataccaggacctcacccggcccgcggcgacgacgagcgcatgtcgccggcgtccaaccacaacctggcccagtcggtgaactggtgctgtctgaggtgcgcttcttccggagctatgcgcaccacgtggccatcagcgacgtcgcgagggagatgttgcgcgacatgtaccagatccccaaccgcgtgcacgtcatcctcaacagcgtcgacgaggcgcagttcgagcccgacggcgctgggccgcgcgttccgggaggacctcacgctgctcaagggcgccaacctggtgctcggtgtcacaccctgaaaaattcaaaatatataaatggttgtttaattggaatttttagaaatgattttaaaagccttgaaaagaagatctaatttttaattaataaattccaatataaaatggggccagataaaatttcattaaatactttgcttaactctataattcctagatttttctgggatttatttgagctaaggaagtatttttaataaatggaattgcatttcatgaataattttaattgaaaaaggttttagaagtcttcttttggctttgggccgaaagtcggcccaaaaccgctctctctctctctcctcggcccagtccggcccaatccgcagccgcctgcgcccgcgcgttcgctcgctgacaggtgggtcccgcttgtcggagtcgtcgtcttctttcgcccgccgccaccttcgccttcgcctctcgtcgtccgtagcgccctagcgtcgtgtgcccttgcgccgccgtcgccgccgtcgctccagccgtgcgccgccgccgttccagacgtcgccgtcgctcgggaagaccgtcgtcgtggtcgccaagtcgtcgccgtcctcgtccgccccttcgccgtcgctgtagaccgccggagcaccgtcgccgtcgtcaagccgaagagcgccgccgcttcttcttcgtcgccgtcgccgttcgttcctcttccgccgtcgctttggtcgccggtgagttcgccgtgccgtccgctacccgttggtgccctccgttcgtgccgaagcgccgccgttcgccggcgagcgtgcgccgtccgagccgccgagccgccgccgctggtggtgacgtcatcgtcgacgtcatcgtcgccctctcccgtgagccggtcgtggaccgttcgatctcggtcgtccgttttggatcaagtcgatctcggccgtccgttcgcgtgaaccgccgccgtgcgcccggtccaccgaaaccctagtccgctgacgcaataaatccctttttccttttcaaaaataattcattattgcgtcataattcaattaaaatcaatataagtgttttaatccgaattaatcttcaaaaattcataactaattcatcttagctcggatttagttggttcaagtctctaaatttttctaaaattgagatctacatgttaaaaatatccacatgtactgttcatgcttgtttatgtgctgttttggtgttttttctcttttctgtttagattccgtcgtttccggagagtccgttttcgtcggagaagaatttgaagagttccaaggccagcaaggcaagtcacacagatcccaaacaaccctttgagcatgttgatcccgtttaaagctattgtttcttttcaactactgcatttattttcgaatgtcattgggtggaattaacctattgtttgttatagcccttttgttcttgattactttattccttgataccttgggttattataatttgactagttgagctttatgtatattggttcaactagatattagatataattgcttagccctgcttagaaacattagctcactattgggataacttatgactcactgttatttaatgatggcttaatgatagttcacgatggtcaatcgtgattagttaattaattaatgtgccaactaaaacctggtaatggtgggttgtgagcacatggttttgagagtcgtgctcatgacaattaaggaccggttcacgagtttcggttgtgaaacattaaccgtgctagccacaagccagcgtgggcaacggctttatcttttgtatagcatggttcattgcggggcaccagactgagaagtggcggagataagcccacgggggtcgctggggagtccatgccttgtttataagggggtgattatgatccaggaatggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcaccctctcatcataataaatgctttaattggtaataattttattagctcctggtttggaatggaatattcctggtttggagatagaactgtacagccgggatggttgttcagaatggttgggcctatgcaacagggtatgttgtatagcgttggatcaatattgtttaattacttaactgttttattacatactcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaatagttctacagtgaagctgatggtgtggaggattaggtgtagccttggtcaagctgcctgtggagtggagccgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagccaggttgaccctaggttatgccaaatggttatccatagaagccctctaaaaatattggaaaagtagaactgttctcctccctttctcttttaattaaactaaactaatggcacatgcacttcataatctcttttaatggttctcattcaaaatttattccagtgttattagtactgtacatctattaccgtactaatggctcattttaccagcaaaagttttacaatattgctttatttaatcttgctgcaacaaaataaatttagcatgttgattttataactttctttcatttcttttgaaatctgttattcaaaagtacaaaacttgtgaccttgtttccaactgtttcaacttatcttgcaagcttggtttactttatttacttacctttttactttgatttctaaactttattcaaattaatccaaaaacttgtgctattaattggataaatgtcttaactccctcctttcacttgtctttagatgcggcgttacaagcctgagtacttgtttggtgttgagggatttatccaggagttgcgtacgatg

SEQ ID NO: 79250 - DNA, 682 bp, Oryza sativa
aagaatccaagcgcaaccattccaagattgagtgggtagctacccaagatgatgaagacgagccgaacgagccttcaatcgacctccgatgctcggaagaactagagtgacttgttaagtcattgtcttagatcgttgtgttagtttgcttgttttaagtttgcttgtgtgtgtctcgcatgtgatttacatcaggggtgggatgtaagtgcatgcgtttgtttgctttcgagtgttaggtagttggtgagtttagtggtgtgagagtcttcagtttgtaataatgaaactcagttaagatcaataaaagttaaagtaattctctgtcctaagtagtttcccccggtttctcttcttgtgccctgcccatgccagatggtgaacactcgcagcaacgggaatggccccaataacaataataacaacaacaatggagagaatcccacacttgcccaagtcctggctcaacaagcacaacttatgaacatgatgatgcagcaactccagaaccagagaacagggaaataaccatgcacctccccagaacaagttagcagaatttcttcgtgtaagaccacctattttttctagtaccacaaatcctgttgaagctggtgattggctgcatgccatagagaagaagttggatttgcttcagtgcactgatcaagagaatgtctca

SEQ ID NO: 79251 - DNA, 1223 bp, Oryza sativa
aaaagaaaaaaaaagaaaaagcggcgtcaggacgacggatcggcgcctcggcggcggctgcggttgatacggaggagatcgcggcagcggttgagacttgagaggaaggcggacggatcaagacaccgctcggccgttttcttttcgctgattccggatcgcatcgatcgagtcgcgcgacggtggtgtgcggactgcggaggaggagcgcgtagttccgattttctgatccacacatgtgcttacatgcaaaaatttcgcgattcccagcgacacgaaatattaacagaattcatttggtttagataagccatacgcgtgcgacggcgccgaatctatccaccaagataattaaactaatctccagattatttctcatccaagcctgcttccctcctctataaattgactccaccccggccgaggtttcctcacccatctcatcaacgccttcttgctctctatctctctctttttcggcatccttcttagtattggcaaaagctcgttgtcgtgctccggccatgaagacgacgatggcggcggcggcgacctgcctcgtggcgctgctggtggtggtgctcgcggaggcggccggcgtgggctgcaccaccgtcgcctacaatgaccgcagcctggtgatcgacggcgagcggcgcatcatcatttcaggatctatccattacccgaggagcaccccggaggtataatgaaaattagctatggatatattgatcgctatgcgcatgcatgcatgcatgcaaaaatacgtgtgattgtggtaggtcttagccgtcttttgatattgcatgtacatgagatgagattagtacgtgcgattttggttttgttcttcatatatatgctatacaccaatctcaaaggatcgcataaaatctaacagtagccgtcatttatatctactgtaattatttcttatagatcacatttatatctactctagatgtctacaaatttatattctctcagtttttctagtcatacacccgcgcacatcattattctttttttcaccagttgcttggctcataacatcgttatacatatggtcgaatatgactaacagtacgtatttacttaagtagattaatcttcgcatcatactttcacagtacgtataatatcctactagcgatcgatcgactatgatagaatatatgactaacagtacgtatttacttaattagatgaatcttcgcatc

SEQ ID NO: 79252 - DNA, 1109 bp, Oryza sativa
ggcaatcctaattaagcaattggtctctctgggctgccattaattaatctcatcctgaagcctatgttctattcttatattcttagtagtatcttgaacacaaaattcagatagaacttcactaatttctttttgttctatagctactagagttgactggttgagataggagctttaagtgaataggttccttctcagttcttacgatatgtacgtagttaattagtatctctacatcacaatcttcttggttgagtcattcctcttgcagtcttaacactaacagatgacgtgctctttaatttataggggacatataagatattataaacttaaatagtttcaatatttgatgtattccttgtatagcgtttatactattcaattatcaccaaacgttactttgtgcttaatgatgtcttaaagttcaacattttttcctatttaaaataaaaaaaatattttacatatatatttactagctactagtattgtagggccctttatttttgtctcgtactaggcctcaaaatttcatgactagccaatgatacacgtatatttatcatgtttccctctggtgcagatgtggcctgatctgattaagaaagcaaaggaaggtggccttgacgcgatcgagacctacgtcttctggaacggccatgagccccatcgccgccaggttagttctgtctccgataaaatatgtatactgctttagctgttactgctatttatttagtaagtaatcgaatatgtaaatccacagtaaatattttacgatttaaaactaagcttatgtaattcaaagcaaggctgttccccatgtatataccccatgtatatacggaggagtactatttatttagtaagtaatcgaatatgtaaatctacagtaaatattgattaaaactaagcttatgtaattcaaaacaaggctgttccccatgtatattatttagatgaattaagcttagtttatacatccttatattccaggctgttccccatgtatattatttagatgaattaagcttagtttatacatccttatattccttgcgtatagatcgcagtatcgctacttgtagcttattttgcaaacccga

SEQ ID NO: 79253 - DNA, 4734 bp, Oryza sativa
cctatacagccaggtcaagctataactaggcgtcgagactaagccgatggtcaaatcaatggccttagccgattcgacatagcccttggtgccaggttatagcagggcttgcctgtataggtagcagatacacatgcaacgatttaagaaacaagcatatcagataagatcggtgaaaccccgatactacccctagaactgaccaaaaacaggctatacccctatggttctaatcacgacttagcagatcaaacctaactgatgtagcactaagtatgaaaagaaacacaagatatagacaatcaagctgtcggtcagtagtcagggttgtagataccctggctaatctaatatggtaggacgatttagccgataccagcatcaaccctaaagcgaatatcagccgatacgggtaaattgggctaccaagctagattagacaggatataagataaaaccaagcaagcatgtaaaccaaaccagtgtgatccaagagatctagtgtaatgatgcagccttgaacaacgccgatgtagtcgacatgattgcttgggccggcggaacgtaggacttacctcttcgccggagatcgaagccaatgcagccccgcgtcaggtgccaagttctgccggaacgtaaaacgaaagtaaaagtaaaagggtgacgatgcaccgaagttgtattggactgtctcccctattacagtgctagggggttaacatttataccctgggtacaagaaaagtccattatggacacgacccaaaaccttccaaattctagatacaaacaagaccggccatttacgacggtttcttaccaaaactaatcaaaccgacgtaactaacctatttaacctatttaatagatacaattgccttcaaatgagctctatctctatttggtaatgacggttattccaaattgggcctacccgagcccgagtcgcactgtgctggctggcccaatcatcggccgactcagtcagtcctggtcgttggcctttgttctcagccgatatggttcctggccaatgcatagttcaattcggatcccagcatacttcgacatcaaatctatcctgatttccttctttcttcctgagttctgctgccagattacaccgttaacagatactccctccgggctgataatacttgtcgttttagacaagggtgaggtcaaactttagaatctttgattatgaatcattttttaaatatttgtctttcaaatatggtgactacatgtatagattactcttaaaaaatactttaataaaatcatatatttgttaacacttttatacatattataatataaaataatggtcaaagttgtttttaaaagaccgtgtacttttccaaaacgacaagtattattaacccggagggagtatatatacatgtattctataacattgatatatatatatatatatatatatatatatatatatatatatatatatatatgtattggagattatcttgtttacaaatgaaaaaggtttgacacagatagctatcataaattaattaaagaagagagttacccgtgccattagagtattagactctgccgacagtccatgaaggggtcaccaggtaaccatcacttggtacccacaggtcacaggaaagttggacaaatgtgtgcccaccctgctgccaacatgcttcttgtttaaattcacttgcaattatggcccagaaatcatcaactgattcccatatcttctcctttatgacctagctagcttgaaaaaaaaaatctccaaagtaaactccacccaagtttccatcaatcaatcaatgagatttaatttatgcaccattatttctttttgtacaacccaaattgcaccactgaattaaacaagaaccacataaatttccctcatctcattagtgctaacataagatactagtttaatcttagatattttgttccttcatatccaaatccatccacacaaggggcagctttgcctcatgtccaaatcacgtctccatcttcttctatctcatccatctataaggatggctcgtatcatcctcactctctctgcacactgcttctcgctcccgctctgaacttaacgctgcaaaaaaaatcttggagtgtataactgtgtaagctttgctcaatggcggaggagaacaagtccggctccggcgacctgatggcgagcggcaaggtggtcgcggaggcgaccatgtcggtgttccagcagaagagcgtggagggcgtcgacaagaaggaggtcgccggcgccgccgcggacctgctgcactcggcgtccacctacggcaagctcgacgacaagccggtcgggcagtacatcgacaaggcggaggggtacctcaaggacttcagctccggcagtggcggcgccgcaccgccaccgccggcagccggagacgccgcagcgccgaagccagcggcggaggagccgcccaaggagcctgcgccggctgagaaggaggaaggcaagccaccgtcgtcgtcggaagggttcggtctcgacgacgtcatgaagggggccgagtcgctgatggagaagaagggcggcggggaggagagcgccggcagcggcggcgccgccggtgggctgttcaagatggcgcagggtttcatgaagtaggagagctctttggctggatatatagctgcatgcatgcttgtctctggattgtggctctgctttaatttgcttgttaattaactgatgatctgtatgatgttttgtaaatgtctctcagctctgttgttaattttgtgtggtgaataataagaagacagctactttgtgtgtataaagcctgtttttctccgtgaataaactaattctaatctactaattaattcattcactacttaatattcttatgatagttcaagacttatggggagacgagatggataaattatgtggctatgtttttgtttgggctgttgccaatgtcaaacttgtcaaacatatcggtatactagagatttagtagtacctcaaaatagagaaaaaaaattgttatggtacatccaaaatttacaatctttaataatggactagaattgaaacctccaataaaatactaatttttttctcccaaaaagtcgatagcttcgagcttcaatccctctactatttatacccacaacgtggctgcccctagccacgaatccaactagaactaggactcctaatcacataggaaacctaccaaaccagggaaacaacatccccatacaattccacgttccaatcttttcaaacttggactccaatccaaatttgactactctttccatacgcacacaacacaacatgtatgtcatatggaaaccttcacctccacgtgcattgttctctaatccgagcatcatgtgtgacatcctagcctagggtttaatatgattaatagaatacccataacaataagttacgacttctttttcagaagccaatcaccaaagaactttgaggttaagcgtgcttggcgcaattttgggatgtgtgaccgcttaataggattaatagaatacccatactaacaagttgaaaatttttcccgggtgcgcacgagtaaagacaaagtgggtgaccgcttaataggattaatagaacactcataccaacaggctgaaaattcttcccgggtgcgcatgagtgaggacaaagtatgtgagggcagtctatatcctagaaaaactatcagatgtaagtgggcctggcctgggagaggttctacgaaaacaacgcgaaactttttccctggtgcgcacgagtgaggacaaagtgtgtgagggcagtctatatcctggaaaagctatcagatgtaagtgggcccggcctgggagacattctacgaaaacaacgcgaaactgatgtgagaaattctacgaaaacaacacgaaactgactcacatcaggagtttgccggtctgaccattgggctacccggtcaagcactaacaccaccggtttgactggccactagagccgacaaccgaaaacacatcacactgcattttcaccaaacaattgttcatcaccaggattaatcatcacatgattttatattggcctctccatcactcatatagattcattagcatctatatgaatttggagatatatacaaaggacataatggatccatgcaagaaattattccaaatccaaaacatgtttgttgtcgaaacgacgaccgcatacgtcgaaagacgtggttactcaacagtggttggaaaaacgaagtgtattaaattttgaatttcccttgggatcttcccccgttacatggccctagggggctatttatatccccattacaggttcttactactagggtttaggttatacaggggaatttacatgattacccttatgaaagggacatttacaggggtacatgatgatataggggctcatgggcccttgatgggccgtctggcgatcgccggccctattgcccctaggcttgatgggccggaaaggcttctttggccctcgcgggggcaaacttgccaaggcgaagtcatcttccttcggcagatagtcttcgccttgcacccttggcctgagacacctctggcctggcaaggcacttcgcacgactcttcgcctcacgccgttcttgctccatagccttcgccatgggtttcggcagatttggtcgaagggcctcatgccatccgccaacaagcccctcacgggcaagggtgaga

SEQ ID NO: 79254 - DNA, 49792 bp, Oryza sativa
  unsure (1)..(49792): unsure at all n locations
ctgtttttacctagtgctgtgcgacaattaacagtacccacaatgcaaacttagaggtgctgttataactgtaatttgttttctttcagagtaggaaagaaacatttcaaaaaatgaatgagcagtaatacagtacatctgtatgcaggttctcgactggcttcggtgtttctgggggaagtacgcttatccatgatttttactcaagagaagtacagagccccattcatctcactgttgacactgggttcacaaggggcgatgcttcaatcaaagcctatatctcatccaacctgtctcttggagataggcaccttgctgcgcagttccaagagattccccttgatctgaggatgcttgaagcaggaaaagttggatgtatgtctcacagtcatcattgctgacccatactttttcccccattaccttaaagttttctctacccaatttatatgttatacagtaagatcttaagttcttaggatgagaggtatacaacattgaattaacaggtttatatgttatcactagaaatctatatggggcctgcaaaacctgaagcaaaaaaaaaaagtcttcttttggcagctttgaagtccttatggcttgaatatttataatttccttttgttttagttatccaaatagtggagggtattagtattgtggaacatttatttcctgttggaggaaaactattctgtgttttttgcatttgtcttggttgtacattcatttatttcgtgttggtcattattattgcttttgtgacagttgacatcctgaaatctacaattgtggagaagctccccaatgatctggaaggaatggaatcctccatggaaaagctgtatgtccttattgacgagatctacaaatatgttgatgatgtcgtggtaagaaccttttggggcaaaattctcttatttcttatgtagtgcagtgttaaaaaggctttttccacccctatgtaggaggggcgtgtagcaccggacaataaaattgggagattcatctctgatgctgttgcttcaatgccaaaattgtcaccagctgcttttgacaagcttttcaatgacaggattcaggttagtgctttagcttgtcggtatgcgagtaaatgaatatcattttcaattttcttgtacataatcattgcaccatttggtgatgcaggataatcttgcactggtgtacctgtcaagcatcacaaggacacagattagcatagccgagaagttgaacaccgccgcccaaatcctgtaatttccatgtagttggagcatctgggagtctgacttaaaatgctgttttgtttgtttttcattcgcacgactgaaaaattgggatatgatggcagagtatgcatttttgtacttgttatctgaggcctaaagaaaagaaaccatcatgtttcagatgataatgtttgtgttggaggttgggtgcactcttggattagtatttcgatgtagtttaaatatttgtgttagcgctcttgcttgatttcctcgaggagcacttttggaaggtgcggtcaattttgttgtgccttcattttgaggcagagataaaccacccagatcatcattatatatcccggcgaatttgggctatcttttgggagtcacctgtagttaagttgtactcccactgtcctaaaacaacttaacctagaatgagatgtgattgtccagatagagtcacatcccatcctaggttgagttattttgtgacagagggagtaaatatgagatggagtttgtgaaataaggcatcattcaataacctatgaattgttgggacagaggtagtataaatatttgttctccaccaaactagaaatggagtatgctgaacacagttcagttgtatacatttcttatccactccacttccctctaaagtaccaatcaaagctcatccaaaaataacacaaaggctgtgtttaattccattcaaacttccaaaaattccatcacatcaaatgtttggagacatgcatagaacattaaatgtgaacgaaaaaaaaccaattgcacagtttgcatgtaaattgcgagacgaatcttttgagcgtaattacgccatgatttgacgatatggtgctacattaaatatttgctaatgacggattaattaggcttaataaattcgtctcgcagtttacaggtggaatctgcaatttgttttgttattattctatatttaatactttaaatgtgcgttcgtatatgtaaaaattttggaaaattttggaggaggaactaaacacgaccaaaatcccaatcaaagcactagtacttggcagtgatattttataaagattttgtaatcccatgtggttcaattaaagatagatcgtattctcaatcagcaagctcgattattggtggtgaatggcagggcgcaagcggaggtccacagaggcactcgttgtgctgcaggctgtacacgtacgtcgccgtcgaagctcgccacgcccgtcggcacctcgccgcagaggctgacgttgaacacctgcagcctgctcagcttcgtcgccgtagatgatgcatgttgtggctcacgtccacggtgaccacctgctccggcagctccaactccaactccaacgcgttgcgcgacacgtcgatggcctgcgcggccttccctcgcccgatcgaacagcgccgccggtgagctgacaggtcgatgcgcgccaagttgacggcggcgaactccgccgggatgctgatgctccgggagaggtggttgccgccctgtcgctggggtggcattgcttcgaggcggcggcgacgaggagagtggagagcatgaggaggagcatcttattcttagcaagcagcatttccatttccatggccatgggactggctatatattcatggggctagctaatctgatcgaattattgagtttggttaggaggattagcactgtcattggaaattaatttgcaaaagatcaaccaaagcacaagtgaggaggtcaaaattgaagtcaaatatagtatgctgcacctccatctgcatctgcatgcatgctgaccaaagatggactttgctttgccaccaggctggctgctcagctcaaagtatcagtatggacatacactcaaaagattgattgacactaaatttcactcatgttcatcaagaatggaccttaattattagcattagctggttgcttcttcattaatttatcctatagtttttggtattgctcagtgattattactacagtacagtagtggttacagtttcaaggtctggatcaaacatcaatggcaggcggcgagcggcgcaccgcagaggcacttgttgtgctgnaaccnnnnnnnnnnnnnnnnnnnnnnnnnnnnnnnngtgggcacctcgccgcacatcctgttgtagctgacgttgagcagctgcaggttgctcagattcgccacctgcgccgggatgccgccgcggatggcgttgtggctcacgtccaggaagctcagccgctccggcagccgcagctccgacatgtcgaagctcagcgcgttgcgcgacaggtagacgctgccgagctccttcttccccgacccgaacagcatcgacgcgtcgccggtgagctggtttcgcgacaggtcgatctgcacgaagttgacggcgccgaacgccgccgggatcctcccggacaggttgttgtgtgacagcgtcaggaacgcttgctgcccggccttgctcagcagcagccgcgggatgctcccggtgagctggttgcggctgaggtcgatggagatgagcttcgggggcttggcgaggctcgccgggatggcgccggtgagcgagttgaaggagaggtcgagagactggagcgcggtgaacttgtcgccgatgaaggaagggatggagccggagagggcggtgcgggagatggtgagctccctgagggcggtgagcgtggcgagcgcggcggggatggggccggtgacgccggggaccttgaagaacatgagctcctggaggcgggtgaggcgggcgatggcgtcgcctggtatgccgccggtgacgttgtcatcgcgtatgatggcgaggctgaggacgcggtcgccgtcggtggggtcgtagtcgtagtcgtcgccgccgcagtcgacgccgtaccagtggcagcaggcgatgtcgggcgtccaggactggaagtaggacgcgttgttgaaggccgccttcacggcgagtagcgcggcgcggtcgccggcgtcgcagcgtggccgtcgcacgggcgccgccgccgccgcaatggacaccacgaacacgagcacgtgggcgagcaggagcaggggcccgatggcgcgcaccatttcgacctccgatcgattttgtctcagcttatcttgaacgatgtgggtgtgggggtatatatatgtagacggagagggagtaatcagattggcgagttgttcagatggaaggagtttggcgccaaccgctttgaacaaaacaatcaaacgacgcattctacaatttgtgtcctcctgccccaagtgccttgttctacttctacctgcattatttgaacacaagtgcacgacaatccagcacacaagatatttagtccctgaaacaactcagcacacaagttctattactaattcatcccaaatgcttaaaaaactttttgacttctccaattctcttgtgtctatccccatatgtatcgatcgcacggtgaaatgaaacctcttggtgttgggttgggtggtcaaacaacaacacaaaacccccaaaagccactgacagtaaccggtaaacaagcgtacaatcaaatgtaaatctacacctgtaaaatcaacaatccataatcccatattaccttcgacaatacggttcatcaacagcaggactgcaaattgctgcgcatccaatagcagaacctgaaaaggatagccacagaagaaagatgacatttagtatcaccggataatcgaacaacacattacatttaattacgggcatgtatcctcttctgctagtcaaagaattcccaaagcagcactgcagcgccaacatgattattctcattaccagcatattgcaggcctgaggcctcctcgcctctgcctaataaaacactactacccttacaggattcctagtttcaaaccagcagcaaaactcaaagctgcaagcaagaatcacagaatctgcttttaattatttcgatgaacccacttattcgatcctcggtaacaacaatgctgactgctgagtgcatcgaaccagcaaggtttaagtatccaaaagagtccatagctccaagcttctgtcatcatatgaccatcaattaggtcccggtatgttacacaactgaaaaaacaaagtaaaattggatgtcatttggtacttcattcctagcaccagccaccaatgtactgaagttttcttgagttggaaacaggaacagaacagtgtattatagaatcaaagactcaggatatctaacacatatattgccatgccagacaaatgactcatagcacatacaaatcatgattaattagtagcataaatcactacgcatgccatttgatgaagacagcaatgttgaataaacagcggcagatagtaatttgatgaagatagcaatgttgaatgtaacagtggcatgtagtttcagttaacttgcagctcgctagggctgtattaaactgaaactgagttcagcaaggaaaaccttatgcttaagaactgaattcaagtctgctgtacctgcattatgaacaccattctctagcattctggaacatgcgcagccaggggctgggaccactcttctcaagctgccaatccttgggagaccatggatattgccacatcatgaagcaacgctctgggtgtggcatcatagcaagatgtcttccatcaggggagcaaagggctgcaatgccaagtggagagccattgggattgaatgggtagacttcagttatgttattagcatcgtcacagtaccgcacaggagccaggttagactttacaacactagctagaacattttcatctgggaagaaagctctcccctcaccgtgagcactccaaatgcccattgtagaaccttccattcctttgaacatgatagcaggagaggcccctatagagacactagtaaaccggcactcaaaacgaccagattcattgtgaataaatcttggctgggacatgtccccacctgaaccaagagaacctccaacgtctgatcctggtacccagccaagaagagccattagctgacaaccattgcacaccccaaggctgaaagtgtccggcctattgtagaaattctggaactgctgtatgaggggttggttaaacctgattgatgcagcccaacctttagctgaatcaagaacatctgcatagctaaaaccaccgacaaacgcaatcccacggtaatcctctagagaagacttcccagctaagaggtctgacattgtgatatcccatggttcgaatccagcagcatagaatgcagcagccatctccctatcaccattgctcccttcttcacgaaggatggcaacttttggctttgaggatgcagtcagcagtttttcatctgtaaatttgggagtgaaagacaaagaccatgatggtgatgttctgtgctttaatccttctttctcaagtctgacacaagatttcagacgttgtagcccctcaagctggaagcttgtttcctcccagatatccctgagatctgaagttttttccttaagatgcagcctgccatcaacaaccagctcaatatctggtgatgctgtaacttttccaattacattagcggaaatgcctcctgcttgaagcttttgtttcacaacactcagatctttcaaatgcacttcaagtagaaggccaagctcctcggcaaatagtgcttgaagaaggctagaatcttctgagtcaatgttcagcttaacaccgcaattaccagcaaatgccatctcaagaacactcacaataagacctccatcactaatgtcatggccagctgaaataagacgctcaccaagcaattcctgaacggcctcaaaggctttcttcaagtacaggacatcatcaatgtctgggcagtcatttccaatttgatcaaaagcctgtgcaagagcagaaccaccaagccggcgctttcctttgctgaggtcaatgtgcagcaaaactccatccttgccaagcttcaaatcaggagttaccgtcaatgttatatcaggacatgtcacataagcactgatgaccagatttccaggagccttgacgacctcaccatcacattgagctgccatggaaagactgtcctttcccccatcaattgcaataccaagttgaatcatgcagtcagccaatgcaacagcagcatcatacatatctgcaccttctccatcaagctttgcagcatacatccagttaccacttgctttgacatcagaaagtgatgaaactttagcccaaaccagattagtcaaggcttccccaatagcaagtcttgccatggccttgggattaagtaaacctttcgttggctgttctccaatggcacaggcaccacctgttagatcagtgtatgtctgtgcgatcacagccacatctgcaagaggaagttggagaggtccaactgtctgctgttgtgcaacaagacctgtcacacacctgtcaacttttgtggttaagaaacgcttagagcatacagatggaagactcaatactcgcttcagagcatccatgattgttactccacgggcaatatctaagggctcactgactacagagactcgcttgaattcaaaggtcttttggggcatatctcctagaaccttttcaagctcgagatcctcaacaggggttggaggaggaaggccatttaacttcgcatgctccacagcagcactgtcaatcaaaacaatctttccacatccattgattgtcccaatgacagccattgaaaccctttccctttcacaaagtgactctaaaaggcttctgctctcaggcttcaccagaagtgcatcttgttcctggtactcagcaccccatatctccaagacagacaatgtatgatcaccgacaacaattgatcgtatatcaatttcagcgcccttaggatagattatttccttcaccacattgcagtttcctccagcaccctggtcatgaatgctgatgatagggttgctctctcccatttccgcacatgccctgaccacacgatataatttctgtgccatttcagcatctccacgctgtactgcattgaaatcgagctctgcatcattttgtccactaaccatgctggaggcagcaccaccacccataccaattctgtatgctgggccaccaatcttcacaactagcatgccaatttctggatcccccttagatatatgtgcatggtcaatttgcccgattgccccactaaacattattggcttcagccactcgcgccgttccccattaagcaacctcgtcccaaaatttctagtaaatccctgaattagaggttcaccaaacttgttcccatagtcagaagcgccatcgctagcatcaataagaatttgcaaaggggaggccaaattcgacagatatgaaaaggatggatcctcccagggtgcatatgcaccttcaattcggagattaccaacacaatagccagcagtagaagcaacaacaaaagaaccctttccagtggcatgtgtgtcccttatgcgaccacctgcacctgtttcagctcctggataaggtgccacagcacatggaaaattatgggtttctgctgtgaataaaatatcaagctcacgcatcataacagataatggtgaagtggagcctggaactgttgggcgtagctgatttgctggatatccctttattgcacttgagttgtcattaaatccgatgactgagttattatcggggttagctttcaggggactcttcactaactgaaacaaggttctcggcatggtctctccatctatcacaagctttccattaaaaaaccaatgcctgctgtgctcactgttggattgtgcaatgtcgaaaagttcaacagtggttgggttccgtttgatgtcatctctgaagaggtgggtatagtacttgatatcttgttcatcaaaagcaagtcccatcttcacatttatttcttccagagcttctcttcccctttcaatgactggaacaatacggacaggttcaggaactacatctgaatgaaatgatgtgagcttcttaggataaacacactctgtcattctatcatgaaccaaagcagtaaagtcgttaagctggctttcatcaagtggaccatagccaggatccaagcataaaaggtatctccttgatctctccaagcgagttacttccatcaatgagagagatttacatattgagacggcattggttgagaacgctgttgaaaaagtcatccggggaccaacctcaacaatgacactataagggttcctagcgacttcctcctccagaaagctttgtgcttgtaacttatcaggttcataggtttctgctaagagccactgcagtgttgcaagcttctctgaagctaatgcattatccaattgaatgttgaagcattgttcggtctttatacccacaatattagaagaaacctttgcttgcacttgcctgagcagctcaattgtctcactgtcttgaagatatggtatacgatataattgaataactccagcttctgatgcattatcagatttgtgaaccaatgaactgtcaagtcccctggaaaccaaagcaccaggagttggcagcaatcggacattaggaactgaagctcttcgaacacctggccaacaaaggtgtctatggaagcactgctgagatcttctcagtccagaactccttgcagcaatgaaaccatttctttttccctacatagagagtagacacataagaaacacaacaatgttatggggaaaaaaaatccatccagtgttgtgcaaaggtcgcttaccagattacaaggaaagccttggaagcgtaatggattgcttactgacatttcacccggagatgccatgtttgaagaaatccaaggatcacttttgtgaagaaaaaaaaaggatgatctgcaatacatggtacaggaattagatattgactttgcatgatcccaaacttgcacttgcgatgttttttttgataaagtatagctaagctcaaataataccacgttgcttttgtccaaatttaaacactaaataatcaagaagggtgctagctatacccaattgattattcctgaaagatagtgatacaaaatctgcctttgaaattattgaaagacagagtttctatagcagatttaccacccatcaagctagaaatgagctgctatggccatacatagagcatggatagctaaaagaagatgagaaggatataggaagctaaagaaagcagtggacaatcgactgtggcgtactacaaattaactttgtacacatgaaacagtatataataaaagcagaggtagaggtgaattacttgatcgaacttgaagtctattggattcgattcttgacagcaagcaacgggagataatatataaagggggaccggggagataggaacggcggctgagcggttcgaggtgtacccgtgacgcagcgggaggtggacagaaagagtaagcggtgggagggctggcggtagcagcgcgcggaggaggtggtgggctagtgggatggcggcggcggcggcggcggcggcggtggcggcgcgggaaggggcgggcgacagcgagcgagaatgaaacgagtgacgggggtcgggggctccttccttttaatcgacggctctccatcttaaactcaagagggttctccaacaaattggcctttcccttccgctaatcgtggatgggccttgatatcctctttagatacaacagtgtttattaacgggttttctctattagcttataacaagaaataaatttggtgatgtgaaagagaaaaggaaaagaaaatatttttactacgcatgacaatgactcaaagggcgaagaaaagaaaagaaaagaaggatgataaatgttgtattaaaggaatttttgttgtacaagggtggagaaaagaaaagaagaaaaaaattattccggtgcattaatggttaaaagttcttgttatctcaaatagaatgttagtctctagtgttatgtatcaatacatacgacccataacagactctatctttgtatatgctattacatctgcccaacacaattcactaattctcgtcctgtttgtcagaatttcagatctcaaatcacgatatatttaaagtttttacgctaaattatagtgatttaactttttaaaaataaactcatctaaaatgaaaataaaatgatatattaaacgttatcaacgtaaacgtcgatctgcatccatagtttttgaacctaagaatacccagctttgacaaatcttgggatccaaatctatgccaaagatgtccatataaacgtagcttcatactcttagtatgaatcagacattatttcccgcaggcatctcaaccagggctgaaaatttcggactaaaatttccaaaatttcggtcattttgaacccctctaatacgatattatttcggctgaaaatttttagttttttgtgaattttggtaatatttgttcaaatttaactaaattttgttcaaaattttggtatatcagtgacttccgatcaaatcggttaattcgaaaaagcaaaacctgatcccaacctttaaaacatactccctccgttataaaaagaatcaaatcctatctatgaattaatctggataacactacgtctaaatttgtagctaggaattgatttatttttgaaacgaatggtgtacatactatgtgttggtggcctgagataggtactccatatcaagcacgaacaaaacattacatcacgcatgaacctgaaccgatcgaaggttcttatttatatactactcctagcttgctttgctttgctaggattattcgattactaattgcaagcagcaaattaagactgcattaattgtaggtggatgattatggtcctcatatcatataggagtatatcaatgggtgcagtgagaaagcggcgcgccgcagaggcacttgttgtgctggaagcagtaggcatcgaagctgggcatgttgccgccggtgggcaccacgccgcagagcctgttgtagctgacgttgagcagctgcatgtccgtcatgttggccatctgcgccgggatgctgccgtagatggagttgtggctcacgtccaggaaattcagctcttccggcagctgcagctgcgacatgttgaagctcagcgcgttgcgcgacaggtacgcgctgacgagctccttcttccccgacccgaacagcatcgacgcgtcgccggtgagctggttgcgcgacaggtcgatctgcacgaagttgacggcgccgaactccgccgggatcctccccgtcaggttgttgtgggacatcgtcaggaacgcttgctgcccggccttgctcagcagcagccgcgggatgctcccggtgaggcggttgcggctgaggtcgatggagttcagcttcgggggcttggcgaggctcgccgggatggcgccggtgagcgagttgaaggagagatcgaggattccgaggtcggtgaacttgtcgccgatgaaggacgggatggggccggagacggcggtgtgggagatggtgagcaccctgaggccggagatgttggcgagcgcggcggggatggggcccgtgatgcctgggaccttgaagaaggtgatgtaccggaggcgggtgaggccggcgatggcgtcgccggggatggtgccggtgatgttgtcgtcgcgtgtgatggcgaggttgatgacgcggtcgtcggaggggaggtagtcgtcgccgcagtcgacgccgtaccagtcgcagcaggggaattcgggcgtccagtactcgaaggaggcgttgttgaaggccgccttcacggccagcagagcggcgctgtcgtcggcgtggcagctcggccccgacgccgccgcactagtgcagctcaacgccgccaccgccagcaggagcaggacgacggcgcgcgccatttccatccaatataatcttaatctttcctttccttgctgagttaatttatatcctgagttggttgttggtacgtgtagtaagtatatatagtcagatggatcgagtatgcagttttggcgccaaccgctttgacttgaactcgttagtggaagactcacaactcacaagtgtgtgcgtgcttcctctcttctatctgcttgtttacttcgacgacgtcccccaggaatctcaagatgggccggattggcgcttcttcggcccaaaccgagtctactgccgccggagagaacttcaaggcccacgacctttcccgcttcagccgtctgggtctgggctggaggagcgcacttcaccctcgagtggcccagctttgcagcctggccagccactcagtgcttcagttgccgccgccatgtctgaggccgactccgccggcgacatccatccttgggaagaggcctcggcagccaagacaccgctctcgcccagctccctacacaccgccatgggcgcaacgcgtcgtgatgaaaagactcggcgtcgtcgacaacgagaacaaggttgaagagcaggacctcttgcggtacctggagctgtttaaatcacccctcgcgccgtctcatgtgcaggcacttgcggcgctgtgcagcgtggcgatccctgtctgcggggcggcctgattgctctgttttctggtggtggaagcccatgagtctctatgtcttgtagtcttttagtttggaatgttaggggcaaaaggtccctagtagctgatgttgttagaacttctagtgcgtccattttttgttgtcaagagtctaaattggctgttttggaccagcggttgcagaaccagtcttgtggtcctgtgttagactgtgcggatttcattcctgctgatggaactagagggggcctgttcacggcttggaggagtgatctcttctctgtttcttgcctgcataaaggaaggtggtcgctctctctctcagattttgtaatttggaaggcttaccaatgtctacgggccgcagtccgacggcgacaaaatcctttttctagaggagctgctggtggttggtgactttaacttgttggcctcggagggtgacaagaacaatggcaatgtgaatcgcagactgattaacaagtttagacaaactattgacgttctggagctccgtgaagtttatcagttcaggcgccggtatacttggagcagtgaacaagagcagccaaccttaaccaaaattgataaagtgttgattaatggggaatgggaggaaattttccaggatgcccatttgcaagctctcagttcgtccgcttccgaccactgccctctgcttttggcttgcgataacatgatgcaccgtccgagaaagtataagtttgagtctttctggaccaagctagatgggtttgaggaagtggtccggcaagcttgggcggctgcgccgtcgggctccaactctgtttcctccctccatctcaagttgaaatctactgccacatctcttcgttcgtggggggctaggcgaatcaacgaacttcggcagcagctcgcagtggctcatgaaattattcttcagctggacaaggcccaggacgaccggcttctctcggcagaggagcgatcgctgcgtgctaccttgaagggacgatgccttgctctcgcctccctggagcacattaggctccgtcagcgagccaggttgttattcctcaagcatagcggcacaacggcacaattttttcgccttaagatcaatgcacgtcgaagaaagaaagcaattcctaccctctgtcatgatggtgtctatgctaccactgaagaagataagctacaggctgcatacaactatttcctcaatattttggggacgcgtggagagcgaattcccagcacctacatctcgtcaacacagcttccatcatcctcctgcccaagaaagaggacccgaatcaactaactgacttttgcccaattagtttgattcacagtttcgccaagatcctgaccaaaattctagcacttcgtctcgccccgagaatggatgaattgatcgggcctgcacagtcagcctttattaggcgcagaagaatacaagagaacttcctctacgttcatggtgtagttaaaaagttgcatcggtccaaaacgcctgccatgctgttgaagattgacatcgcaaaagcttttgatacggtatcttgggaattccttttggagctgcttcgacatttgggcttcggcgctcgatggcgtgactgtgtttctgctttgcttttcacttcgtcaaccaccgtcaccatcaatggtagagacactcaaaggatcaagctagctcggggactcaggcaaggggatccactctcgccgttgcttttcgtcattgtgatggaggcatttgcggctctctgctccacggcagcgagccgtggcgtgctttccccacttgctacgggttccttgccacttcgcgcctcaatctatgcggatgatgccatcatcttcttccatccttctcggcgggacgcgctgatgatccacttcatactcaagttgatgggtgacgccaccggcttggtttccaacctagccaagagctcgttgaccctgatccattgcactgatgttcaaattgaagaggtcacagaggtgttgacatgcccaatcaagcaattgccgattgtttacttggggctgccgctttctgtgcgtaaaccgacgaaagtgcaaatccaactgatgatggataggcttgccaaaaatttggctggctggaagcccaagcttttatctccagatgcccgtctagccctgatcaagcatgtgttaatggcgctcccactctacttcatgtccgtcttggaactaccagcctgggcgatcaacgaaattgagaagaaatgctggggtttcatttggaagggtgatgaagatgctgcgggctcttgcagcttggtggcttgggagaagctttgcctctctatcgagcaggggggactagggatcagaaacctacgcctaatgggaattgcgcttcgcactcggtggatttggctgtgccgcgctgagccagagtgttcttggacgcgcattgcacctctagctgacagaaagtcactgcactgctttgccgctagtagcaaagtactgctggggaacggagcctctacctcgttttggtgcgatagcttgttgccagacggaggatcagtgcagtacagattcccaattcttttctccttcgtcaagctgagtgacatcacagtggctgccgctctctgcaacaactcctagattgcagatattaggggcggcctgtctgtccaagcgatggaggaataccttgcgctcgggtacgtgatcgccggtgacggagcgtggggctcctcaccgagagaccgcgcgggccccccttgccggttcggccgggggcgctaggtgaggttctaagcactcgatctgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcccccgttcttaagtgggcaaggtcctccttttatatctcaaggggatcccacctgcaccacttctacctactcttcttttgggtggggactcaccctatcttcccaaaaaagaaaaaactggcttgcgccttcgcctggaagctaaatcacagcttgtctttgagtgaggcccagcgtcatcactcgcctgacaccggggatctccctattactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcatagaggctctcatcattccgacgggacggggcgaggcgtgcgaaaggccgcctgttgccacctaacccgcgatctgaccggtatgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagatacccccggtcccatgtcaccgacagtagcccccggcgttatgccagggcgatcgccctcctcgaggaaagcgctcgggcgtgacgccacttcttaggcctggtgacaggtggggccggtctctacaggcgggcaggaatccagtggtcgcaaatcgcgcgcatcggcaagggaaaaaccgaccgataataatgagcggctttcttcaagaccgctacattacttgagtagcgcgcgaattgggacgagccggttcgtttcgcctggagatgtgatgatggtgcatcggtcggcgagcgtagttaacgtgcgcacgatatatgccatctcgactgccacggccgcacatccgcctcgtgcgccgcaaacgggcgagcgggattagtggaggagtgggcgcgagaaacgagggggcgagatagtgggcgcgggaagcgaggagccgggcatagcgttggtaagggtataaagacgccgaggaagagattcgtttccttcctctcgccattattccccttgccttcgccgcttgcgttctaacttctcgtttcctgtgccctaccttcgccgcactcactcgctctcaagcccctcctccgccggtgtcatggcacggggctccgcaccgctcgacggtagcgtgctgccgccttctcgcatcgtgagcgagaggcaggccgggctgccgcgccgattcatgccggaatctgccaccggccgggaggtggtcgcgctgggtgagggacgcccggcaccacactacccggggcggtccgtattcttcctttccttcgcaatggcagggctggtcccgccattctcttctttcttcatggatgttctggagctttataatctccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtttgcgatcccaggggctcacgggggccatggtgtacggcgattaccttcgtcgccggatcgcgccgctccagcggtgcgcccggggcgcctgggagttttcactcacccgtttttcgtcttctggtttttcttctgcctcagcgagatcccgtcgcgcccttcccgccattccaagtccggccggtctgaggccgaggagacggcgaccgcggaggcccggaggcggggagctgaccggcgagaagccgcagaccgcctccgggaagccgaagaagctgcccaggaggccgtccgggctcgccaggctgaggaagccgcttgggaggaggccagactccgccgggccgaggagtccgtccgggagacggaggcggcgcgcgtacgcagggcggcctgccaagtccccgacccgactccgcccgaggcaacgacgacttccgaggccgcccacgacgaggccgcgggcgcgccactcgggcccgacccctcgggcgatgcttggggcgagccagcctcggggaacgcccccgagtccggcacgtccatcggcggaccgagccgcgcggcgcccacaccgaggcggctctcccctctaccttccgctgccccactgagcgcagaacccctcttgcaggccttggccgctgcgaacaccacggtgttggacgggttaagagcccagatggaggtcctgcaggcagagcgggcggaggtcgatgcggcgtgggcgcgcgtcgaagaggggcggcgctcggtggaagccatggtggaggcgggccgcaaggcacaccgccggcacgcctcagagctcgaggcccgtcgtagggacctggcggagatcgccagggaagtggaggacgagcgggagactgccctcatcgccaccgccgtgttcaacgcggtgcgggacgacctctgcctcctatacgggagccaggcggcggagctagagaagaagctcgacgcgtcccggcagcgcgaagaggcccttgaggctcgcgccacggtgctggaggagcgcgcccgcgccctggacacgaaggagagggaactggcgggtcgcgaggccgccgtcgccatccgggaggcaacgctggcggcgcacgaggccgcctgcgccgaagaggagtccgcactccgcctccgcgaggacgagctcactgagcaggagcgagctctcgaggaggccgaggctgcggcgcagcggcgggaggagctggcgcgcctcaatctggaaggcgcccgcgccgagagggccgcactggatcagcgggccgctgaattcgaggcgcgagcgaaggagctggacgcgagagcgtgcagcggtggggcggccgcgggcgacggcgacctagccgcccgcctcgcagccgccgaacacaccatcaccgagctgcagggcgcgctggactcgtccgccggggaggtcgaagccctccgcttggcgggcgaggtagggcctggcatgcttcgggacgccgtctcccgtctagaccgtgccgggcggcaggtgggcctctggggcgggcggaccatgaaatacgccgccaaccaggggggcctcgcccagcgcctctcagagatggccgggaccctccagcggctccccgaggagctcgaggaggcgatcaagtcatcctcgagggacctcgcccggggggcggtggagctcgcactggcaagctaccaggccaggaaccctgacttctccccgtgggcagcgctggaagagttccctcccggaaccgaggatggcgcacgtgcgagggtccgggacgccgccgaccacatcgtccacagcttcgagggtacagcccctcgactcgcgttcgcgctcgactccgacgaggagggcggtgacgacggcgcggacgacagcgacgacgaggccgacggcccgggggcgtcggagtgagcccccaggcccccgccaatcttaataacttttccttcttcttccgaggccttcgggcccccttcttgtatagactgatttaatctgtaatcaagtaaagaggaaatttctgcgtcagttaagtttgttgtgtgtatgagacgaggatggtccgtgccgcggtccttctgtgtcttggcttgaacgagggctcgtgcccaggtcccaacctcaagtggcgcgggtcggggctagtgcctggggagatccgcgtgtcgagactggccaggccgggagcgtggtgaccgagggttatggatgacccgattgtgggcctttgccgattccccccccccccggagttcaccacgccccggggcacggctcggttctgggccccgtttggcgattttagccggcccgggccaccgagggcagggtcgggcacgagcgtgctaattcaagccaagattcttcaaaaggaaacgatagcatagacacaatcctcaggaaatcgaaaatgcttttactgaaatacggaagagaaaaaagataaggatatgcatgtggtagcccccggccaaccctgcacgcccgggggggcgcggggttggcccgagcccgagacctgacaaccgacccccactaggggtagaagcgacgaaggtgttcgatgttccacggattaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtgacgctgatggtagcgccgcaggctctgctggtagcgcgcggctcgaagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccaaagcaccgctggcaactcctcgatccacgagtcgccgtgcttcttgaggatgttgaaggttttggttttgaggcccttgaggatttccgcgttggcgcgctccacttggccattgcttctggggtgggcgggggaggtgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacaccttgttcccgaggaatgcacttcaggaggactccgttagccgcgcgccgatagaaggtcccttccaccagcacgtagcgcttagagatgcgctggacgcgttcactcccttcgcggtgctcgggtagagtcttatctgcgaggtacgcctggatttcagtgatccaagcaatcaatctaggggaactgggagcgctcccctcgggtcccgaggcctggactccgacgggcctcgggggccgttcaggcgcgtccgtctcccctagggggtcgggtcgcgccgacgactgggcaagcctttcttcaaaggcgcccggtggggtctgggctcgcgaggaagcgagccttgagagttcgtcggcgtccgcgttatcccgtctgggcacgtgccgaagctctatcccgtcgaaatggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgcttggcgaggtcaacgtgacccccgcaccggcgccctaaagagatagggagccgtcgaactacatcacccagtaggcggtgtgaggcagctgcgaggggcccgagctggcctcggggacggagatgggctcaggggctggggtccactccgccacaaagtcggcgagggcctggctcttgatcgcgtggcgtggttcaaagcgcaaatcgaattcagagagttcgattgcccatttcaccacccgtccagtaccctctcggttatgcaagatttggccgagggggtaagacgtgaccaccgtgacccgatgcgcctggaaataatggcgcaacttcctcgaagccatcagaatagcgtaaagcatcttctgggcctgagggtatcgggtcttggtgtcccggagggcctcactaacgaagtagacgggccgctgcacctttcggcggggccgatcctcttcgccaggggccgcatctccagggcgttcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggcctcgggccgccattcggctcgggggcctctcctgcctgctctctcccgggtcgagtcgacgcagggtggggatgcacggagtgagggttgtcctcgttgcgctccacgaccaacgccgcgctgaccccatgcggggttgccgccaggtagagtagcaacggctcatctggctccggggcgaccaggactgggggagaactgaggtacgccttcaactgagtgagggcccgctcagcctcctccgtccaggtaaacggcccggagcgtttgaggagcttaaataggggcagtgccttctctcccagcctcgatatgaaccgacttagggcggccatgcagccggtgacgcattgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacccgcattctttaacccgaaaggcattgtcgtataacaataagttcctatgggggtaatgaaagcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgctttgggaacgacgaccgggttcgccagccactcgggatggataacctctcggatgaatccggcctccagaagtcgcgccacctcctcgcggatgaagtcttgacgttccggggcctgccgccgcactttctgccggaccggccttgcgctcggccgcacggcgagacggtgctcaatcacctccctggggaccccgggcatgtccgccggtctccaggcgaagacgtcggcgtttgcccgcaggaaggagacaagcgcgtcttcctatttgccgtccagaagaccactgattcgtgtggtcttggacgggccgtcgcccagggcaacctccttgaccgggacctcgtcgcacgtgatcatccgctgcctcggggcggctgggacggaggtgctgagcctctcgttgccaccctcgggcttggacgcggcggcgaggtggtccgcgcgctgctccatacaagcaagcgcgactttgaggttgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccgaagcaccatccccggggccttgatggcgtcaaaggctgcgggggaaaggatgttgagagctgcacccccgtctatgaggacacgccccaacttcacgttgcaaacggtgggggaaaccaccatcgcgatctgtcctccccgggcaacgcacggcgggtggtcggtctggtcgaaggtgagggcaacctccgaccaccgcgtctgccgcgtcgcctcatgggtaggggccgcggccagaagctctcgcttcatggccttgaggctccgacgagaagcgtgagcgcacgctcccccatcgacggtggcgatggtggcccccaggctcctggaaccctagatcatcgtcgccatcgtcgatgtcctcggcgggggccttctgcttggcctcacttcgccggttgccggagggagccgccggggccttgccctcacggcgttcctgcctcctctcctcctcccacttcctcgtccgcttagccaaacttttgaccgcgcggcagtccgcgaggtcgtggagggaggtgttgtgcacggcgcaccacttgccggtcgggcgctccctgctgggagcgccggcctccttctttttgtcgctcgcaggcctcccctttcgggtggcccgcgaagcgccctcgacggcgaggacgtgaccctcgtcgtcggaatgggccgacctctttttcctcctcctgtcccgccgccctaaccgagcggcggatccgggggcggccgaagctgccacaccggaaccggtggagttccaggtccaggcctcctccttgcgagccacacggtccgcgagctgaaaaagctctgcggtggtctggggctccttggaggcgatcttttcgagcatgcggttgtgccgcacgccccccctgaacgcgtagattaccgcgtgtgcggggatgcatggtatggtgttgcggacttgacagaaccgctgaatgtacgagcgaagagactcatcgtcccttcgctgtaccgcatgcaagtccgcttcttcacctgggcgcgcatatgtgccttggaagttcatggtgaactgctggcacaaatcctcccaagagtggaccgacgcgggcggcaagttcattagccaaccccgcgcctgtcccttcagggccatggggaagaaattcgccacgaccctgtcgtcacccccggtggcctcgatcccggtcgtgtagacctggagaaactcggcggggttgacgcttccgtcatatttttcggtgatggtgggccggaaccttgggggccaacggacgttccgaatgctcgccacaaaggctcgacagccgacaccaccaagcgggggcacggggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcgttgacgagggaatggcgcccctcgacgacacggagccggcggtagcagcgccagaggccttggcggcggaggaccgcccaccggcgcctaggcgctgctgcgccgtcatgaccaagtcggccacgtcatccagccaacgtcgggctggagtctctggatcggggacgacgggcgggtgacgcaagagcgcgcccgcagcttggagcgtgccctggggcgtgctgccatcgccgtagacgaggaggcgacgctccccgtctcgccgtccttcttcatcgctcgtgggcggcgaagtcgcggatctttcgaccccctcgagcgcctcctcccgcctaagacttcggcgagaggggggcggtggagtacgagctcgacggcgcgggttctgctccccgtcgtcaccgctagcgctcggagagaggttgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcgggcccccctttgccggttcggccgggggcgctaggtgaggttctaagcactcgatctatggaatgtttcgtgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcccccgttcttaagtgggcaaggtcctccttttatatctcaaggggatcccacctgcaccacttctacctactcttcttttgggtggggactcaccctatcttcccaaaaaagaaaaaactagcttgcgccttcgcctggaagctaaatcacagcttgtctttgagtgaggcccagcgtcatcactcgcctgacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcatagaggctctcatcattccgacgggacggggcgaggcgtgcgaaaggccgcctgttgccacctaacccgcgatctgaccggtctatgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcctgacccctcggggagacaaagggaggggcggccacatcaccctcgggcccgacccccccgagggggtcaggccacgtgggtgactgcagctgccccaaacctctagtcaagatacccccggtcccatgtcaccgacagccgggatttctctcgactccagaagtacggactctatgatatggaaggcggcacctaatggtgacttctcggtgcggtctgcctactctattctttcggccggtagaacatcctgcccgctcggcaagattatctggaaatcccacgcaccagcaagatgcaagttcttcatgttccttgcggtccgcaatgcctatttaacagctgataacctgcagcgccgaggctggaagcttgcaccaatttgtcacctttgttctaaggatggagagtcctgccaacacatcttccaagcctgcaccttctcgcagcaagtttgggtgcaggttcaggctcgtttgaccctctactgctcgccgccgtcctcggactttgccggctggtggctcgctgcccggcaaactgttgcgaagatcgatcgcaagacgtttgacgccggggtcatcctcgttacatggttgatttggaaagagcgcaacgcacgggttttcgagggaacggcctcgtcggtcacgcagttgtgtgcgaccatgtgtgatgaatgggaaacttggaaatcagcagggctagttacctcgttgaatgttgctgcagtgccagctttagaaagattacagattttgtaatttgctttttgttgtaaaggcggtgctctgacgtactgcatttgtacagtttttccccttttccttaatatacatcggtcagcattcttcgccgtcccggcgaaaaaaaagattgaagattaattgtcccagaaacaattgaacacagctttattaatcattccttccaaatgcatcaatctgtttttgacttattaaaatcattatacaaatatatatatatatatatatatatatatatatatttatttatttattttgcttgcattgctgatgtataatttcaccacatagctagtaattaagtaatgggagcttaattgcagggagtagggagcggcggtccgcagaggcacttgttgtggaagaaggagtactgatcgaacctcgcggcgccggcgggcagctcgccgcagaggcggttgtagctgacgttgaagtcctgcaggctgctcagcccggccacctgcgccggcacgccgccgtacagcatgttgtggctgaggtccagcgagctcaccccttcctgcagccgcagcccggtcatgtcgaagctcagcgcgttgcgcgacaggtccatcacctcgaacgccacgccgccgtactcggccgggatgccgccggtgaggttgttccgcgacagcctcaggtaggcgccgccctgctgcgtggtgttgagcttgctgaagagcgccggcggcagggggccggtgaggcggttgcggctgatgtcgatgccgctgaggaaggggagggcggcgagcgacggcgggatggcgccggtgagggagttgaaggagagatcgaggagggtgaggctcttgagcccgccgaggaaggaggggacggggccggagacggcggtccaggagatgatgaggagggagaggcggttgagcttggcgatcgccggcgggatggggccggagatctgggggaggtggtgccacgtgagggtgcggaggtgggtgaggccggcgacggcgtcggggatggtgccggtgaggttggcgtcctggaagacggagaggccgacgacgcggtcggtggtgtcgtcgcaggtgacgtcgtaccattcgcagcagaggttgtcgggcgtccaggaggcgaagtggtaggggtcgccgagggccttcttgatggccagcagtgcggccttgtcgccggcgttgcactccttcttcttcgtggtggcagcggcggcgccggccgcggcgagcacaagaacgacgaccatggcgcgcatcttgttcttgtaggatatcgtattaattaggtagtagcctccactccaatttagttgggcatttcagtgagtgagctagatgatgagatgtgttatatagagagaaagggggagagggagattaatttgatggttggtattaatcaactgttgttgttgacttgttgtatgaaattatttggaaaattaatcgcaaggaagaagaatcaagttgaaaaaaaaatccaacgcatgcaatagcgagtcaacaaaaaacattgaccaccgtacccatgcaagcgtgcatgcggatgagaagggtacagctctgctcatttaatgcacatgcatgtgagtgtgaggcgccgcagacgcagtttcttgaagccgccagggagccagccaagccaaagtaggagtaggagataaaatacaaatactgtagcaagcacgggaaagccagggagaatgaaatggtcaaagttggcagtgccaaattgccaaacttgtccaaatggagagtcaacccaggcctaccacgcctgtgcagggacagagcaccttattgatctaggacaaataatattcttctgcttgcttattgatcttcttgtcccacaaatatccagttttctattcttatcttgtgcatctactcgctccatccacaaaattaagctttatcatcttcgtttctcttctatgcttaagtagagaccatgcctccaattgtcagttgcaaatgtcccgtattagagcttggctatgccaaaagtttagccgagcgtcgaagcatagaaaacagtcttaatgaaaggcatgatcatcctttgacatctgaactaatctgtcagatattagctagcttcaaaaaatataatcttttaagatagtcagagtataagacttctataaatgctcatatttctagacaaagggagtatctatggtggagatgatgcgtatggtacaaatgacagaatgatcattttcccattatctaaaatttatactatcccgtttcatattacaagacactttgattttttttccccttagtttgttaactttacataagcacacgcatgtttagtgcgattcaggcattggggggggcctagttggggcgtgcgcgccccccacgcgcgtttcgggactaaagataggaggtatagttaactaatcaattaattagttttagataattatagcttaagataatgacagtagtagttaggattttctttttttcacaagattttttaactaacaaattgaaaagaaatctatttctgaagtcaaattttcaaaattttaaatccagatttgaaaattttaactcgaaatttgaatttttttttaagtcaaattttaaaaacttttaacttttcatctcacatttgaaaaactttcaactcgagattcgaaaattttcaagtccagatttgaaaattttgaaaactttcaactcgagatttgaaaactttgagctcagatttaaaaactttcaagtccagatttgaaaattttgaaaactttcaactcgagatttgaaaactttgagctcagatttaaaaactttcaagtccagatttgaaaatttttagctcgagatttgaaaactttcaagtccaaatttgaaaatttttaagttaagatttaaaaattactagtaaactaatcagtagtaaaaataggagactaatcattactccctccgtcccacaatataaggggttttgagtttttgcttgcaacatttgaccactcgtattattcaaattttttttgcaaatataaaaaatgaaaagttgtgcttaaaatactgtggataataaagtaagtcacaaataaaataaataataatttttaaaaaaattgaataagacgagtggtcaaacgttgcaagaaaaaacttaaaatctcttatattctaggacggagggagtagtaaactaattacgattttttctcccgtgtggcagaaaaaagaaaaaaaaaaggaaaaaagaagagacggcggtgcgccaaaagaaaaagaaaaaagagagagaggcgtgcgcgcgtgcgtgcatgggccgtgtgggccggagtatgcgccggcaacgcgcgcgcggggattagcttttccgggcatcgggtaccctaggccattgtccgaagcctggcatcccatggccttgtgggctgcttttttctaccatggattgacgactatcaaggcccaacccgtaatgggctggcccaggttatggcccaatcctagctcatataattagaaatagatttgctagaaaactttcagataagatctcagtactatgtaaccaaaccattgttgaattcaagttttattaataagttatatcgtaattacattgtagttagtacaatgtaattacacttcaattatactacagatacatctgaaagtttttgaaaaaaaaaaacttgcgacagttttttaagatactcccgttagaaaacttcgtatttgctggtacaatcagttttattgtgtgttgtaaattaagttgaatgaaacacatttatagtagcaatatccactccaatgttcatctttcaagtacatctggaactataatataaaagttggctgattgattgatcatattgcaagacgacatgaacattgttctcttcacttacactcgttctccgtacattaccagttttccagtcgtagctagcacagtacaatactcttaattactagtaggatttaacaaggagttcagataattaattttaagtagcgattagatgtagtttagttgaaagtttttatataaatgtttttgtagtattatttatcgacgacggcaggcggtggcgaggggagcgccgcagaggcatttgttgtgttggtagcagtaggcgtcgaacctgggcatggcgggcaccgcgccgcacatcttgttgtagctgacgttgaacgtctgcaggttggtgaggttggccacctgcgccgggatccccccgcggatggcgttgtggctcacgtccacgtagtacgtctcctccgcgaactccacgccggacatgttgaagacgaagccgtttcgcgacaggtccacgtaccttgcccgccggaacaccgccgacgcgtcgccggtcagcgcgttccgcgacaggtccaccagcgccaggttcgccgccgccagcaggtccgccgggacgctcccggacaggttgttgtgcgacagccggaggtacacctcgtcgtcgtcgtcctgcagctgcaggttggagaagaggcccggcgggatggggccggagaggcggttgcggctgaggttgatggcggagagattggtgagggcggcgagggagggcgggatgaggccggtgagggagttgaaggagagatcgagcatggtgagggaggtgaggttggcgaggaaggaggggacggggccggagacggcggtccaggagatggtgaggtgggtgaggtcggtgagggcggcgagggagtcggggatggggccggagaggctggggaggtggtggaggaggagggtgcggaggtgggtgaggttggcgatggcgtcggggatggcgccggtgaggttggtgtcctggaagacggagagggagacgacgcggccagagtcctggtcgcagtccacgtcgtaccagtcgcagcaggaggtgttgcgcgtccacgacgccaaattgtaggggttcccgagggcgtcgtcgatggccagaagcgccgcctcgtcgtcctcatggcattgcaccttctgctgctgctcatcgtcgtccttggccatggaggcagcagacaggaggaggacggacagcagcagcagcagcaggagcttcacatccatggtcatcatcatcatcatatatattggtcgtttaattttaccagcttgagctagctgcttaatcaattgccgactgatcgagtatgtatgtatgtatgtatgtttgtgcaattggagtgaggtcgcaagagatattgagatgcatatggtgcatgcaatgccgtgtatatatagcctcgcctgggccctgctctctctctcgactgaaaagagatcttctttttcaggtgttaaaaggttattaagttgggagcacctgcactactgagacagagataaagaagctaattaagatagataattttggattaaaatattgggaaaaagcgcaggcaagtgcgcgacaaagatacatggaggcaggccaggccatgcaacgccaatgcagtagcgacattcacttactaattgctcagatatttcacccagtagtagcatttgcattgcggacctaacctcatgtgatctgaatctgactgacatggatatgcatttactagtatttcgccggcctttccatcgatggatgcttacttgcgtggacagatagttgcagacggccaattgcaacaccagtattcacgcatgcttcacggattaacagcccttctagtgagggaggaggcactgaattctcatcactcagcacaggagtcaggaatcgtaatggccaaccaactggattgttattgcctgcagcacattaattgttccaacaggggcaaatgctctccatctttctttcttctattagacacaaaaggccttatgttttgtctacagtgtaaattaaatcctagcgatacctaaaattatgtagcccatcttatcctatcaaaacaaaacaacaatcctatggacaaaaaaacatcatggtttctggtcgaccaccggaagctacggtatcaccttccaggaccactgctctctctgcctccctccaatcgccatgatcaacgataatgcttcatttcagatggtttcagaccgtatcgctgctgaatgctccttcaaatgcaaaggggaggcttcaccaccaaattatatatgctctcctttcatgacgcatagcactgaaacagaggcacgcacatccatggtttccttgtcttgtaactttgttatctactaacgagccagctttgtttaaatataccacctttcctgaagttgcgtccatgtggagatgcagaatcaccttgatttcggtagcactgaaaaacacaatgttaaaatgtttagacgactttatgcgcatggtttttttaaaaacaaaagcagctgctagaaaaaaaataatagcacaagcagttccagctcatttctcaaagggttaggcaatccaagtaaaccatagatgtccaatatccaagttgctaagcacagctaatttgataatgctgcttttgtacgagagaattcacctgcaatgcattatcggataataatccagagtatgcatctaacaaccaatcacgttttcattcaaagaagtaaatagcaaaccaaacagcaaaattgttttgagttgacataccctgtagcatacaactgagtcatctgggtacatgacaaacagcttggtgccaaggcgagctcgacatgaatcacatatgctctcgtcagttagctgcacatgccttgacctctcctctaatctggtcaaccgtgcatcaaggttcgttgcgcgtgataaattatgaactacctatcaataggcatagagcgaaagagaaaatggtaagtcaaacttcacataaaagataagaccaacctgggagcaagtttgagttcaagagaaatattaacagtgcagaggcagaatagttcctcaaacagtcacatttcaatagaagacattggctgaaaaacaggaaatgattatgtttacctgcccttgacgatgatggtgcacccgggctctcagcattcgcaaaattgtatctgatgctagctgaagaggcatatcagcagataatctctggcaaaaataattatagctcaggcttcagaattcttgttctaataaaagtagcacaaaataggatgatcataccaatagcagcgataatataaacataaaagaacacggtgggatgcccctacaccagttttctattatccatgtattctttatttctttcaaagaccaatacacagagattaacaaacaggacatctcatttaccttttgttatatatcaactcctaaagagaaggatcacagcagacctctatagaccaggatgattaaggaatatcaggaacccaaaaaggtaataaatactaaatacaacattcaggcaatgaccatttgatggttcggaatcctgttctgaaggaacaagtgcacactcattttttctgggacaacacaaattgcttttctagactcactccccatgatcataaattaccaagggctagaaacactagcccccatgttaactagcatgcacatcacaaataacaaattaatatcatcaaatagattctgatcatacttctgtaagaaagtggtacctccaacacttgtattggatccaatgattccccatggttatggagaagtcgaacggctgctgtaaacatgggtcctttcccatttttggggtccagatacaaatccaacagcctgagttcacaggaagatgtagagaatatgaactaaggaccaaggtcatgatgcatgaaattatgctagtaatactaataagtcaacatagaaaagctaaaatcaaatcaaaacatagagaatgtaccaagaatactaacaagccaccatgtaataaatactgaagtgaggtaataacatactgaatataggcatcatctcgaccaatctctgcacagtactgctcagcagcttcactatcctccagtttccttcatcataaatgaagaagaaccaacaagaaagttagggaacagaacttgtaggggtgtacaagtccagttaaacaaaacattactgctgaaatttacaagtaacaacaaaccaataaaaaataaatgcagcacaggatcttacagcgctaatatctgaagtacaatgttctcttggcccatcttcctatacaaaatagcctgccagaaggaaagagatttttatgtcaaatatgtcagatataagcgatgaggactatcaagcaagcataaatttcaatgggtaggacacaaaatgagctggcatggaacgcgagaaggaagaaataaattgtataatcaccttttccagccatagctcagattctgaaatcacatatagcacttcttctgggtcatacaaatctgacgattgcaaaaaaaattgcaacctttccctcaatagataaatgaactgcatatcagaatcaaattctttattgtttctctcttcattgttggatcccaaacggactgcgtccatggcagatctggagagggacaatgcatatgacgtgtgatagtgaggctcatcacattcctgttcctcaatcaaccattgcaaatatctgcaaaacttagcatattcagatttcataaaagctgaggaatttattcagcaagagtacaaaaggcatagaacacatagagctttcaaagaaacatgcaaatggtaactatatttgattaagaactacctaatataatacgcatatgatacagtagcttcaagtcataatatgttatttcattgagcctcattatgtttccttcgtatatatttagaatacgcttaggtcctgtttgatttataccccaattcaaccatgccaaataattggcaacaccaagaaatttgtcacccatttggtttgcaacctaaagaactgccattgccaaattatttggcatcactcttatgcccatacaaattagaacccactcattcttgccaaaatttttggcaatagacaaatcttgtcattgcccaaaaaaattggtaacactaggaatggaattgatccaaacaggccccccttggttacaactattattgtcagcatttactcgaataatctggcatggaaagacaagatcatcaatcaatcgtatcaatgttcaggtcactctacagtggtgatggatcccaagataccaagtaattagtaagaagcctgacaaactgctattagttcattgtttatgatcatgcaattgtataatgaacaaacttgcacaacgtatacccataattcactctgttactatttaacatttttttaacaaggatcattggaggatcatcatggaatcttgagttctaacttgtaatgattttgtcgattcattatatgtacctttggtgaatgccaaccttctctggatcaatggcagcaacaaccttttctgtagaataacaatcatccagaataaatgttaacgcatgttagttacacccaaaaaagtttcctagcagccctaagtagcaaacacaattttctggatgcaatataggctgatatagtgaaaatattgttagttctaaaataggagaaagagagcccatcgatccatgattacatatgcctactaccatccacactatgttatatacacattcataagtcaaaaggagaaaaaaaactggaaattgtgttgatctgccatggataagccataaaaggcacactggtatagtggtttatctaaaacaaagcaattaccaggagaaagctgtttttccctcatttcagatgttaaaattgcagttgcaagctcttgatcaatgtctgccacctaaacgcaaatagtcagtagaagtacacaaagtggaacagatcattgatcatgaagtccttagtgtgaagtaaatacccatccaagatgctccagaacaaggtcctgatcagatgatgcttgaagtatcttggaggcttcaacggcagcaatttcctcaccagacattttaccaacagaagtttcaagagagtcagtttcaggtaggattgcatgatccttccacaaaccagtgctgtaattccttgctaagatacgccagataccaagggatttggagcacattcctttactgccatataagaatgcaagcgtccgcagatgtccagagtcatccaaaagtgattctagttcctcctgcaccaccatagtatttttattgtatcttttttttaatttgaacacataagaatatcactgaactatatgtagttatgtactgttctcaaatgaagagttaatgtcgatttaagtatcgtaggtgtgtaacagtcttaaacgcttcaaggttgcagatgtttaaaggatttacataccacaacacagctattctgagatgatgcaagcttctccatgtcatcaacaagattgagagctctataaagatacatcagaagagtatcaaccccttccatctctgaagaagataaatccttctctcgggatgcacacaggtacctagtttcatatagcattcagacatcagctggatggagcagcttatttgcaattcgtaatgaataaaaaatgtcgtgaatgagcaaacctgataatatttctgattgctacttccagcagatcagctctgcttggtggatttgaaaggaaatcatcatccacaactgtgtccacacctgcctttttgagaaacaatgcctgttgaagtgttactagcccatcatcaataacttcttcaagaggctttgggggagcatgcaagccccaataacgctttcttggcacctaaaatttacaaagttcacaatcagataaaaaactgctgaatacaaaaggcagccagtcatagtggaagatgagcagtttgtcttgagaacttaatcagtatgttaggtgatgaaaactacagattccatttgacaattacaaaaatatgttgacaaattaatctagcagatcaaaacttaacagatgtgcctaccaatataagctttacgctcaaatttgaaggaaccagctcatgttgatactcaagaggaacgggttcatatatcaagaaattaataaagtcttatccattgaaaaccacattaaagagataaaagaagttgcagcattcaacatgaacttttcacatacagaagaaaaggttaagagagtatcatgagaaaggttgtgcagttagtcagctcctcgagcacattacaggataaaacataaaacaaggaatgtgttaaaacagttgtcttatttatacccagtggccagtggattttacaaggcgtattttgatttcaaagagtctacagtgttaaaccttgagcatggattttttttgtcataaaatatattctaaatagaaccaaaattgtgtgaaaacattttgaactggtatttgtaacttgtctagtttttggtcaaaatctacaacgtttgactttttaaatcaaaatatgccttatagaaatcaacgaggagatacagcattacaattaacatgtggtaatgaggcataccagatctgaccaacgattagggtcccgcatgatgaatggaaatatttctgctggttgcatagtttccgagagcaagaaatgatttacagcatcctcgaaacgcaagtcgaaaaacaacaagaatccaagttgtgcatgcacaaaggaaatcatgtcatttgagatttccccatcggcctcgaactcttgtaacaaagaaatagcttctgcataactctttcttcgtagtagtgccttgatctgttccaccgctgatactttacggtagcaaaatacctggccaagccaataaatgtgtccataagtacagtgtgtgatacaaaatcgacatgataaaatggcgctgcacatttatgagagaatccattgtcagggtttcacttgagcatacaaaatcattgtcttgtcattggaaattgtaattattgagtattactaacaaacacagaacgcagctcagtagctaagcaatccggtagagcagattggaaattttgagtcaagttgcaccgatggatgagttgacatacctacgttaccttataagccgtagcaatcacaactacgtcgctgccaattccggcatcctcgctcgctacaattagtccacctgtaccaggccttgcaaaaggaatagcctgcaaatgtgcgccgttctttcttctgtagacatctaccttggagtccccggcaacaacaacataggggtacacctccgctatacaatccggcgtggtgttaaagacgaagctgcttccaacgggatgccccgatcggtccacgacgaccccgacattgtcgacgagcagcatgacctcgtcgcccccggacaggggcttcaccctgggtggcctggaggactcagggagcgtgaatatatcgccaccttgggcgttcgtggtggagaagagcgagtagcccgaggcagtgccgacgaagacggagtccccgacccaagcgagcgccttgacgccatcgacgagggcgatgtcacgcgtccgcacctccaactcgtcggcgtcgtgtagggtgaggtcaacgaggagcagcttcttcccgacggagaccgcgagggagcaggaggggcgatcatcgtcggattcggaggcgcgggcggcgacggcggcaacgttgcggacggagccgaggcggcggacggggcgggagaggagggggtccgcgaggaggaggaggccgtcggcgaggaggaggaggcgggcgacggcggggagggggaggatggcggagacggggcgggtggggccgatggggaggaggcggaggaagtcgggggagggggaatcgagggtgaagaggaggagcttgccgccgccggtgccgaggtagaggtatggggaggagatggcggcggagcggacggtgagcggggaggaggctgggaggccggcgagggcggcggggtcgagggtggcgaagggctcgagggcggcgcgggagggtggagtgttggatcccatgggtgagctagggttgggagcagggggacgccatagatagctggggaagactagagtgatcgatctcttcgagtcgaaggaagaagacgaccaaacaactactagtctcttctctcttgtaacagtgttaactccgattagattagaccaacaagtctaacaacttagttagttggtgactttgttgttggcgagagatatacaactctttatcccgaaattcattcaaatcttcacaattttcactctaaacttctccatttagcatactatctccgtctcaaaataaataaatctattatccgtagtaataaaaaaaatacctgtgcgttgcaacgggtaaaaacattttttatcatgtacattaagctcccttgattttggaccgaatgcttccttgtttttggaccgaacgttcattccttccttccttttcagctgctaccttcactgctcggcatatctctcttcggctcagcccacaagtgaagctgtaggctcagctcaaacagtctcgtgtctggcctacctcttttcagctcaacccacaagtattgttgtaggccctgctcgaacagtctcatgtccgtaccatgacgaagtcgatcctctccatcaaatgcggtcgaatctttctcaatctccaaaattgttgagatattttgatccactcgatcctcttttttgattttttttatcaaaatcgaagtgatcctctttttcgattttttatcaaaatcgaagcaatccataaaactcaggataaaaaatgacgaactgaaaagaaaattctgaactgaaaagaaaattcaaaagaaagtagtggagaatcgatttttgcaattaattggatgaggcaaatcgacgtggcggcggcgctaggcatacatagctgggcaagagtgatcgacacaaatcaaaggaagaagaagaccttctcttctctctctgtaacagtgttaactcccatcaaaggaagagttcaccagcaagtctttgctgttggtgatagacgccactacaactccttaacccgaaatccattcaaatctccaccatttacactctaaacttctccatttagcatattcccttcgtctcttaataaacaaatctaatactatatgagtaatatttgattattttagtacactttggtctaaaatattcgatattcgtgataagattttcaaatttcaaccataaaaaatctctaaatattcagtttaaaggtatacttggcacgggtatttattatcagaaaaactgtaaaagtttaatcagattctgttccaaacattaaatatttttttaccaggatagtccatttacatttcctatcatcaatatagttacctacctatagaaaacttcaccaattaaaccatgtctaattttgagcttattcatcccgctagagatgaagaacaagaaccaataaaccaccgctaagcattatcatcaaaatagacatacccaaggaatgataaaatagaaaagatccataccataccggtatgcttgctactagtagtactttatacaagaagatggagtacattacatacatatagttataggtgccattgattgtacgctaggaaacataatctccattcatatatgctacaaaattattagtaacaaagagatgagatgaccgtaacataacaaatatgccagcattgctgcagctcaaggcgttgtcattcccattggggcagccatattccagtctctacccatcatccagccgctgctcttcatctcctctccagcttctttacagattcggtccagcatggcaaggaactccctcacactgccaaaaactctcgccatgtgcccttcgtcgccgctgctcaattcaccatggaagtactcagtcacctccttcacacaagacaggcagatgctctcttgcgcctggagcttcaggatctcctcctctgcctgcctcaggaacatgctcattgtgttgtggaaccgcctcgcgctgtccgctgaggtcaccatgctgtttagcctcaacacgtcgtggatctttccaagccctacgccgagctctgaaacatctctgctgagcttcatcatatcgatggatgaagctttcttggtattgctcagctcagccgcaagttttgacacaacctgaagaccatgttttctgtattccacatcatactgctgagtagtatttgcattcgttttgcacaccggactgtggccttcaggtttcacaatttcatggacaacaaattgcaggagagcagccttgccatcagctcctttcacatcaacgatcttcagcagagtgttgggttccatggcatgtgaattcggagatcctgtatcgatactcatcaagttgccaaagttcaaaacagcctcaaggaccttgtggaacaacctgctgtttttcagctcctggcaagctgcctgtatgaaaaacgataagaaaccctcagagatgagtaatactataaacaaggaaacagtaagtgagggtctattccgttcacagattcaaatcatttgtgtaaatattgatatgcataatacccaattgcatatgaaagttttgttttgcttctttcaacaaagggtgcaaaacaatttgtacaaaatattcaaccaagggctcaactatacctcaagagtagcatatgacattctgagctgattgacctccaaatagaagttggcaacatagagcatagcatccattctcttgaacgcaaatggaatatccagcactgcctttagaaaagcttccacagggcaaagtttggtggatagatcatctttgaaatatttcagtttaagctcttcctcattggtgaggaccatttgcatgagcattcgcaaggcttcaactcccaaaccatgtgcattacctatatccagcaaacacaaattaaaccatgtcaactcccaaacggcaggaattaacagtgcaaaccgtacccatattgtattaaggcatagcatgaaaagtgaacaaataatgttatcaggctcaataactgattagctatgatgtttgtaacaacttgaatgcagatctacgttgctgaatcaaaatacagaagcccaccacagggaaacacatagtcaccaaaaaaagtctataccaatatggcaatattggaaaaatgtggccagtactatattgataccagaggatgcaaaatactgaaaacaagtgtttttccccctttacacaaagaggaggcaactacaaagaagagatcagacgatcacaagggaacaaggaaatttcatgtgcacctatgtcaaaagggcgggttgtgaaataaactatttcagtcagctaatcaggccatgtgggacaatcacagggcaagaaacaatcactgaaccaaattgtgcaatataactggtgaaaaggcaaccaaagttgaaaggacagaggcaccatgcatcatctattcatcgttgatggtgggcataataatgcatcgcaaatatggccaatggtaacagccacccattccaaaggcccccacaataggtgaacactagtttcattcagaaagatgacaactttagacagcataattcaagagcacaacattgcgcgccaaatccaattgctaggaagaagcagccacacataccttccaagatggcttcgcgcacttgctccttggaaatacccaatgctcccaccagcattccaatgccatggcacctcggagcgcccagtaagcacacctccctcggcatcgccgccgccatggagttgttcagatataggtggatcatctcatccttcatgctgcaaattaacaggaaaagcaacaggaagccatcaaatcgaaataattcttttaaaaaaaaagttagcaagttgagatcaaaattgagtggttgcattgggggtgcatcttactgcaaagacccgggctttagcttatccgagtgcaaaggccgcgacttgcgcatgctcttctcggacggcgagtgttcctcctcctcttccgaaggaggtgcttgaggcggcatggggacgaaggggttccaggcgtgcgctgccattggctccggaggctgcggcctccgcttggggggcgatggattgggggctcggccacgcggctgcgggatggagggcgggcggagatggacagggctggagccgagcgtgggggaggaggccgacggcgaggaaggggatagcgaggaggaggaggcctcggcggcggcgggtggcgcggtgctggggtcggaggcggagctccgggatgcgaactcgccggaaggtgggccgacgcgtgggagcggcgggagagggcggagctctggcgatcccggacggagatgggaggtggtcgggggcggctgttgcggcggggcggcgagggtgccgaggtagaggaactcggtgctggggttggaggaggaggtgggcattggcggcggcttgaggcggcgtccctcctcatcgccgtctccgtcgtcatcgtggtggtggttggtggctccggaacgggatgagggcgagcgagcgtttgggtgggagtgggaatggtggcggtggcgtaggcggcggaagaggtggagggagaggagggcggagaggaggaggaggcagagggaaaggaaggagaggaggagggcctggaggacagggaagcggcggggtgggcgctgggtggggtggacgagagtggagatgttggccgggaaagtgggtaggccgccgtcgccggatggctgctgctgctgctgctgggtagggggtggcggggcggcgaagttggggaagaaagggtagttggtgaaggggtaggcgtcggggggagaggggttggcggaggaggaggggaacttgggtgtgggtgtgggaggtggtgctggcgccgccggcgggggaagtgtcggtgcgggcgttgccgatatcgaagcgggtggcggtgtaggagtgggaaggagaggcggtggcggtggcggtatgcgatggtgacggcgaggaggccggggcgcagggggcggaggtggaggggtgggcgtggtgacagtgggggtggggagaggtggaggaggaggagagtcgggagagtggagctgctgcaaggtggtttgggttggggaggaggagcggtggtgggtgttgttgttggggacggagacggcgctgcagtagggtgcaagaagaagaagcagcagcatgagattgagcaaggagaagaagaggggtggggaagacgacggcattgccattgccatcgccatggaggtaggtttgccgttgcaagtgcaaaaacaaaggatgggttttggggaggtttctctactccctcctctcctcacagagactgtgcacaagtgcagtgatgatcctggccctggccagtgtaggggggccagctaagacggtggcaggaacggcagcggcagcatctttgcttggttattggattcttggtgagtgctcctcctcctcccttcctcttgctctgcctgcgcctccgtgtcttgttgtcttgggaatacaattaaagaggtcttctttctcactggtgatggattattaccagtgggaaatgcattttattagccactagtagtagtagcacctccactcttgaaaactggtgtccttttcctgtcagtgttgtctctctttagtttaaataaaatggacaaatgaaaccgaaaatgcaacctgctgtttcttcggctacagctttatttctgaatgagcactactacggctgtgtggatctaaacttcactacttttctatcacatcaacatgtcatacacataacttttcagtcacatcatatctaatttcaaccaaaacccaaactttggatccaactaaacacagcctacatctatttttttttacaaaactcttacaaataataatatcaaccgtttaacttaaatatataaaaattatagataacctgaatgtatttacagcgtgacatgtaaatggcccaagaataatttatattaaaactaatctactaatataatagatttgctgtaagattgttttcgacatgttagcttctccacagtagcataaaaggcggagcgaaccaacaactagggcctgtttggtacagctccaactcctaaatataactctaggagttaagtctggagtggaattgtggagctgtcaaaacccagctccacagctctaatacgttttgtgagagagctctactcctagttttggtagagctgaaattgtttgactgagctccaggagggtggagctggagctggagctgtgccaaacaagcccctactctcattatcttgtggcctggtgcattggcaagccatccttgatcgtatccgtagtggttaggaaagctggtgttgccactcgacatggaagaggaggtcaagcttgtatcgttgcatacctggggctgggactatcatcgctaagagcatcaacaccaacaatagtttgtggatgccatataccttcctaaaggtgatatcactgacatcccgtgtctcagtgtggactctctagctgaaaacttagttatggtttttaggatatttagaatagtgacgatgatactctagatgctatgatattttttgagatgtcgtattgtaggtttcatgttaatgggtgttctggataacttctgtcttcgacagatcggcttcgatggctatggcctatagcggctcagttactctctaacatcaatttttgttttggtttgatgcctgttctcgacaatgatgtgtgtggaattcgatcgacgcaacgatcaaagttgattttagacattctgatttttcaatatgagaaaaacacaaagactacatacaacttataaagcattgagaagaaaataatagttatgcgtattattgtcaattatagatagtaagtcactatctttaaggtattataagttgttttattggttttaatcaagcagtgatttaaaaaaacctaagtctactgtaaactgtaactaaatggtggtagaacatatatggcctcatcagatggccagatgctttggctgatcagccatttaagcaaaataagctaaccaatatacattgaaatttagctgaattagaggcagttttggctgatcagccaaaacatttggccatccgatgaggaccatattatacacctattataacacaaatcaaacacaatatcgttttgtctaagaaaaaccatattaatgtatactctcatagtagggtatgagtattggaaatatcaaaatcacttacctattcattcattttaaaatataaaaaaattttagttagatatgatgcatattagttgcgaatctgaaaaataaagagtatgtaataaatagtggtgtgtatcaggtggt

SEQ ID NO: 79255 - DNA, 19437 bp, Oryza sativa
agggcacaaagaatattacaaaatattctcggccaatgatttttaaaggaaatttttaattccctcaataattcacttggataaattgcttaactttttatttaatttctaggaaatgcattattaaatgatttttaatcccgaacgataatcggggcgttacatacctacatgatgatgaagatgccaggacctcgaggaatcatatctctgcggagcaacatcaagcaagccgttacctgcgacaaggaaagctgcgagatgcccagacacgtgagatcacgctcgctcgagaggagatccgactggctgcatcaacagcaaccgaaggagaagtgcctgcgcccaagatatcaaagagcggagaaagcgatgccaagactaagaaaattcctcttgatccctttgatcccactaagactgctgtaataggcgccgagttagattgtaaataggaaagcacgctcatcacctttcttcaaactaataaagatatttttgcgtggaaaccatctgatatgcctggtattcctagggaggtgattgagcactctttacatgttaaggaagacgctaaacccattaagcaacaactacgccattttgcacaggataggaaagatgcgatcaaggaggaattgaccaagctgttagcagctggcttcatcaaggaagtcctacatcccgactggctggcaaacccagtcctggttcggaagaagataggacaatggcgtatgtgtgttgattacaccgacctcaacaaatcttgtcctaaagatccctttgggttacctcacattgaccaggtagttgactcaacggccagctgcgagctactcagttttttggattgctactcaagttatcatcatatctgcttaaaagagtccgactgcttgaagacctcattcatcacgccttttggggcttactgctacatcactatgccttttggattgaagaacgccggagcaacttatcaacgcatgattcaaaggtgtttttcaactcagattggtcgcaacgttgaagcttatgttgatgacatagttgtcaagaccaagcagaaggatgatttgattacagatctagaagagacctttgcaagcattcgcgccttcaggatgaagttgaatcctgaaaaatgcatcttcggagtaccatcagggaagctgcttggctttatggtgtcccgtaggggtatacaagccaacccggagaagatcaacgccatcctcaacatgaaaccgccaagttctcagaaaagatgtccaaaaactaactggatgcatggcggcgcttagccgctttgtttcacgactcggcgagcgggggatgccctttttcaagttgctaaagaaaaccgacaatttccaatggggacctaaagcccagaaagcctttgaagactttaagaaacttcgcacaactccaccggtcctggcttcaccacatccgcaagagccgctgttgttatacgtgtcagcaacgtctcaagttgtgagcatggtcctggttgttgagcgtgaagaagatggccatattcaaaaagtccagcgaccaatttacttcgttagagaggttttggccgactccaagacgagatacccctaggtacaaaagctgttatatggcgttttaatcaccgtcaggaaattatcccattacttccaaggttactcggtcacggtggtcacatcgttaacactcagagacatacttcataatcgcgaagcaaacgaacggattgcgaagtgggccctagagttgatgtctttggatctatccttcaagccacgaacatcaatcaagtctctggccttggcagattttgtcgccaaatggactgaatgccaagaagacacgcctacggagaagatggagtactggactatgcattttgacgggtcaaagaggctttcaagtactggagcaggagtcgtcctgatttccccgactggagagaggttaagctacgtattatggatacatttctttgcatcccacaatgtggcagaatatgaggcacttcttcatggattaaggattgcggtatctttagggattcggcgtctgatagtttgtggagattctcagttggtcattaatcaagtcatgaaggaatggtcctgcctcgatgacaatatggctacttatcgacaagaggtacgcaagttggaagacaagtttgacgacttggagttaacccatgttctccggcatgataatgaagcagccgacagactagccaatttcggttcaaaacaagaaacagctccttccaacgtgttcgttgagcatctttatgaaccatctgtaccaagaaaagaaacgaccgaggcggtagatactcaagaagtaaatatgattgacgccgactggagagagcccttcatcaagtttttgaccaagcaagaactccctcaagataaagacgaagccgagcggatttccaggcgtagcaaactttatgtcatgcatgagaccgagctgtataagaagagcccatcaggaattctgcaacgctgtgtttctttggaggagggaaggcaattgctaaaagatatccacttaggcatttgtgggaatcacgctggcgcacgaaccattgttggcaaggcttatcggcagggttttttctggcccatcgcaatatccgacgccgacaaaattgtgcgaacatgcgaaggttgtcaattttttgccagacaaattcatttaccagctcaggagttgcaaactatcccattgtcctggccgttcgcggtctgggggctcgatatactcggccctttcaaaaaggctaccggtcgtcacaatcacagcagacaaggctagagacagctcatctttttgtggctgtggacaagttttccaagtggattgaagccaagccagtcgtcacaatcacagcagacaaggctagagacttcttcatcaacatcgtacactggttcggagtacccaaccgaattatcacagataacggtactcaattcactggtggtgtgtttaaagatttttgtgaagactttggcatcaaaatttgctatgcctccgtagcgcatcccatgagcaatgggcaagtcgaacgcgctaatggtatggtacttcaaggaatcaaagcatgagttttcgaccgactgcgtccctacgccggcaagtgggtagatcagctgccatctgtactttggtctctgcgcactacgcccagtcgggccacggggcaatcaccgtttttcttggtttatggtgcggaagccatgctgccgagtgaggtagaattcgaatccttgcgatttcgcaacttcaaggaggagcgctacgaagaagaccgagttgatgatctcgaccgactggaggaagctcgtgaagcagccttgattcagttggcacggtatttataagggttgcgacactatcacagccgaaacgttcgatcgcgggcattcttagtcggagacatgggcttgagaaagattcaatctacacgagatcggcacaagttatctcctttatgggagggaccgttcgtaatttctgaggtcactcggcccggttcttatcgactcaagcgcgaagacggtactcacgttgacaactcttggaatattgaacatcttcgtcgtttttatgttaggcattactcatgtacattcttttcctctttgactaccaacatcaagttatctcttgaagttaccagtcgggggctactataataacaatggagtgtgatttttatcaattcaatttgcttacttgatttatcattgccctgtctgattttttgacttagttaatgaggaatgaaagttttttgaggactttcgcgggttctaggctcagcaaggtttgatgagaacttttaagaaatcaaacactaagtttaaattatcaagcacagcataaatacatcagtattgtacaaattgtgcctccagcatcacaagtcacattatacaatgtcaattagactcagttctttcatcatcagatacatcagcctttgtcggaccaagattggtatcttggaatatttctatgacatctacagcaatcttatccgcggctttctgagcatcattaataagatcaaggacatcttcttcgcttgtcccgtccgcaaagccgtcgacagtgtcaacatcgatcttcgggtacaaagacttggtcatcgccaataccatgctcgctcccatacatccagcttctttgatatttttgaaacacacattcggagcagttatcagcttgtcaaagatttcaacagcgttgaatgaactcggaccgttgttgttaaaaaacatggcttggatgagtggtgtagcagcattggcgacctcatccctagctccctcaagtttcttgatcttgttgactagaacgtcgaattgagcttgagatttgatcttgcgatctgcatataagggctatatcaacacttgcatgcgaagacaggattgattttggggtttggattataattaccttcaacatccttcagagccgagtccctcttcttggttagttcacccttatctttttccagagctttgattcgcttttctagctcagtgatcttggcagcttgtattgtagtatatctcagcagttgattgaatacggatagtagcctggagtaagttaattaagagtacgggttacctttggatgatccactaagctcagcgattcgatccctgagatcgtgttcagtcttcctggctagctctctggtttcatggagctgggctcgggttgcctccagggttccaagatgaccgaccagtttctcaagggttgcagtttttgcttcattcctgagatgaattctctgcattacaaattcacccagttcagaaagttgaccgacaggatgagttaagctataagctggagacgtacatttacgagacgagtggcttgattaagtgtctttgtgagtagagacacttcttcgtcttctttctgcttatttattacaattctttgtggctacatttcgtcatcccaccatttgactaagatgggtgggcgagagtcttcagttgattgtatccgaagaatctcttcttcatcgccaattattgggtctatgcatttgtgtaaagagtgataaggcgattgaagagaacttttttaatataaatggattcagatgatcaattaattgttatgaccttcggaggagggcgagctggcccttgtactttgtcaaaagtactggtctctgaaccaacattggtgttattaaaaggagggctgcttgtttgtctctctgtctccgggatgtctttatttggttcaacacccggctggtctccaatcggacgctcttggtgagcatcggtctcaacttctgctgactgatttccagtcgggggcactttcccagtttctacattgtcggtcgccgactggctgccagtcgggtggttttcttcagtcggctcggtttccttggcagttgtagaaccagtctccttgtcagtcgactaagggtcttttccagatggatcgatgtcagatggtttcttgaggattcgagacgtgttatattgatgctacatgttaagacaacacaggagaaatgacaagttgattcatacctggtcgattttctgatttttggtattggacgactggatgttttcttcttcgggttagcctgtcttggctgttttccagtcacctctttgctgccagctttcccaacgttgtcaccttcgtcatcgctcagaactaacttccttttccgagagcctggctggttagttggctttgggctgcttggctgagcaacagtctggatttttggtccgccactggcctggccagcttgttggcggggagagcggcgttgagcgattggaggatcagatttcattagagaaaattcctatgcatgatatttcaagttttcagccaaacattacaaaagataaaagacatcataatgaaagccagaatatgtgatgcgtaccggtggaggagggttgaaggcattatatggcaccactggcaaaaggtacgaatagctaaccacaataccggttgagaaaattttgtacatcctctccttcatgatcttgaactcaagagactctggatcttcacggttggggtcattcttgccatcgaattcgaaggcagtgcgggatctctccttaataggtgccagctggctcttaatgaaatgccgagttatttgttccccttgaagaccttgctctttaagcttcagcatgcattccaacagggtaggcacctgagaagcttcatctctcattggaagcgagttcaaggtttcttggtatgttggagggaggcaagagtactcgggaagagctggctaagggttctgcacataaaaccagtttgcatgccagcctttgtttgatgttttgaagggcatagagaaatatttctggctcagggtcccccttaactgaaaaccggctcccccaacgacgcacgacttgctcttgtttggctgaggcttcaggaagaagatgcggcggaataaggcaaaatgcgacctaatccctagaaaagcctcgtaggcatggatgaaattagcgatgtgaactatggaattggggtttaggtgatgtaagctaatcccataaaactctagaattcccctgaagaactttgaagttgggagagaaaaaccaccataaaagaaatgggagaatacaacgacctcgtgtgtatccggggtcgggaatgcttcgtcacatgccggacgccagccgatgatttccttcgctggaagaacaccatgcgccaccatctcttttaggttctcctccgttacgtcggaaggagcccactgactctcgaagctttctctttcctctgccatggatgcaatatggatgatgcgatttgatgaggaaatggctaggaatggatgggagattgatgcggaggttgcgcggaagattttcgcaggagctgtaaagcctcggcaaagtggattggtgcggatttgagaaccctagtttttgccgtcgcagttttttcactgtagcgaggagtggggaaaatggaggagaccacggcagggaagacgaagtggcgctctgttttagcgattatttcgctagggtatcggaaggtactaatgggcctgggcctgcatagtactttcagcccaactttattattgacgtggttggttgtactccttagggacttaagcatatatttttgccttggtaaaaatttctcacaacagaatagcccaatgccgcaaaaatcctttttgatgcagctagatgattctttggaatctctacaatgcggaatgaaaatgtgctcgacagaaaagtgtaatgctaattttgttggtctttttaggcaacaaagttgtttggattttattgagatggctacttttttatggccattctctcagcatgttatatgcttattttgataacgacataagtcatggcttaggctattttgacttgtcatttgtcgttttctatacaacagtcgatgaatcctttaagagttttttactcgaattattatcgcatatgttggtttatggacctttagagtgttttttcactcgggtttctttttgggcgcattatagctaaagcagtcagcagaatgcgttttagatgtcgcctgagcttaattatacagtcaccttggtgattcggttgtaaaaccactcggatggatatttcatgtgccttgactatatgtttagtttttattcaactaatcacatagtcgggggctacacctaattaggtgtatctagtcgatgcacctgattttttattttcagcccttcatggtttttaatttcagtactcgggagaccaaggcaggagaaattaaagcacttggattattgttttagagattacaagaaaagactatttcatcgactataaaggtctcaggagatactgtgaagattatggataccccatacccacacagcatgtatatccgactgggtatgggggtaccatgtataaatagaatatctttaaagggtttcgggttaaattcataaacttgtatatcaaggaagcacccgggattttagtcggttacgattgtgttttatctataactgcttattccgttaggaatatgggctgtactttataatacggactccttcctctatataagaaggggtctgggtgcctcttggggcacgatttttctcccagattatacgatcaataatacactcggcggatcaatccctagacagaagtagggtattacttcttattaagaaggcctaaacctgtataaaatttcttgtctctaaacccatccacttttccagcttgatagccaccccttttagtattgccgaaatcttgtttcgacaataagacgagtggtcaaacagtacaagcaaaaaagtctgatgccacgtcagcgaaaccagataattatactgtcgacctacattgcacggttttgtataatttagaggtgaagatttctggtttagggatgttaaataaacttgatgtaaagttaagggacgagacaggtgaacttatccgcaagattacacacatgggcccaggacaagatgaatggacatcacttctctcgggctgccaatgcggatcctcgcgaggattctcgagaagcggccatacattcttggctatgatcttagggtggacgagtacgagtattgtcaaaactgaagatgtttgtggttgttgttctgggcctctggctgctagctgttgagacgaaaaagggaaggagagaaagaaaaagagcagtagtagccatgtttccacagagttagaaaggatccactgattgcaattagtggatcctttcttttttttatcttcactaattgcatcgaaagtaaactattaaaatcacaaaagcgaaattattgggttcacgcatcaataattgcatacacacattcttctagcaaattgcactttggatcatgttttattttattgttaaagttctactttggatcatcatatacctaatttttgtttagtttggatcatcatatacctataacctaatatttacacttaattagctaactttttgttacataatggaacaccctaactctcttcactagccatatctagcatcttctttgataaaaatatgaaatgtgtataggtagggtagttcaccagatgctcgggtagttgaagtgctgatgatgtgatttggggtgatctattgtaggggatcctaatgggtgtgcgcgtgctggctgcttaactagtgcaaccacgcgacccctctccctggccccgtgcgcgattagcgcaacacatccacgctaattatggttattaacattaattaccacaattagcattattttttaaaaaatacataaataatttaaaatttgagttaaaatttttgaattttgatattaaagttctcaactagatatgaaaattttaaattttgagttgaagttttgaattttgatatgaaagttttcaattttgagatgaaaatttttaattgtgagttcaaagtttttgaaatttaaattgaaagtttttaaattgagttgaaagttttcaattttgagttaaaagttttaaagttgggatataaaaattttaaattttgaatagagtttatgaaatctattatattattaaaacagccttgaaaggaggcaccatgttcgctgtgggggctagaaattcccacattaatcggagaaaaagaaaaaaaaagaaaaagagagtccaagtagaaatacaatctaaaaatatctgaaattcggaattaaaataagcaataatgaaataagtttccatataagaacccagtacgagattaatcaaaattcaaaataaaaataaaataaaatccaaaattagaaaaaaaaaggagaatccaaatagaaatacaatctaaaaatagctgaaattcggaattaaaaataaccaatattgaaaaaagtttccatataagaacccaatacgagattaatcaaaatttgaaataaaaataaaataaaatccaaaattaaaaaagaaaaggatagtccaagtaggaatacaattttaaaatagctaaaatttggaattaaaaataaggaatattaaaagaagagtccatataagaacccaacacgagattaattaaaattaggaataaaaataaaaataaatccaaaattagaaaaaaaaataaaagaagagttcaagtaggaatacaatttaaaattagctaaaattcggaattaaaaataagcaatattgaaagaagaatccatataagaacccaatacaagattaattaaaattcagaataaaaaaataaaataatatccaaaattagaaaaattaaaagagagttcaagtaggaatacaattttgaaacaactgaaattaaaaataaaaaaattaaaagaacacaatacgatattaattaaaatttgaaaaaaaataaattctgaaattaaaaaaataaaaataagatttcaattaggaatacaatttataaataacaaaaatttgggataaaaataaagactattgaaagaaaagaccgtctaaaacacatgacgagataaattaagcaacatgcctataaaacagtagagtggtggcagttgatacgtcatataaaattcataataaaacaccaaatagatcctaatgacgattaaaaggagggacggccagcagaccatgaagcaaacgagtaaagcggttgccaggacttctagaaagtaaaaaaaaacccattgattatcatattcgatttttaaaatctcaatgcctataaaaaggagaagcagcgagcggggtgtataggagtatagttgcagagccaccaacggttgacgagacttctagaaaataaaaaataaattccaacgataattatgtttgatttttagaatcacaatgacaataaagagtaggcggcggacatgccgtagagtagcatagtggcatcattttacggaatttctaaaaagtaaaaaaaaacaatgtgttcgattttaaaatctcaatgacaataaagaaggaaggcaacgggcgagccatagagaagtacaatatcaaagccgctgacggtttggcgggacttctagaaagtaaaaatgaacccaaacgataattatgttcagtttttaaaatgtcaatgataataaagagaagagacagtggacgggccgtagatagtggacgggccgtagaggagtataatggcaacgtttaacgggacatctagaaattataaaaacgaaacccaacgtgacaataaactctaaaaactataagatctaatttttaaaggttccaaggagaatgaatagaaatagtgatagatcgtgcaagcaaataaaggaggagatgtcataaggggtagcaactggtgtgacttttaaaaactatataattagaaacacggggatgataaggtttggtctttcaaagttttaagacaatgagatagctatttaataattttaaagtaaaatcatacttaaaaaaatatatgattttgtttgggtgctagccgcacaattgcgcgggccaagaaaaaaaaagaaaaggagagtccaagtagaaatacaatttaaaaatagctgaaattcggaattaaaatcttacccattagattatagtgggtccgaattataatggtatagattgattgatattattgtatacaagatacaattatatctacataaattgaagttaagagttgtatgtctattaaaactaaaagttgtataaatccaaatacacttctacgtataaggttcctataaaaataaaatttttcagaggcatgcagccttgcggaattgaaatcaaacatgatataggatatatacgtatgtaacggactcaatatgaattattgtctgatttctgttagccaaaagaagttccgtatgaattagattatacatatgtacttctataaatcaattacgtatcacaacaatattcaagctttgatatggacggaaacagatcaacaaatattagggggacgaaagctgcagcagcaggttaagcaacgttaaaaaaagatttccataaaaaaaggaaaaaaaagatttctgtatggaaaaaaaaacaagcgctaaaaattttaggaattgctaactagcagcctccgataaaaaaaagtgcgaaaaacgggtttccgccttccgtaaaaaaaaggaaaaaaaatagtgcgaacaaaatgtccgattctaaacaaaaaaatcccatcctccgtgccccccaaaaaaacaagcgcgaaatttttttttctatccgattaaaaaaagtgtgttcccgttttccttaaaaaggaaaaaaagtagtgagaaaaaaagatttatgtccgattcttaaaaaaaatagtacgtataaaccggtcctcccgaaaaacctccgtgcccgaaaaacaaacaagcgcgaacaaaggttcccgttttccttaaaaaaagaaaaaaaatagtgagaaaaattgttaattgaagaaaaagttttcgtgaaacgttcaaaaaaaaatctgattccataaaaaccgatgcttttccaaaaattcctccaaaaaaaagaggttgataggaaaaaacaaagagtccaataaaaaatccaatacgagattagtaaaagttaggaataaaaaaataaaaaaaatcaaaattaggaaaaaaagaaaagacaagaagagttaagtagaatacaatttaaaattaaatataatcagtattgaaataagagtacatatcagaacccaatagtagatgaattaaatttggaataaaaaataaaataaaatctaaaatcaggcaaatgaaaaagagagttaaagtaggaatacaattttgaaacagcttatgaaaataaaaaataaaaataacaaaagaacacaataagaaaaataaaataaattctgaaattggtgataaaaaagtaaagaccattgaaagaaaataccatctaaaacacataacgagattaattaagtaacaggcctatataggaaccactctaataggaacagagtggtggcggttgatgggacatctaaaaactattaataaatcaccaaataaaatcctaatgatgattaaaaggaaggacgacgggcatgtcgtgaagtaatcggtcaaggcggttggcgagacttctagaaagttaaaaaataaaccccaatgaaaatcatattttattttttaaaatctcaattacaaaaaaaaaatgagaggcagcggacgggtcatataggagtacaatggcagagccgctgatggctggtgggtcttctagaaagtaaaaaaatgaattccaatgatagctatgctcgattttacaatcccaatgagaataaagagtatgcggcggacgggtcgtagaggagtatagtggcaccgtttgacgggatttctataaattataagaaaaaatgaaacccaacgagacaataaactctaaaaagtataaggtctaatttttaaaggtttgggcttctaaaaagtaaaaaaataaaccccaatgataatcatgtttgattttaaaatctcaatgacaataaagaagggcggcagcgggcgagccacagaggagtatagtgacaaagttgctgacgttttggtggaattctagaagtaaaaaaataaacctaaacgataattatgttcgatttttaaaataatactccctccatcccattttaaatgcagccatagttttccgcacctaattttgaccgtctatcttatttgacattttttaaaaaaaaaataaaaacattagtcacgagtaaagtactattcatgttttatcatctcataacaacaaaaatactaattataaaaaattcaaataagacggacgatcaaagttgggcgcgaaaacttatggttgcaattaaaatgggacggagggagtaatgataataaagagaagatgcagtggacggtcatagaggagtataatggaagcgtttgacgggacttctaaaaattacaaaattataaaattataaacacgagaatgataaggtttgttcttttaaaatcttaagacaacgagataactatttaagaaattttaagtaaaatcatgttaaaaaaatataattttatatgggtgctagccacgcaattgcgcgggccacacagctagttttaattgaaaaccttaaattatatttgaaaagtaaaaaaagcaactcaacgtgatatggctaattacccgaagaaaggaaaaaaaatcagactaatgatgttactaatctgcatctaattacgtgataatcactttttccctcgttttcctgtttctgacaacaccgctgttcgttccgctagcgacacatgcacttgtgtgccacgtgtatgcgctgaggtaaagttgcctagttcaaaataaaaagattgagtaaagaggaatctaaaataaaactttgacaataaaatagaagtgaaattgagtctgtctcttttcttttttaagcctcttttatctgcgcgagcaggcgattaaaaatgaagccaagatggtcacgtctacgagcacgcgggtcagaaaacggaagtgaggcggaaagtaaaagccgtctctttcccttcccctgacgccatctcccctattcgctacagcgatgtcgtgtcattttctgcaagtcaatcgacaagaggattatcgaagtacagatacagaagcaggcgctgctgctagaagcgaaggatataacaagcggcggccggagacgacgacggagaaatccggaagaagaggaactgccggcgctgagctgcaatcgcgcccaagaatccatctcctccggcggcaggtatggtgatttcgtcttcctcgaactcctccgtttctttttcctttttttttaaaaaaaaatcatccatttctcccctgatggagtggagtggagagctccgtttctcgtcttctcggtggatttggtcattcgggtagtgctaccgtttcttgatttatcctgcggaaatcgtgctcttccgcattgatcttataggctggtgggaggcgccgagccgcccatttgagttgaggggttgaccaatctgaggaatattctgacggcgttatataattcggacaatcgatgcacaactggggcccaaaaacaaaaaaatgttcctttcttaaacagttggttcagaatgggatttttttttctttttggtaatttttattttttgttccttcccgattaccgtgaacagtttttacaagcaatctacatgtctggtcatgaacttaacatctctaaaatatttactctattatatatatcatacactgttcaactgaattgagattgcttttttttttcttttttgtagttttatttgtttgttcccttccaagtaccatgaacaatcttgcaaattacaatccatttacatgtttggccacggcttgaaatgttaatccagtatatggagaatcatatacggctgaactgacttaaaacactgtagtgtttgacaatataaatcacactgttgaactttgttttagacttaagatactatatagtatttaacagtaacagtatgttgtactatgtatcatatatgcactgctgaactatcttaagagactgtaggtttaacagtaaaagattgccacctgtaatttcctgaaggatataagcagttaggaacatctttttttcgccgggccggcaaagaacaccggccacagttaggaacatctttgttgctgtatattcgtaatgcacccctatattcccttcttgttctgttcttattgctgttttatttgcatgtacagcttacagggtcgctgctccatctccttgaattgtactagctgtcttgtgcttaagatttgcgctcggcttcatttttggattcaagctgctgggtgtggatttttatgatgggctgtctaccaacaaagcaagtgggtcgttcaacacattccttgaatccacgggaagctgtggctcttgcggctgaaacatcttgtgagaacgtcgatctaccagatttcgttaatattgccactggaacaccctgtgagaattgaaatccatctttccataagaaagaaaaaggatttagtttgtttttggatatttttatgattctgtcttaaaatgtgtggattagcttttcttatgttagtcgttcaaaatcaaacaaaatgacaatgcactgcatatatgatgtgtattatcctgagtagaatggaactttgaaccaataacttcttttctaccacagtaccagtaacccaatggatgccagggtaggccaatttcatctaaaaaagcatgttatacattatcatggattgcgtatagttctgtaatgttacctgaaatacatatatttttccgggttttacaacaagtttcttaacatttttctattattgcagttactgtgaatgaagttgaggcattatacgatctcttcaggaaattaagtaattcaataattaaagatggtctgattcacaaggtaataagtgcttccgcataattttgattggtacaagtttttaagatatttggcatgcagcttattttgtttttcttatccaggaagaattccatcttgctctctttaggaacaagaagacaaatctcttcgttgatagggtaagacttaagagtgttaatatgttccaaattgtcattgtataggttttcttgatgattcctctgttcttcagtgctaacagtttatattaaaaataataatatttattctccatattctttttgaattaatatgtccaaatgatgtttgcagtccacattctttctacttcacaatagtatgcaagagaactgcatatcattatataaatcgtagaaaagattcccactttacattcttgtgctcattgtttttagtcatccaccatcaacactcatatgttatccttcctaaaggtgaatccatataagtggcctgaagcagtgtaatttctctcttgcgcattagagcaacatttaaaaactaacaaatagaatagattttacatgacaggcttccggtttaaaaaagggtaattttgaatgtattggcattcagtattatcagtaaatatttatgtgtttgaaaataatcgcaggtctttgatttgtttgatcaaaaaggaaatggtgtcatcgaatttgatgaatttgttcgatctcttagtgtgtttcatccagatgcacctgaggaacagaaagctggatgtaaggactcttcagtcaattgtttattcttaccaaaaacatgtcgggcataagaatatagatgtttagatttgaacatttgctttcactaattaatgttataacttcttattgcagttgcatttaagttatatgacctaagacagacagggtttattgaaaggcatgaggtaagtgttacttttctcttcttttagttccagaaaattgatttgagcaccgtttgatatactttttaatgctcagtagcacttttttttactgaatcacagtcagatatctatattgtcaggtatagatattacctagaaaattatcatcttagtgaaacaaattaacagattgggcagctacataacatgtttgtaattgcatgagagaagttatgcttgtttgtatttctaagagttgttgtgtaaactttggttctattttggtatttaatcatttctcccctcgtctatagcaatgaaatcatgctaactctgctgattttattttctctttgctattctttatttttttttgtagttaaaggagatggtgttggctcttctggatgaatcagatttgaatattacaagtgatgctgtcgagatgattgttgatagggtatgggtcctaactccctagaacaccaagtaaatatgtccttctgtattgttctaagtctttttaaaaacaaaaaaaaaacaaaaacagacatttgaccaggctgacacaaaaggcgatgagagaatagaccaggaggagtggaatgagtttgtcaaaaataatccatatgtgctgaggaatatgaccctcccatacctcaagtaagtgctatgcacaaatttactaccaccatgaatagagttgctctgctatgtagaatgtttttacttggagtcacactagcaattatactcaacaatatttcttagaacttgcactcgtcagtgccaaaacgtagaatcagacgcttgtcaatgatagcgattgggggaaaaaaaggatgataatgggcttcacaatcacaattgactatagtcatgtttttgtcatatgtattgcgcattaactaattattattggttggtgatattctttagggacctcaccatggtattcccaagttttgtgattcactcagaagtcagcgaagcagacatggttgcctaacctgaaacctggtgttgctacttgctagattgcaagtttgcaacacttctagcatgtaatgtttgttccttgcgtgcattgttgactagggaaacagccatataggagatgagttgatgcctcaaaatgtagcatcactgaccagcagatgctcactgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcatgtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggattgagtactctacgagcgacggcgcagtacagagtaggaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgctgcctgccctgcagggcaggccaggccaggccaggcgaggcgagcgagcgcgcgtgtgtttcccctcttctctccaccacacatgcttcaagcgactaggagggcatcatcccttttaaggaggtccccctctcatagaataagca

SEQ ID NO: 79256 - DNA, 67322 bp, Oryza sativa
atcttaaaaataactctctgatgcctatagattacttattcctgtcagtcctaataagagaactaaagcttttgcaacggataaaaatgttatgctgaacaaataacagtaatgatttcttaaattgatagagagttagatttcacgtttgactgccgcacattatattataaaatgacatctattggagaacatcatctagagtcaaatacaatagttttcaaatcatacaggtaaacatgacttattagaaaatttaatgctgtggcaataaaactctaaagctaaataggaaaccaattgcatctaagatttgtcaggcaaagtcagagactcgaatttcaactgttggcatgccacttgaggtggtatgaactcctaatgcggaaaaaggcatgcctaatggctttaccagagacctggtaaggtaatttccatttagattggaaaaaaaataaaaaatcgttttcttaaatcttaatctagttcaaccacccaaagagtacagtcgtattttatctcaagcttgtgggcacatacgacattgttcatgagttggtgcaagttatgtttttggaggttggtcatcagcatagcaaatgttctggttttgtactgctgcatgtccaaattttgctatgatctgtttattttcatttttccaaattgtgatatgactagtacaaagttagcacaatttattcccttccaagtctatgttgagatagaataaaactgggtagcaagatgagagttaagggataagaaagaagacaatgatatgtgatggtgggaccattgcccactggacagtcctgagccaacaaggatcctagtcggtggcacatagtaccaaaagaagggctgtttacttagagaggcttaagttaaattttcttgaagtttaagatgaaaattaaactcactcaagagttagtgaccaaaattttagttttgccaacagattatttcgataggcagagatgatctcgttgattcacatgaaaaagatttttgtaatacaacaacttctgattgttttttactaaagtgctcatataaaatgtaatagatttaccattcctttatcggatctttatctactacttaaaatgacaaattggtggtggtaattttgctatgtactccttcactttagatattccatagatggattcatgtagacttggttgatttgtttgctagaccttttgcaaaatgaatgcattatctgcacttgtggatatgtggttgctgattgatgtaacatgatttacatacacaacttagtaggcacttaggcttgagaataactatgtctgtgtttaaattgggagttacagtatatttatttgagacccactacaaaacaggaacactatgctagtcaaagttatgtgttagagatcatgttgatgttgaaataataatacttttgaacggagggagtaaaatcacataagtagcaactatcctacaaggtataaatgtttgtttcgttacactagagagatgacagaagtatagtttgcacttaattgcatatgaatgaatgatcattcacaaacctgtgacaaagcatctctccaccttcctttattgcagagacagcaagctagttcataataaacacttgcagctccaacaattcccctttgttccatgtccttaactgcttcaactgcttcatttactttcccttgttcccagtaggctcttactagaactgagcacataattaggaaaatgacatgaatctcaataccaaagaagtcaaatgaactttatctgaattgctacctttataagttattgctcttggaggtaccccacttttttgcatcttctgaaagaacttttggacaaagtcatacttcttggctttaagcatgacctaaagtaactccagtaagtatgatagaatgccatatcaaagtttagtaagaaagaacatgtctttattatgattgactgactgcgtatgcaataccacactatatacttgagattacaacccactggactacacggaggcacttaagggtatctttatgaactattaggctaaatctaccgacatttgacatgaatggaatgcacagaacaagaagacgacgatgagtgtgagctaatgcgggaaataaaggcatttagttcagagaagaggaaactttgcatcacctcttttttgcaagcttctttgacaaggaacgttggcagaaaaatggcgttacatgtagcagtacggtggatgctatgtttacggatataatcatcactggatggcatgtttgaaagagaaggaatggtacaaaaaaaatgctaagagggttaaagaggtagcgacaaactcagtctcaacactcctggctagctctttttggttttacatttcttcctagctcttctataaaataaaattaaaaactacttatattgtttatatcatggcaggagcatctcccaatatttcccaaaaagaaaaggagaatgtgatgatcagaggactacaataatatggtttcgatccccagacttctaaggcagatgcatgtaaaacaagacaggaatcataagctgatctaacctaatttccatcaggagcagacccagctaaactggacttgtgaacctcacacacgcatgctttgcaaataaatttcaccttccataaagtgttcccaaatatgtacaacacatttccaaaatacccatagaacagtaccaatcagccaaatgacaaaatggacagttaaaaagcatacctccatcgctaacccaaatgttgctcctgtaggtatcaaactattccttctcatttgctgaaacacccaaaatacccctttccactgctgtgatagaacgcatgcattaaggacctataaaaacaatggtcaaagtgaagacatgcaaaagttatacagttaaaaaaaataaaagacgtgcaaggttatgaacaagacttcttccaagagagtgcaggaaaacagaaataaaacaaaaacatcaggcgccatccttaccgagttataaatcagaacatctggctccaaggaaggatcccaatctttgcgacgcatcttcattacccttttcgaaggcttctgtctcatatactctataatcttgattagctcgtttagaaggccagctcgaccaagtgtaacagcaatactatggtatgcagccatatcagggtatatttgagcatcactctgatttaacgtaagatataatgcttataccattatgttttctcaattttaggctggaatataagagacaaatggagtaaattctaaatgggcaacaaataaattctacccgcatgatggtgaaaactcgaagtgcttcagttggcctccatgcttttccaaggattgatagtaattttgtatacacgaaccttgatatgttatattccattagtcaagcatcagtacttgagttcaatttcattagataacttgtgcttgcagcgatctgaaacctagtaaactaggatatacctgctttttcgatgcttgtagatgttctcattgtacacccactcagtaacagataaagcctgcctccaatttcctcttgcctcaagcccttccagtatttgtagcagattatcttcattatatattaggtcagcttttttcatcaatctagtaagcctccaatcacgcatacttagatcatcttcgttcagcctgacaaaaaaaacttacttatgcaatatggaacaaagacaacatttcacgcaattcaattcattgtgaacgatttaactcaataatggcattggcatttaggataatgaagagtgcaatgaagttaaatgcacataaggtgaatcctaaaccgctatctatctaaattctgccatatctcatattcttgtaaatgtgattattaaaatcataaagcaaccaccactactcgaaagcagtgaaaggccaagaacgcctgaaacagcaagagcacgaacagggagggattcttcgcttatacctcctcaccagcgactcaatcctcctctcctcatcccgaaaatccgaattccagccgacgccagcacgcccccgcctccccaccgccgcttcctcttcaccctcctctacgtcatcatcctccagtagccactcgaacttgccggccctcctcgccgcgagcatctcgcggaggccgtcgaggccctcgccttcgcctcggagggccccacgcgggggtgccgaggcgccgccgtgccacggccggcccatgagcgcgcggtactcggcgacggccgcgcggaagcgggcctcgtcgtcttcgcccaccaccgcggcgccgtcctcctccctgggcagcgcattgctggccgcctccgcggccgcggcggcggcggcggtgtccttcctggcgcggcggagggacttgagggcctccttcttgcggagcgcgtggaggattttgggggtcggggagacgcccttgcggaggaggcggcggcggagcgtctcgctcgtcggggcggggcgcggccggcggcggggactcgggatggcgctggggttgtggagttggagggagaggtggaggcgaggcagggggaaggaggggataaccatggccgcgcgaggagacgagcctctgccgaggcggcagcgggcgcttccaaagcgtcactcataaacgctggacaggaaggaagagaaatatctgaaattttaaaaaatatttaaaaatatataaacagggtaaaaagaaacttattccaaatataccgtgacctcaatagactattggctattggacaggagaggatagccattgccaagagcacatgaggcgagtcggcagtggcactttaaagtttaaagtttagagttagtgtcactaatacgtgccaaatgctcggacgggaagagaaatataggtaggaggtttatgaaaaaaaagacaaatatccttaatttgataattatagttttagccttttagtttcccagaacattttatattatttattcatgaatatgcacagaaacacatggcactacacacatactacacgttagcaaatgtgcaccttaacaaaccaccacgagaattaaggccaatggcttaccatccttactaaagtcttattaaaagatcatctgcatatgtgtaaatgtcggtattaaaatttatggtaatttggaaccataccattataattttgcaaagtttgatatatgtcatcggtatctcaatgacatgtaggacccacatgagtcaatgacatgtgtgtcaggatggcatatctcaaattttgcaaaattataatggcatggttctaattttccctaaaattttttaaactatggtgtctacaactccattgtcacactagtattgtttccccgctgcatttcatatgctcgattgtgaatctataattttatttattaaaacatacaaataattatatttaactcatctaaattcatctctttagggcagatccatgtatttacaacctaataactcaatattaataatgtattacttggcatgagtattaagttagactatacgataaaaggagatacatgagatacttggcatttttttcctgcatctgcctttttctaaggtgatggtatagttcaaggctatgttcctgaaattggagagaagtttagggaaagttggtagtttgaaaaaaaaagttgggagtttatgtgagtagaaaagttttggatgtgatgtgatgtgatggaaagttgggagtttgggggaagtttggtgtgaactaaacagggcccaattcaaaagccatagagcattcaatagagggaaaccacgtttttcaaagccttctttaatctccaattctccatcataaccttcataccatcagtgttgtgcagaattattctctcctaatctaacattggccattataaaaagggcattcacatgcttatcatgccaaagagagaagacattatatttcaaatacaggtaacaacaactacatcatcatcatgttacaagaagacattgtatccattggcatccatgagagtagattcctaagtcgatggcattgatgcccctgcttgaagagcgttggaagatggttggtggctatccatatctatccctagatttggcaaagccacataaggaaattttcataggttgattatggcgcattggcacctagttgagccgtgaaggattaattacggggtgtgtggatacatatttagctgccacaaccactcgcctctcttggctcgactctagtcataatgggcattgtcgaagggcaaaacctatcttccttattttgctatgagggaaagcacatttaccggtgtaacacacagccatagtattggtacttttctccataaatctatctcaagttcatagatctggctgatcaacaaaggcatttttcctactttagctttggtgggtctatttttttcaaacgacatatctcatcctaccaccgagtagactaactcactgcttttcttagaagatttctcaatttttttctacattcgaagctgatggtaatcaagcagtattagctatgcggacaacccctgattccctaatgaaatcattctacgagaagcttcatagatgtgttaggtgggttgtaggacagtaagggagtaagctatcaaaatgatatatgatatgttcaagttgtcttagtttttttttctttgctgttcttttctttattagttatggtaatatattaatataggtgtagaggccgaatgtaatttatcttcttgataaagtatatgtattctaaatatatacatgacatatatatatacaccttggtttgtccacctcaaccaaaataggatgtaaacaaaagtattagaagcgagtaaaacagaagatatcgtgcacgggaagtccataagaaggtcaaaagatcaatgcatatcatatggcactagtactacccaaatataatcccaagctacctcgctagatgcaggatatgagaaacaacattatgggtgtctatcttgatagggatggatatatatagaaaatgccagtttatgagtgtaactaacttaaatggagtgatattgctttaaggcttctttgaaatgcatgatttcaaaaaacacatggataaaaaaaatacagaatgttgagtatgttgaatcccattggatctataatcatatgatttctcaaaacatgtgtttacatggctcaaaggaaaatatatgatttttgagattatgtattacttagattaagattaaaagaagacagaaatggagatgttgctttggaattctcttaaaatatgggttggagctcatgtttaaagttctttagaattggggtatatgaataaattgcaaaggaattttgcaagcccaaatcccacaaaccaagcaacctccttatgatttttttttcctaagaatctaatccttcaatccaaagaaacataaatattatcataacatctttggttgtatatagaatatatgataaaatcatgaaaaccagattaaagaaaatctataaatcgtttggaggatgttatgaaaatgagattctgtggtacgaagatagtgtagcgagttatgataatttgaacgtattgtactatagggactactcgaaaacattggctacaacagcatagcctacagccatgtagcttggctatcttcaaggcaaccatccagactggctacagtagtataagtgtagcagcattgttgtacaatctaatagttgtttaagattatcatatatatatatatatatgacaatcactatttatatatatgatatctattttcagtatctacgtaagttagatctttctatgatacacgatgagccgtttgtttttgggatccttggaacttgtattgtgtgatgtccactggagtatagctgggtggggtagtaacccattcggaaaaccccactaatccagtccccaactcccaagccgcggccaagccatttttcaccgttcaccgtggattcgagttgactcgcagcgtgccgcgtccgagtccaaagccaaactgtcatccatccgcatcacctcaccggtataaaggcgcgcccctcccctcgccgccccgcgtcggatgccgccgccgcgaccgcgaccgccatggcgtaccgccggaagccgcagcctccgcagacgccgccgtccttggaccaccaccaccaccaccacaccccctccgtgggcccctcgtccccgccgcaggactccctcgccgcgcaggccatgcgcgcctccgccgcgcaccgcgacgcctcctccctctcctcggcctactcctcctcctccgcctccgcggccgccgccgccgccgcggctcgccggggccaccacgagccctccgtctccacgccttcccccgtaagcttccccgctgagactcccccccaccccttagatgtgtctgatgcgtggcccggatctggtccgctcggggcggtttgtctccccgtcctagccgcttcttgaaatccatggtggtgaatcgattagggatatcgatttagggccgcatctcttcgttttgattccagttaggttcgcgattaactaacttgtgatgcttgactacttctgtttagtggttttgccgccgcctctgctgttcttgggttgggtctccctgacatcatcggaccaaattgttgtatttcttgatttggggagcgaagattctatgtttatactgtcgcttttgttctgtgttgtagggttcttcgggttatgaatacacatccatgaagaacttgaatgaggctaagtacggattttggggggcccttgctcggaaagccaagtcttttctggacgaggatggttcaccagggcagtatgattccccggcgaggcagcagccgtcaagagatgcgccgccggttggtgtccaggtgggaactgctgtcctgacattctcttgcagttaattgaactggtagattctaatttttatttaatgcgtgtactgatcatttcttgaagagattagcagcacagtctaaacttttgacttttgctaatgatgttaacacttattctgtcatcatggtcagtacttgactacttgttcattcatgctataatctgcaccttgtaagtttgtgttgtgcttaactgccattattgtgtttaggcagtttactttcagatgttcttgtgtcaatgccaacatttttattgctattgcagtatacacgctcacaacaaccaccgtctgaaacatggaaatccgagacacctccatctcataagaggtccgaggccatagcttcctccctcaactatattggtggcacaataaaaagtgcacttgaagtaagttgctatacatcaactacttacctaatcctatttaaacgatcacgtgaaagtatatctcctttttccgttaatgttatttaagaactgttcaaataatttctattctaaaaatatcctggtagcattagcaaaccatgtgttagaagtatagcaccatggaaatacttttatctttcttcttttacctttgtctcaacttggaaaatatgaagcattttacgttgttgtctatttcatatcacaacagcactagaataatggtgatatgactggttaatttattttatgattgaggcatccttctgttatgcttttatgttatttacccatgctaacatgttttaaatcttctttccaggaaggccggacgattgtagaaaataaaacagccgacattattcatgaaacacgcaaattgaacataagaagaaaaggagctggctcaactacacaaggagaagctccacaaagatttactcaaaggaatcttccacaaaatccacttgactacgaaactcaattgaaggcatctcgcgacgtaaggtggccaatatgtgtcactagatatgttgcttagtgctacattttgcatcttggaatccacgtggtttccaaatttaatctggtggcatttttgataaacatcatttttacctgatagctgttcaagttttttttttgtgttgagcgtgatatctgtgtgattatattctttgcaaagtatttttcattaaacatagcctttcagtgcttatttcatcctgccctttattttttctctggttgacgaacagtggcatcagtttagtaatcttttgtctctcatcgccctttctgttggagtggattagtgacccatattttgcacttgcaggttgcaaatgccatggcagcaaaagcaaagctgctattacgtgagctgaagactgtgaaggccgatttagcttttgcaaaggaacgttgcgctcagcttgaagatgaaaataagattttgcgggaaagtcacgataagggtgataaccctgaagatgatgatctggttagtaatttttctttaaaacggacaagcaattatgaaaatcatcagattcttgattgctggagttatgtattaaaatgttttgggcttcttctgtgcatctaaagttttactaaataactactcttttgacttgaacacctgtagtccaactttctgaactaataataaatagctgttgagtctacaaattatagcttcacatgctcaattcaaacttatcttggaactgcctaaaaaaattatcatggattttgactcttatataatgtatgttcatcagtgtgaaatgtggccgactcatgcttatcttaccatagtttattaaaaattgcccctgaggggtctaattacattttgtattatattccgagtttttttttgtcatattagttactacctctgtcccaaaataagttcatttttcacctaccccacacataccaatacaaaagcaaaaggactagaataccctccactttaccaaatctcaatggaattgtcccccactttatctactcccaatgtatttatccctactttcacaaactccgatgcaatgatcactaaacatgaacttgttttgggacaaacaggagggggcaatgaacttattttgggatggagagataatgttgatatcttttttgtgaatggaacctgtaattttctgtgccttagagcaagtttaatagtatagcccactactaactcaaaatcatctatagccaatgtaatagtcaattcatacaatagttgcttactatactattaatacctggtcccacctgtcatacatacattacgtcttggagtccgtgctgcagctggctacagatctgtagctcgctgctcttctctctcttcttttatctctttaaaatatgtttatagctggcttatagcctgctattgtacctgctcttaccaatatgacaggagtccagggtggtacctgttaccttccgctgtggttaatcatacttttttttttaaaatttgcagatccgcctccaactagagacactattagctgagaaggcacggctcgcacatgagaattcggtgtacgctcgagagaatagattcctacgagaaattgttgagtaccaccaacttactatgcaggatgttatatatgtggatgaaggcattgaagaggtcactgaggtctaccctacacaagtattaccacctgcaccttctcgggctggttcaggccttggtcgctctgtaaccccagctactcccaagactgccagctcatcaccttcatcaacatccattgttgtaccagaaacttgtccggtcgttccagcctccccaaagtcgctttctcggacttcatctaagcaatagatcaagcccggcaccaccaaccatgctgaagattaaaaggtggttagtggtgcgatacaatccggatgccattgcaaatgtaaaaccaaagctgcgccgttgctgtgccctgtatgttagtctctgatgagttgtgtcctggaaatgtgcggacaaatgatgttcatgcctgagatgtttgtatgatccggtgtaacttacacagtatttataattttactgcatcatcgatttggtactggcaaggtgtgcatgcaattggctttgttttgcccgtgtcaatttgcactctgaaacgaacacatgttgatgcaacccttcgtgattatcttggcagtttctttggttggcgaatcgaagtggttagctttcttgtgatagaaccaattcacctgtgattaagtcttagatttgacacaggtgctcatctttacagctaattattctttgtggtgcgatagcgaggtgcccgtggtgtctccatcaattttaaggtccattgtctagtcctccgaagatgcttataagggggtacatcgttccaatcttccgaagatacttataagggggtacatcgtctcaatcttccgaagatgcttaaaagggtagtatgtgcggggagtgtgcacgtgttgtgagcgtgtgtgtttctattgtgttatataaaatagttaattcaaaatttgggtgggggttttttgaatgggggtaatggtgttgttggcttcttgccctaattttatgttgcaattgtggatttacctacttctttctttgtagggtttatgatttgccctcacgtttttaaatgaagtggatgtttaccatgttttggatggtaattaggtaggcctggaactattgaatctaccttataattcaccaacaacagtcctacattctacatacttcatacttcattgatcggtcaggattgtttcactcaaatccgacgttccagatcgtaaacttaaaacatgcacaaacttataaaatgcataaaaaaaattcattacaattcaaaatgaagcaaactcaatttctacagaatcaccatcttatactcttttgaaaagtaaaataaaatagtatacatactttacatcaaaatgcccctaaaaatattatctacaaaataattagttttagataagctaaattttggaaattcatataaaatacatttcaactcatttttgagtaaactcaagctctggagaatgaccataatatgtacttacaagttatgaaataaaaaaatatacccagagtacaataaaagcccctaaatatttatataaggaataaacaacttagggtacactttaacttgtaaaatctgtagaaaattcattcttaatccaaatggagtgaactaaatttatatagaaccagcaagaggtgaactttcccattataaaataaaatgtacaaccttctgtaacagaaacatcactaaactttaattgaagtaatagtcacttaattatgaactatgaactatgcaatttatataaaaatgcaaccaagctaaaataaaccaaaataaaacttgttagaccagagaagtgataaatccatcctccaccactaaaacttgacacacttaagttatataaggattcataggataatacatcaagtcatcaacataaaacaccctctagttcatataaggtaaagcaacaataatacaatctttaaagttatgaactaaggttagattagttaaaaagatcattttctttattcatctcaaacaaagtagaatatattctggacttaaaacgccagagccttgtacatacagaacactatgcacctacaacacgttataacttgtaaaattcataaagaattcataattactctaaaaattatgaaaccaaatgtgttaagtcttagaaaacacaccactacacctctgtgaagtcaaatctaataaaaatcaaatagcaaaaatatttcataacactactcagtaaaaactactatataccaacataacttataaaatttgtaactcccaaataaaaagggataaaatggaaattcattaacctaaattcattttagaccagaacctacccaccttgcacaagtcatgcagtttagagcattttggatttttcgcctatttcggtgtttaattgcataacgtgtaaacaagatagatattgcaataacggcgaaggaatgacttaggtgctaacattttctaggaacaaggcaagtccttcctcccctcttctttgatcacattgaaacttatgtttttggagatgaaaagtgttgtttgcaaagttgcataatatttgattaaaacgatatttgaaaacttggtaaatggtagtcatgaccttattgctgcatgatctaccttgaataattgttgttatcactgtttgtttgtaaccttaagaatggttagagtactcttcttgtgctcaaatgggtctatgcttagagaagttttatggtgtttgcattccaaaaatagtaaagatccaacgctccacaattaaaggtatcatacaaaaggtatttaagtattgctatagatacttaggcaggaagggtaaaaagataattttcttaagagataaaaaaggatataattgtcataatattagtaggaggtacattgataccgcatcagtagttcattaccatcatatgctctaattctccattgcattatttgtgataagggatgtaagatcccggtcttctgataagtgttgataaacagtcgatttgggcggagtcgcgacacaactcgatccggcttctgaacgaacacgctactgagccccgcaattgcagcaccacgtctcctctggttatcaaccatgccgaaacccggttgacctcaccgagaaggctaatccctgcatgcgtatcgaagatcacaagtaagaacaagatagattgcaaccaaattgcatatgaatgattaagcactcgaatttggggttccacataccgatctagcggtgaaaccgttcttgacagaataatctaagcaaaacccgactctaaacgatgacatctactgaataaatatgactagggacattctaggttgcgcacacccccttgggctaagcccacgacataattacaagtccaaaacccaaatcagattcagactggatgaaatacgtggcttgttttccagattcctggtagcttggtaggaattttgacgtgggaccaaaaccatatgaaagtagactccataagctttccaaaaagtactcatgggccctggaattccttctatatcagcagctaggtccgtttgaaattgatgctgtcaggaggcccgaatccgaatccaaaacgtgtagaactttatctcttgtcttctatggaccaaaagtgacgcggtaagatggaagtgggcttggagaaggtcttggtttgttctccaatcaatttctttgatcatccatgaattcgttagctcggtctcttttccttcgcccaagcaagtacctctgcaaacaaaaacacacgaaacttattgtgtagcaccgtttgttcaaatatataacatgtaaatctaatatagaacatatgcaactttggttgattagtacataaggtggtcatggttatatccgagctagttgtgtcctcatcatcctccccttcttgattggaaaccgtccttggtttcaccttgtcatagagcgtattaaacttatttttatttatcacaacatctggtgaggaacatttcttgatgaccatatggttggatcctaaaatctttgtagtcgaaaactacaacactccccttcttgcaaaccaatctataactcatttaaacaactagaggaactagatagagaattacttatacgcatgcggtcctctagaccacatttcatcatgaaaaggaagtatagtcaaatttgaacaaatatatacttgatgcacattatattgtcatttactatcataattgtcaataatatgaaaaatcacatcagaagggcatggcaattcaaatctagcaaataatttcttctctaaatagttgagtggataaagatcatcaaattgaatatgaccccaagtatttaaagaagatagcaatttaagctcttcattttcgctagcaatgtgaatacatgtttaaactcaacacatagtggttctactataaaattaacatgttcattcactagttgtggcatggatataagtgaagcatcgcacaaatcttctttatcactagaaacatcaggcaaattgttttgtgacaaaggtatttcaacaattgtttccactatgggttgctctaacgtagcataagtagtggacatagttggcacatcataactatgcataccttgagtagttgcagcaccattatcattaccttttttcttaggacatgactagatagctactggtagctggtttgtcttatccagctaccactccatcaagtataaatacaatagtgtgtgtctttttttaacatctttaataacttatatcttttaaatcacatattgttcttaaaatctatttgcaccattgtgctccactcaaaatatgcgataaaacaagacccatattgaatatatttaaacattttattaatttaaaagtaatttattatatgtagaagtaggaagtaacttttacatcttatacatgattaattctcattagttactccatcaatattatttacaatccatcaatggttttatcttcttttctcatactacatgaaaaacaaaagtgaaagggaaaaaacaatcaatgtttaaaacagatttacagatttatagaaagttacttcgaattaatatcgaagttacttttaaaagttgttaaacttacttgtgctaattaaatttaatttctatctcctacaacgaatttacttctaatgttgtgacaatgttactttctttttgttttaagttacttttataatttatctaaattagttttagactttactaaatttgcttttatatgtctaagaagtaatttagtgaaatctaatagtaatttagatatattataaaagtaatttataatttttcattaaaatataatcatgtgagatcttgttataaagatttaattgttacgaacacaacggtgtaatcggatcatagatcggatgagtagtttaagagaaaattttatttgaagcataggatgaatagtatatatttgaagcataggggagaaacttctctctctggcgtagcagagtgcgtcatgtggcttaagattcggactattctggccttcttggcaatgtcggcatgtggaacggacgactataccagcgtgcgtgggatcggacggctctagatgcgttgcgtgataagaccagatcgagaggcctttcgagatagattttacgtttttcttatctttagaaattataggcgcttggtcaattgaacattcttcaagcatgcatggagctatagataggtctttttgctcttcgtctttattctcttcctcctcatcgtcttcaacgtcggaggtgctgatgtagccatcttccgtagcaacgtatgcccgttgactagggcaaaccttctgcacatggccaaatccatggcagtggtggcactgaatcttgggcgtgcgtcccgtcgaaatgacagatgaggcactcttggtggatacctgcgaagaacctttacctaaaactgcaggtcgtgggggaggtggttttagcgctacagaaactccggacgtaactggtcgcttgctcgttggtgggggtgcccaaaaagagatgggcttggaaagcctcgaagatggcttcgcccgtggcgtgtacgtgctcgccttgttcttgatctgttgatcacgcccctgcaattccttctctgcaagcattgaaaactgaaacaactagttgacagtgttaaattccttattatctactatgtcccgaatatcgcacctcaatcccatgtaaaagtgacaaatagaatcctcggttccctctactatgctacatcgtatctatcccttttgtagctcaccatagtaatcctgtacatatttattcccttgttctaaatacatctgtttcttgtgtaaatctatatgatatgatggaggaacaaatttatcacgcatagctaccttaagttcttcccaagtagtaggcaaagcaccctctgcagctaacccagtcccccaaaggaaaaagtacgaaatacccccccgaactatagcggttgtctgaaataccccctaaagtcgaaaaccggacataattcaccctcaactatcaaaaccggttacttaacctcctaaggcagaattaggggtggttttgaccggtcttcgtacacgtggcagtacagcgtggcaaggggacgacacgttagcacggggtcactatataacagcggagcgctctctctctctctctcgcaaaatttcccctttctccccgaaaccctagaacgggcggcgattccggcgacttcggcgaggctgggtgcggcggggctaggcggcgctctaggcgggtgggggtagcgcgctccaaggcggccacggcgtcgaggccggcgagctccactgcgaccacagcggcgcattgcaaggcggctgggatgaactaggctggaagaaaccgggcatttgaggtatgtgatttagctcgatttgaagtgtggattttttggtgaagtagttggagtgtgggatggattgatatttttttgagcagttcttgctagatattagtcagatgcgttgggattgttattatagtgcagaaaggtggagtaagtgggaatatgggggaggttgatttttgtgttgggattgttaggtcctgcatgcatagggattgattttgttgattttatagtaaaggtggaagtatggtggttgttttttaactgtcaatcttagggcacagatgcattgggattgattttttagtcttaactttttttaggacaattttaccatcactgcaatggatcgtctagagtatttatctgttagatttcactttggcggtgaattcattaacaattggagggaaacattttatgttggtggatctgagggtatgtcttacattgaacgtgacaaaatatccttgcctgagttaattgggtatctgaaagatcactgcgaagtgctccctggtatgcttttgcactggctttttcctgggaaagaactggcagatgggctgagggtgttggttgatgacaaggtctgtgactatatgtcaaagtgtgttgtggatggaggagtggctgaaatatatgtagaggcagtagtgggaggggagtccaatgagtctggtagcagtgatgacagtgactttgaagatgaattggaggacatgtctcttgctgatgatgaatgggatgatttaaatgatgatgctgtgtttgaattacctactgggaagcctattctgttattcagtcaacaccagagaagacaaaaagtgatttagatagattgagagcttggagtaccccaagcccaaaggataaggggaaagctgtggtactatgtgaagagagggtgaagagtgcagacttgtctggttctgacaatgattacgttggtggggactcttgttcatcaggagaagatcaagaggttgaggaaattaggaaggcatacaaggagtttaagaagaagctaaaggatggtgaggtaggaaatttagatgatgtgatctatatggggtcttcaagacagattaatgatggagccttggttcagattcagggtgaggaagataatagcccatatgagaacagcagtgcagatggtgattcatatgaagaggatagtgatggacagttggtcagaaagaagtccaaataccccatatttaatgccaaccagccccatgttaggcttgctcttgggatgaaatttgatgggaaaaaagagtttaaggaggcagtggtccagctagccttgcagaacaaaagattcataaggttccccaaagatgaaggttacaggacaagggcaaagtgtgactgggcaacctgtccatggagttttttgctatcaaggaacagcaggacaaatagctggcaaatagcaagtcttgttgatgagcacaattgtcctccaaggaaggataacaacctggtcacatacaagagaattgctcagaaatatgagaagacgatcatagataacccaacttggagtattcagagcatgcagtcaactgtctctgagcaaatgtttgcaaatgtcagtgcatcttagtgcaagagagcaaaagcatatgtcctgaagaagatatatgagtctagaagggatgaatactccagaatttttgactatcaattggaattgttgaggagtaatcctgggagtatagttgttgtcaagcttgatactgaccagccaagcccagtgttcaaaaggatatatgtttgcctagctgcttgtaagaatgggttcctattgggatgtagaaaggttgttggtttggatggctgctttttcaaaggttcaaacaatggggagctattatgtgctgttggcagagatgccaacaactctatgtacccaattgcatgggctgtggtataaaaggaaacaaatgactcatgggattggttctgtgatttgctatgcaaggacttgggatttggtgaaggtgatggctgggtgtttatttcagaccagcagaaggtatactcttctaacatattttgttcagtgttatttactgtatttcttgatgtgttgttgttattaaatggcttctatgtggttgattgcagggaattgtaaatgcagttcagcactgggctccaagtgctgagcacagaaattgtgcaaggcatatttatgccaactggaagaagaaattcagcaagaaggagtggcagaagaagttttggaggtgtgccaaagctccaaatgtcatgctattcaacctagcaaaggcaagactggcacaagagactgttgaaggtgcaagggctatcatgaacacagatcctagccactggagcagggcttggttcaggtttggctcaaactatgattctgtagacaataatatttgtgagactttcaacaagtggatagttcaggctaggttcctacccattattagcatgttggaagctattagaaggaaggtgatggttaggatacatgagaaaataaccttgatggacaagtggctaggatcaatttgtccaaacatacataagaaacttaatgcatacatcatcgattcaggaaactgtcatgcaatctgcaatgggatggacaagtttgaagttaagcatcagaatcataggttcactgttgatcttgagaggaaaacttgttcatgcagaatttattccttcaaaaagacctacagctgttgtttggaacctgttgagggaatggaaagctggcctacatctgataggccaaggccaaaggctccaggttatgttagaatgccaggaaggccttccaagaaggaaatgagaagagagctacatgaaaagcccaaagcaacaagggtgtcaagggtagggtcagtgatgacttgcaggttgtgcaaactccttgggcacaacaaggcttcatgtcacaagaggagacagcaacagcagggcaatgtgcaggtactaacttgttcatgcagattttgcttaaatttattactagcacagcatcataactgatattttctctcaaccttacaggctcaaggatctcagccaagctctacacaggatcaggcacatgttgcagccaaggtaataatggcttgcttcctgtttgcacttgcttcagtcctatgtctaactgctaccacttgctgttgcagcatatggcaaatgcttcatcatctcgaaagaggcagctgaaagcttcaacatctgcaagggcagctggaatggttggggttgagcagccaagaaagaagttggaagttaggagatctcctcggctaaacagaggatgaataggatattaggttcataaaacgtttggacatgcttactggattagcaataggcagaagatcaccaccttttgtagagtaacatgtggtatgaaacttctgtaatgtgatagctgtggcatctaataggccatcttttgtgtaataactgaaggaattacagtgctctaaagtttgaagcaacctgtgacatttactgccaccactcttgtttacttgctgatgtaatcagatacaatgggttccagatgtggcaatatatgtcattatttatcatcacttttgctgtttccattatctccaactgccataacatgccttgattcccagtcacccaatatggctggtccatttgccagcacaggtcatcaaatcacctgatttttaactgtcatctcaaacaaaaccacaattttgcattcattccaatttgcaattacaaattctagtagaacagctgacaacacaacaattccattcattccagtacccattacagattataatagaacacctgacattttcttaactccacactgaccacatgaaccctaactttcatcacaacctacaattttagatacatagttccaaccaagagaacaacaacagctactaaaacatacaccaacatcatgatacatgtctgttgtttgttaatcctatcaactaaaacacaatttgcagcttccatcttctctacagcagctctcagaccctgaacctcattgctttctttcttgggggtagactgcaagttgtgctgggctactgtcctgtcccgaagtgcagcctccaggccattcacttgctcacgtgcagaccacacagcattcctcaaatcaagcaacagctgcttcatatatggttctgccttatcatcacaccactcccaaaatccgcagcccccagacttcacaaaaaaaggggaagtgaaagagtcaatcccttgaaaacaaatctaaaatgcaaaatcaatttaaaaggcacaaaatttaactcacacgcgcattgtagcatgtaaaatatctcctcccggggttatggggactccaagaaatccaccgagctgccttcactttacaatcacagaacacgggaggctcataatcaagaggcccctccctgtatggcaccggcggctgacgccttcctcgctcaccacctccagcccaagaagacgatggcgagccacgcgatgtacctgagctcggcatgccgtggtcgcagtggagctcgccggcctggacgccatggctgccttggagtgcgccgcccccgcctgcctagagtgccgcccagccccgccgcacccagcctcgccggagtcgccggaatcgccgcccgttttagggtttcggggagaaaggggaaattttgcgagagagagggagagagagagagagcgctccgttgttatatagtgaccccgtgctgacgggctgtccccttgccacgctgtactgccacgtgtatgaagaccggtcaaaaccgcccctaattctgccttagggggttaagtaaccggttttgatagttgagggtgaattatgtccggtttcgactttaggggggtatttcagacgaccgctatagttcggggggggtatttcgtactttttcctccaccaaatgatagcaaaatctttgaactccctactggcttgtcgaactctatattgctcaggcacaaggtgggcactaaacttctgctctattgccatctcccaatcaagatatttctcagcatcataataaccagaaaaagatggcattttaaacttaaccttagcataaggatcatcgggcacactattattgttaccttgttggtgttgctgattttgagcaccacccattcttgtcattgcaaacataaaaacagcaacaaacagtgacggttatccctaataatctgctacgctgtgtagtggtgcctctcaacagttcagccaaatggagcaccttaccaagctcttacaagtgtcttactagcaatgctaaggacaccttaccaagctcttacaattgtcttactagcaatgctaaggacagtacaaccggtggctggtttgtgacaccttgaaggacgtgatgtggcgattgcaaggatcaaagtggtgctgaccagaagtatatatgtggagcttgggaggcacaatatatagtagcaagaaacgcagttgtgctaatcagaaaatgcaaagttgaataatagttcaaagtactagtcaatgtgctggcctagcctagactcaactctagctcaagcaagcacccgacaacactaaggactagatatgaatcaatgcataactctgcactctgaaaacatactcaaaggatgaatgattttttttctttcttggtgcggctttttttaagcacctttctgcctttttttttctttttttaggtgaggctttttctttctttttctttgcacctttctgccttttctttttttctttatttttttactattttttggcaacaagatctagccactggcctcgaacagggactcaaatgtaaaatatagatattacagggactgaaacgcaaagtgcaaaattaaaattagatcacctttaaaatggaatgctcacattatataggttccgttttataaaaatatctcaagtccgctgaagatttttccttaaccagtgtaccaaatagaatgatctagaaggagagaagtcggatggatgggtgttcggcctgaacccaccatggtggattcggccacggcagactagaggagggagcccaactatgatggagaaaaacgataccaatctactaacagaaaccaatctatctcctcctgttcttcctcacgtgaacaagacacacacggtacggtacatgaaaccctaccccttcatgcaatcatgcaacttcacaaccgaccaacgaaaacttatgaaaactataaaaacggaaaccctgtgatgagtagattcgatttttcaagctcccggcaacaactgacgagatgcaaaactggaccccaaactgacgtagaactcacatacttgagtgatgaaccctagacctaagtgatgaacatatgcaatactcaaaacaaaaaattaaatctaaaactaaaccaacactcgacacgacgatgcaatctaaaattcaacatagcaaaatctaatagaacaatgcaacggctcaaattgtctaggtaaagaacaaatatttttgtgtggcaattttctggttatgggaagataatttacctaacgggcaaccacgctctgataccaactgatgagggatgtaaggtcccgatcttccgataggtattgataaacagtcgattcgggcggagtcgcgacaatactcgatctggcttctgaacgaacacgttactgagccccgcaatcgcagcaccacgtctcctttggttatcaaccatgccgaaacccggttgacctcgccaggaagactaatccctgcatgcgaatcgaagaacacaagcaagaataagatagattgcaaccaaattgcatatgaatgattaagcactcgaatttggggttccacgtaccgatctagcagtgaaactgttcttgacagaataatctaagcaaaacctgactctaaacgatgacagctactgaataaatatgactagggacatcctaggattgcgcacacccccttgggctaagcccacgacacaattacaaggccaaaatccaaatcagattcggactggatgagatacgtggcttgttttccagattcctggcagctcggtaggaattttgacgtgagaccaagaccatctaaaagtagactccataatctttctaacaagtactcatgggccctggaattctttctagatcagcagctaggtccgtttgaagttgatgttgtcaggaggcccgaatctgaatccaaaacgtgtagaactttatctcttgtcttctatggaccaaaagtgacgtggtaagatggaagtggacttggagaaggttggtctaaaatcaacttctttgatcatccatgaatttgttacgctcgatctcttttgcttcacccaagcaagtacctctgcaaacaaaaacacatgaaactcattgtgtagcaacgttgttcaaatatataacatgtaaatctaatgtagaacatatgtacctttggttgattaatacataaggttgtcatggttatatccgagctagttgtgtcctcatcaatttgcgtgctttttttgtgatttacatattgtttctaagaacatggtcgattaaaatatcagcaaattattgtgtggtttcatgaactttgcagttagttaaggtatccaatcggagatatttacgaactaagtaaataaacaatcaaccatgtaaaaaggtagtgagatcttatccatgcgtttgagcctataggcgtcaaatagatcttttgcctccaattcaatcactcgaccatggcggcttttctccctttatctctttctaatgcaatagtttaaaccctagaataattgaatgaggagaaaaaagtggatcttgatatttttccctaacgaggagaaaaaagcggatcttgatatttttccatagcgatgatcatattatcgtatagatgggaaatgtaccgattcaactaagaaaggtattcacataaaacaaaattgcctctaatttattagttaattactccaatgccatcggttacactaattttattccgtaccttgcccctttcttaatcaacggttcatattgctccacctcttactacctctacgtacctcgcaaaaaccgtaaaacatctcataagcttataagtatgcccattgcttagccattgaagcatctaggcccccgttgttagttttggtaattaatgaaagcgctaattgtggactaaccattcctctttgagttatatattttgtgttagtgccacgtgatatgtgagcatggaggattaccgaaggactaaaatttgatggcgcaaagcaaaggatagatgatggtaaactagtggttgaattctaaattgatcaaggtgttgggcaatcaaaattgtgctagtttaattatagctttgccatactattaatggggggtaatgacctagcaaagagatgattaaattgccaccctaggtcatttgcatttagacttgtgctctttttaataactcaaatcttgctatctttgggctgtctgaccagggccggtctgactgtgggctgttggccagtccgaccggtgggtagcggccggtctgaccgccggctatatgccggtctgaccagcccccctggtggctgggatggtgtgctctaggatcgccgatcaagagccgccagagccgaggtcggtcagaccgagctgatggcggtttgaccgagccaaggtcggtctgaccggccaccccatggcggtctgactggccgggccaatggggcccaaacggctagaaaactagttgttgtagagtagcatggtctgaccggccacacacctccggtcagaccggcagtacactgagttgggtgatttcgcccccaacggctggttttggtgggtgggagtataaatactcccccaccagcagcaaggggactctcttggcactcacttcaattgcatacaccccttgcacctctcccacacttatttgagcttagtgttcatccattgtagtggttgagggttgatttagccaagagtcaagtgcattgcttcattgtagagctagtgtagcacttgatcatctctgagccacgtcattgcttgttactcttggaggttgccgcctcctagatggcttgtggaggagttgcccggtgaccactcggagaagattgtggtggaggcccggcaccggttgtgagtgggttggagttcaccacctttggagtgaaggaagaacttccccgagtgatcgaggcttgggtagtcctctccgtgggccggctcccgccttgcccaccccttgacgaagggggcgtgtggtggcttcgtggttgagcggtggagttgggctcgcctcaacggggattaggaaaccagcgagtttctgaacctcagtgaaaaattccttgtctattgtctcatttactttgtgcatttacatttgtccaatttacatttcataaagacatacttgagccactttgaccctaggattgcaaaacataacttagttgcttagttagtcttgtccctcaccgagcctagcaacttaggttagttttgattacgtgacattatcgacatcttgatcctgcagccatgcttagaattaagcaaaatctcaattaaactctttacatgatgaagttgggaatttaatcattgctggacagatttggaaatgctacttatttgtgaactaaaggtgttagaatgtggttttagacttgggcggcaagtggtatgcatatgatgttagttgcataccgatagggggagtgtttgcccaagagcgtaaggaccgaacttgtgtcaccaacttaaagttattcgtacatccacatgtgctttttatggggagccttagttgattaagttacttagcatctaaccttgcatatggggccgtagtagaatgaattagtctgagcgatgattcataggaacttcctatttaccgcgaggtataggtgactaagtctgtctaattcaatggtatagtgccacgtggtggggatcgtttgttgtttgccatcctggccttaagtttaaggcatgggcccgccacttaatagttctaggtcatatgcctaggatggagtcacttatcgtcgctgatgcaaggctaggtattaagtaatgtaaaggcttcgttatgacatctagaccacattcaacgtgtagaatgtggtggacaggtggagtcttgcaaactcaaaacaaactagagtgttcatatcatgtgggtaaagctgtacaaactctgtagagttctaaaaactaatcgattagtcgtgctcacggtcatgagcgctttggtgaggtcacatgagtatagacttgtgttttaaattgtgtttgtgaaacttgggattgaaatggatgatttgtgttgagttgtgtgagtatgattatgattatatgacttgttgccaaggaagacaacaagggtatgtttatgatgatatgatgttatttatgatgaatttacaaatttgttttgttaattgaatcaactcctttgcaaaagtattgtgaaccaaaacttgctttatgctgaaatttaactacatgttgccatcctttgaatatgtcttacatgtagtatgataggattgatttttggcttgacagtacattatttttaataatgtaccgactcttattattctggaatccatttttgttggttgtacgtttagattaatttgagtgatgagggtttcgcgtgcttcttctaggacttgaacttaatgggttaacccccctagtcggagtgcttgtgtttgggtagtcaagcttccgctgttctctgataaatctatatttggccggtcggcccatgtaactataaggtagttgtaatttgagatcactttcgtcttaaatgtatttgctatgtatatctatgcttaagatgaaagtgtgaatctggtgcacatcctgggaactagattcacatgaatacaagttaagtatatttgagatgtcgtatatcttaaaccatttttgtcaagtctcctgaatgtgtaacacatcttatcaccaccttcgtggggtttaacgggtacatctcaggctgaagttgactggcaggctaaagggccagcaatgtctccaatatccttctctcgaggcatcggatatttcattatgtttgtttgatgacttgaattattcacttcatccctcaaatataatgagaggttcggactgcctccgtcaagctgtgtgcatgataaaataatgaaaatagttgtgtgtggtcctgtgtggacgaaatattctttttggttggttggttggttggttaaaactatagtgatgttggttggttggttaaaactaagtgatggcaaatgttgtttaaattcaatttatatcaatttattgtatttaaatctgcgaatgcatttatgcaaattaaccctaaccttcctttgaagccttatatcatatattgtatattcccgtacaattgtgagtactttatgtgctcactctcgttgtctcaccaaaatttcagagaatgcctgctgtttccagaagtttctgttgtggaggaagttgaatagtttgcgtgccctagtcaactgcccgtggtgtgttgttgatgctctgcgcttctttttcggttgtttatctctgtgcttcatactctcatcactagacgcgttcgggatctcatcaaatagttctgaagcgtagatcagcatgtttgagaaaaccttatccaaaatttaaaaacttttaagtcaatgtttgaaattacgtatgcggatgcgtgtgagacttgctactcgtttctctctcgcgcacgtgcatattaggaagccccatgagtatatgatggaacccgtgataatttctcggtcgagattgatatgaacatatcgatctacgaagtcatgacaatcacatccagcagtcgtgtgatcagaacctttcaaaactcaaacacatgcatgcggaatgttcaacttcatcgcacgaattcttatttgggacaacaagagacgttgccggcggcttaattaattaattgatcgttccaaattaatataaactggccacaagaccaaagactaattattcggacaatcagttcttttccatctacaccaccccgttggagactttgaaatggacaagggattgatcagacactggaagttcctttttgtgaatactgaataactacatatgcatttgcagcatgcatgcatcgcctaattacttgattaagaagtcagcaaatgagatcatgattaggtcagtattatccccgatttcttaattttggatgttttgaacaagattaaaatcaaactactatcgatgactttaaaaatatttagcttaaaatatattaaaacaacatttatagatttatcttataaaatactataataaaaataaaaaaaatatttatttattgtatatactataatagaaaacttagtccatgttattatctaaaagttaagaataatagaactcgagggagtagctcgtacgttccgaccatgtaatgatcatctcaccaatccagttagatatagccttgctgtgttctggagggcaagttcccaaccttgtctcccgacacgaaaaacaaatcacgtgattatagtgagattaattaaatattagcctaaaaaacttgaaaaataaattaatatgattttttaaagtaactttcatatagaaatttttttaaaaaatataccgtttagcagtttaaaaagtgtgcgcgcggaaaacgaggaaagtgagttggaaagaggggaaaataacacagcctaaaaataccacttgagaccacttgataaataaattcattgatgcatgctgcaagtctacgatatgagacaacttgccatattattcaagattagagaaatttaacttacagaatgaacaaataccttctgaaacggagaaagtacgcgtcaacttctttgttcaaagtgtatagaattgattgagcgagagggattgagcgagagagaattatacacaagaatgtagagaatgaatgagcggatcctttattgataacagtgttacaatatataggggggagagaggcggcaaccagaagacacgatggtttgggaaccatcgtgtccgttgctagaatcgccgtgaggcgataagaggtgtggggcacgaccaaccgtcgtgtcccagaattggttgctgctctatccatatagatggatgagatcacccaaatatttcataacactcccccttgatcgaatccagcttttatcattgctcatttagggtttgtcacgcccggaatttctatccaaaatttcaaatgcttacatgtgcgttaaatcctcgtccaggaatcaatcgaggtacacaataacaaattgacaatagagtactattaaacagctaattaatattcgcaaaataataaattattacagagatggatagttcctctcaaagaataaaattctacacagcggaaaaaaaacaaaaacgaaacagctatggcgactccactccacaagcaacttgacccgaacaaagcctaatcctccagatcatcaccttcactgaaatactcctcctctgatgaatgaatattgcaagaatgagcatatgacatactcaacaagccatacaacaaatatgcaagtgcaaaggataacaaaggatggcatagtaaagctcatttgcataaacagaatttagtaaacattttaaagaataataaatcaattgaataattaatcagtattaaataaacaccatacaacacacctatcttgcataggcccaacctcatttgaacaaccaaccccggttgtacaaatcaaacctccataccaggaatataccattccaaaccaggagtcatattaattatcacaatattatcattaataaatagtgtgagactaatcacgaaaaacattgtcaaactcacccataaccgcgggcacggctattcgaatagttttactctggccagagatgtaccactgtacccacaagacatagttccacaacatgtcaccatgcgcctcagtaccaccacgataccttggaaaagaactatgacaatacctctcacacaacacaactcaccacagtgcaccgttcctggatcataatctccccctctaaactagaggcaaatagactccccagcgacccccacggacttctcgccgctttacagtctagcaccccataatgaatcatgctatacaaaaggtaaagccgttgcccatactggcttgtggttggcacggttaatgtttcacaacagtagctcccgaaccggtccttaattatcacgagcgccaccatcaaaaccatatactcacaacccacctttaatcaggttttaattatcaattaattatcataacacgattagccatcgtgagctaccattgaatataaccataattaataatgtagtatgattcatccctttaatgagctaatgtttttaagcatggctaagcaattatacatatagcatttagctgaaccaaaccaatatataaggttctagctaatcgaattataacccataggaaaataaagtcatcttcggccattaattaattaggaaaagcttaccacccgatgacattcgaaaataatgcataagttgaaataaaacattagctttaaacgggttcaacatgctcaaagggttgtttgggatctgtgtgacttgccttgagcttccgcaaacgcttccgaaccttcctcaacgaaaacgctctcctccggaacgtcggaaactaaagcaaaagaaaaaaaatcaacaaaacagtacaaaaacaagcataaacattacatgtggatatttttaacatgtagatctcgattttggatgaatttagcaacttgaaccactcgaatcggagtggcgaatgccgaggtactcctcctccgtgcgcacccgacggcggtcacggacggcaacggcgacggcgctagcggcggcgcgacgcgaccggagtgtcgccggcgacggtggcgactagggcaacgtggcggcggcgctatgggcgacggctcggcttgggacttgaagcaaacggaagaggacgactaggggatgctatttattggcttggattagagagatcggactccaaccgagaggaatcgagccgggaaaaactagggttaggtagagagataaactcgaaaacgagtttgatttggcttatccaggcaaaattgatctccgaaaccttaggggaaaggaagaggataaggaggagatgatttcccctcaagcaatcgggactcgggggcgaccggttgaggtggaatcggaggagaggcggcggcgctcgggctcggctcggcccggccagaggtaggggacgatcccgacatgtgggccccacatgtcggcggctaggggagaggaggggcggcggctcggcttgggccgcacggccgcgcgtgaggtgggagagatgtttggccgaaaacggcccaacggcttaggaaaggattttaaaaacttttccaattaaaataattcgtgaaatgatgtttcatttattaaaaatactttccttgctcaaataattcctagaaaaaatctagaaaatggataaacaagaaaagtatttaatgaaattttatctagctcaattttatgttaaaatttttcctagattattagagtttaacttgtaggcttttaaaataatttctaaaaatgatttaaagatggattattaatttaggcgattttcagggcatgacaaacctaccccccttaaacggaatctcgtcctcgagattcagaagaactagcaaaaagatgaggatgagctgactttagtaagcctgtcaaccactacccaaatagaatcatgtcctgccgacgttctggataggccggtgataaagtccattcctatttcctcccatttccactctggaatcttcaacggttgcagcagaccggctggcttctgatgctccaccttgactcgctgacacacatcacatagagccacatattccgctatctctcgtcgcatgctggcccaccagaattgttgcttcaggtcttgatacatcttagtgctcccaggatgaatggaatacaatgtttcatgagcttctttcatgatagtatccttcaactccttattatcgggcacacaaattctttctcctagccacacagttccttgctcatcttctatataaccgatggcttttcctcttctcatgttctttttgatttcttggatatcaggatcattcacttgagcctctctgacttgatcgaaaagagtaggttgagcttctaaagcggccacaaaacctttgttgactattcccaagttcaacttttcaaattcctggcataacttccaaggtagatgtcgtccttctaacatattacaatagcttttcctgctgagagcatctgctacaacttttgctttacctggatgataatgaattttcatatcataatccttgatcaactctaaccatcttcgttgatgcatgttcaaatcaagttgagtgaaaatgtacttcaaacttttatgatccgtatacatctccgtacggttaccaaaaaggtaatgacgccaaatcttcaatacatgaaccacagctgccaactctaggacatgcgttgggtagttattctcatgagggcgtaactgcctagatgcataggcaaccaccttcccatcttgcatcaaaacacaacccaaaccaagtctagatgcatcacaatacacctggaaacctttccttggatcaggcaagacgaatacaggcgcagtcactagccttttcttcagttcttgaaaactctgctcacattcttccgtccacttatacttcacatccttctgaagcagtcgagtcattggtctagcaatcttggagaagttctcaataaacctgcggtagtaccccgcaagaccaaggaaactacgaatctctaaaatcgtcttgggttgcttccaatttagcactgactccacattgcttgggtccacggccactcctccagctgagatgacatgaccaaggaacttcacttcgggcaaccaaaattcacatttactaaacttcgcatagagctggtgctcacgtagtttctctaaagcaagacgaagatgctcttcatgctcttcttttgtcttggagtaaataaggatgtcatcaataaacaccacgacaaacttatccagatattccataaacactttgttcatcaagttcatgaaaaaggccggggaattagtgagtccaaacgacataacagtgcattcgaacaaaccataccgtgttgtaaaggcggtctttggtatatcctcctcacggattcgaagttggtgatatccggaacggagatctatcttggagaaaactgtagcaccttccagttgatcaaacaagtcatcaatcctaggtagaggatacttattcttgatagtgacctcattcaacgcatgataatccacacacattctttgagtatgatctttattttccacgaagatgactggtgctccccacggcgaagtactgggtctggtatatcctttctgaagcaaatcatccacctggctctttacctctgctaacttattagctgccattctgtatggtctcttatggatagggttggttccaggtactaagtctatccggaactctatgtctctcttaggtggcatacctggcaaatcctcggggaacacatctggatagtctcgtactattgggatctcttgcaaagcaacttgatttaatgtcaaaccatgaggtttaggggatgacacaaagaaagacactgtttgcccattgctacttgttaaagtcaccttacggttagcacaatctataactcctctgtgacgggttaaccaatccatccctaagataacatcaagatctttggattctagcgagataagtgaggataggaaaggaatttcttctatttctatagtaacggaagtacagtactgcgttgaggatacttgattgcctagggtattaactagtaaaggtctcccaagactaataacttccatcccgtgatcgctcgcaaaaattttagacaaaaaggaatgtgtagcaccggaatcaaaaagcacatatgcgggtatagagttaacaggaaacgtacccaaaaccagcttaggtgcattctgggcctctgcagctgcaacgtgattaacatgagccttcggtgctggagcattggagttgttctggaccggagcattcttcacacgtcgaggctttggacacttatcagcataatgtcatggatcaccacaattgaaacacacccctggcttgcttccctgttccttcctgataggttgattctgtgttggagctgctacaggtcgtgtgaacacattatgattgtcgttgctgcgattaccagtgttgttgttgtagaactggcgttgagggcgagcaactgaagaggatcctccctgtgggtatggtgcagcttgaggtcccaaaacaatgtgcggcctctggctactaccctgttgagccttgaattgagcagccctacgcttcttctgttccatcctattgtacttgtcttcttggcgaatcgccttgtccaccaactgctggaaatcccggtaatccgtagccatcaatgcataagacaactcatcattcagtccctctaaaaacttctcctgacgttcttcatcagtgtgaacatcttctgggcataacgatctaagcgattaaagtcatggaggtactctgtgacagaacgggatccctgattgagtgctctgaactctctcttcttaagggccacaacacctgatggtatatgcgtcttcttgaaagcagcagtaaactcccaccaagtgataggctctcccgcagctctgttttgacgaaagtgatcccaccactcagcagcaggaccatgcaactgatgcgaagcaaaagaaaccttctcctgctcagtgcactgaatcaaatctaacttcttttcaacagcatgcagccaatcacctgcctctactgggttagtggtgcttgagaaggtaggtggtctcacacgtagaaaatctgccaacttgttctgtggaggtggtggttgattgttgttatttgcctgctggttctacgcttgctgcactagtaaattaatcaactgggtttgctgagccaaaacttgggcaagtgtgggacctccttcattgtgaccacttccacttccacttccacttccagtgcgggtgttcaccatctgaagaaaagcacgggcaagaggaaagaacgacagagagatacccttagaacggagaactttaattaatttaaattgtatattgctcttaactgtatatgattacatttgaattgagttaacactatctcaccaactaacttactctctgacaagcaaaagaactaaactcatgtagttacatcccaccaatgatgtaagcaacacgctaaacccacacacacacaagcaaacttaagcaagcaaactaacacagcgaactacggcaacggtccaactaggcaactaatcccgccttgcgttggaacgaagagacggatcttcttcctctggagtagctagctctctttcttctaagtcttcctcttcttcctcatcacttaagacatggatgacaggttcagcacaatcaggcacagcgtctcccaccacacgagtctttgaagctaactggagacgaggtggtggacgggttctcttccttgcggtgaggcgaagcttgggtgctggcggtggtgcttctcccttaagctcagctagttccttctgcaaacggtacaccttgctctccaacttgcaaatcctgccatggttctagttttccctatcatgagctgctttctcccgctccacgcctactgcatccatggcgctaagcatatacacagcatgtgtcagtgtggcgcttccttcgccttcaggacagttgtaagttccatagtcttgaccatgaggcttgtgtggatgatactggaaagctgatgactctaactcctcataaaagcaatgacgtagctctccaatggccaccaaggctgcttcctgacaagcatggctatactttcttcccccagcttcaaactttatcgacggaaggtcttcacgatcactagccaacgtcacgcgaacacgacacttctcctcgttgggatcatggggaatctagcgatactcgggggcaacctcatagcctacttcaaataccatcaatctcagctccctgacgaatcctagcaccttgatcaagtttttcggcggatgggcggcatctaaagaaacatagaaaggaggaattaatgcatatattttttttaagttagctgtacaaactagacttaatttatttgacccaaaaaggaagaaaaataaaagaaaaggaacaaacagaactaaacaaatttttttttttggaaattaaatcagctttggacagagacaaatagctttagacaaatgaataaaataaaactaaaatacttaagatctactataagcacggtacagtgtcaccattaagagggatgagtagtactagtgctatcttgattgaatcgataccataatagatgtacagtgccgaccaaccactgaaattcaaaaaactatttaataccctgaacagtaaaggaaaaagaaaaattagaaaagaacagctttctgttttgtaaagtaggatttagaaaattttgtgcttgaccttgcatgtgctgccaacttaattagtttgtaagagaatagggaagagcagtcctattttttcaaaatattttaaatgctacttaaggtttaccatttggcttgtcctaaggtcaaggtagctctgataccaacttgtcacgcctggaatttctatccaaaattccaaacgcttacatgtgcattaaatcctcgtccaggaatcagccgaggcacacaataacaaattgataatagagtactattaaacaactaattaatattcgcaaaacaatatattattacagaggtggatagttcctctcaaagaataaaattctacacagaaaaaaaaacaaaaatggaacagctatggcgactccactccacaagcaacttgacccgaacaaagcctaatcctccagatcatcaccttcactgaaatactcctcctttgatgaatgaatattgcaagaatgagcatatgtcatactcaacaagccacacagcaaatatgcaagtgcacaagataacaaaggatggcatagtaaagctcatttgcataaacaacatttagtaaacattttaaagaataataaaacagttgaataattaatcagtattaaataaacactatacaacacacctatgttgcataggcccaacctcatctgaacaatcaaccccggttgtacaaatcaaacctccataccaggaatataccattccaaaccaggagtcatattaattatcacaatattatcattaatgaatagtgtgagactaatcacgaaaaacattgtcaaactcacccataaccgcgggcacggctattcgaatagttttactctggccagagatgtaccactgtacccacaaaacacagttccacaacatgtcaccatgcgccttagtaccaccacgataccttggaaaagaactgtgacaatacctctcacacaacacaactcaccacagtgcaccgttcctggatcataatctccccctctaaaccagaggcaaatagactccccagcgacccccacggacttctcaccgctttacagtctgacaccccgtaatgaatcatattatacaaaaggtaaagccgttgcccacgctggcttgtggttggcacggttaatgtttcacaacagtagctcgcgaaccggtccttaattgtcacgagcaccaccatcaaaaccatatgctcacaacccacctttaattaggttttaattatcaattaattatcataacatgattaaccatcgtgagctaccattgaatataaccataattaataatgtagtatgattcatccctttaatgagctaatgtttttaagcatggctaagcaattatacatatagcatttagctgaaccaaaccaatatataaggttctagctaatcgaattataacccataggaaaataaagtcatcttcggccattaattaattaggaaaagcttaccacccgatgtcattcgaaaataatgcataagttgaaataaaacattagctttaaatgggttcaacatgctcaaagggttgtttgggatctgtgtgacttgccttgagcttccgcaaacgcttccgaaccttcctcaacgaaaacgctctcctccggaacgtcggaaactaaagcaaaagaaaaaaatcaacaaaacagtaaaaaaacaagcataaacagtgcatgtggatatttttaacatgtagatctcgattttagatgaatttagcaacttgaaccactcgaatcggagttacgatgatttagttatgaatttatgaagtttaatcgattttcatctaataaagaaactaagaaaaagagatttatgacgtcatcgctgacgtcatcgccagccatggcacggctccacgtgaccaccggtgctagagagctcggtttgcctaaccgaggacacgtacgcgtagaagacggcgacgcgaactcaccggtgcaataaactacgacggaccacgacaaacggcggccggcgacaaggtccaatggcggctcggctcggctcgacggcggtgacggcgctccggtggcttgcgacagcggcgaaggggtggccgaggtactcctcctccgtgcgcacccgacggcggtgacggacggcaacggcgacggcgctagcggcggcgcgacgtgaccggagtgtcgccggcgacggcggcggctagggcaacgtggcggcggcgctacgggcgacggctcggcttgggacttgaagcaaacgaaagaggacgactaggggatgctatttataggcttgaattagagagatcggactccaaccgagaggaatcgagccgggaaaaactagggttaggtggagagataaactcgaaaacgagtttgatttgacttatccgggcaaaattgatctccgaaaccttaggggaaaggaagaggataaggaggagatgatttccccttaagcaatcggactcgggggcgaccggttgaggcggaatcggaggagaggcggcggcgctcgggctcggcttggcccggccggaggtaggggaagaccccgacatgtgggccccacatgtcggcggctaggggagaggaggggcggcggctcggcttgggccgcacggccgcgcgcgaggagggagagatgttgggtcgaaaatggcccattggcttaggagaggattttaaaaacttttccaattaaaataattcgtgaaatgatgtttcatttattaaaatactttccttgctcaaataattcccagaaaaaatctagaaaatagataaacaagcaaagtatttaatgaaattttatctagctcaattttatgctgaaatttttcctaaattattggagtttaacttgtaggcttttaaaataatttctaaaaatgatttaaaagatggattattaatttaggcgattttcatggcgtgacagtgttctagatatctgtaaagataatcttagaaataattatagtcagtatattaaatacatcacgtaaaactcctcgaaaacccagtgggaaaaataaggagagaaccgtgatatattattgactagttttagatcttaatgagtaaagctcatagtatgatccaaaaatagtataatgtctgtagttatcatttagtaaaaatcccagtggggaaaagccaaatgataagacatataacttatgttgatattacctcgttaaaaactttggatgagaaaacctatagggtaaaactcatacaaaggaaaaagagtataatatgacgaaaatatgttattttccagaggaagatactccccctgaatcctgtaaatttttaagtcgtctcatactaattcctttgacacatttaaagaatgtggagtatggcagagattttgtgaataaatcatcaagattatcacatgacttagtttgcaaggtgtttatctctccatgttgctgaagctcatgaggataaaataatttaggagcaatatgcttagttatgttgctcttaatataaacagtttccatctgaacaacacaagcagcattatcttcatagataatggtaggtgattccaatgaaccaataccacaagatgttaatatgtagttaaccattctgcgaagccatacacattcacgtgatgcctcatataatgcaattatttcagaatgatttgtggaagtggctaccagagtctgtttagaagacttccatgaaatagcagttccaccttgtaaaagtacaaatcctatttgtgatctggcattgtggggatcagataaatagccagcatcagtatacccaataaaagtcgaatcatggttctttttaaagaaaagtccaagatctcttgtgccattaagataccgaaagacactttaactccagtccaatggcgtttggtaggagcagcgctgtatcttgctaatagatttaccaagaaagcaatatctggcctcgtactatttgcaaggtacataagtgccccaatagcactaagatatggaaaatcaggaccaagcacatcctcaccatcttcctttggtctaaatggatctttctccacgtctagagatcgaaccaccataggggttttggaaggatatgacttgtccatattaaatttctccaaaattttctgggtatatgcactttggtgcacaaggattccaaaaggtaaatgctcaagttgtagacctaagcaaaatttggtttgacccaaatccttcatctcaaattctgtctttaaatgatgacgtgcttcattaatatcttgtgtattgccaatgatgttgagatcatcgacatataccgagataatacaaaatcctgtgggggaccttttgataaagacgcacgggcaatcatcatttttagtgtatccttttagtgaaaggaattcacttaatcggttgtaccacatcctgcccgattattttaagccataaagtgacttctgcaacttaacacaatacatgttatgatttaccttctgattcgggatatcgattccgtcaggaaccttgatgtaaatatcaaaatcaagtgacccataaagatatgctgtcactacgtccatcaactgcataaatagacgattttgtattgccaatgatattaaatatcgaaagttataccactcataactagagagtaagtttcgttgaaatcaacgccaggtttttgcgtaaaaccttgtgctacaagccttgctttatatctcaccacctcgttgttttcattccgtttccggacgaaaacctatttgtatcccataggaaagataccacgaggagtaggcattacagccgagaatacttctcttttgtaaagcgaggctaattctgcgtcaattgcgtccttccatttgttccagtcagagcacttttggcactcttttatagacctaggttctggatcaacttggaggcaatcagcaatttgttcagaaaaattaatgtcgacaattgtagctcttctatcaaaagattctccagtttcagagtagttgatggcaatttcatcaacccctatagactcatcgtgatctcccgaaacaatgtgtctatggtcttccgaattcctagtctcagcattatgcaccaccgagctaagttgcagactatcacgatctgcttgatatatagtatcaatttggtgtgtaccaactaaagggtggtttgcatttaccgtctttctttgcttattagcaattgtttctcgctgagtggccatacttcttcctctctttttagtgagtggaagttgagttgttttatttggtacctccactctttctggcgcattctgagcaggaatgaaagatttagttacacctttataattagtaaatgcatatggcaggttatttgcaagtctttgcaaatgtataattttctgaacttgaagttcagtttcagtagtacgtgggtttgaggctggaataccctaggcatcccagtcaatttcctggcattctttctggtacttgaagtctccccctaatgctaggaaatgttcctcatcaaagatagagtcagtgaaccgggcagtaaatagatcacctgttaagggttctaaatactttatgatcgagggagatttgaatcccatatagatccacactttcttgtgtgggcccatagcggtatgctgtggtggtgagatcggtatgtatatagcacaaccgaacttacgcaaatgggaaatacttagaggatttccatgtactaactgcattggggaagtttcatgatatgcagttggtcgtagttggacaaggtcagcagcgtgcagaactgcatgaccccaacacgacgaaggtaatttgcaattcatcaataatggtcgagcaataagcttaattcttttgatcaacgattcagccagaccattttgtgtgtggacatatggaacatagtgctgaacctgaattcccaatgccatacaataatcatcaaaagcatgggatgtaaatttggcagcattgtccatacggattgattgaatcctatgttcagggtaatttgccttcagccttataatttgagacattagtttgtcaaaggtatggtttcatgtcgatagaagacacacatgagaccatctagtagatgcgtcaatcaaaaccataaagtacctgaacggtccagatcttggcacaatagggccacagatatctccttgaatgcgttcaaggaatttaggtggttcagctctgattttgagataagatggtctcaaaaatcagttcccagtagcacatgcagtgcatacgaaatcagaggatttgagaaatttatcagtgatcaaatgatgaccaatagagttgccaatatttttttctcatcatcccggtactggggtgcccaagtcgatcatgccaagtgtggaatgcatcaacattttgaaaaattacttagtacgcaacatgtgcaatgggcttaatatatgtatagtacaatcccaatgtgagagatggaattttctcgcaaatgcgtttgccatatctgttttatttggttaagagaagaaattcttctcgattatccatatgggtttcaatgtgaaatccattttgacggatatctccataacttagtagagtacgggttgaatcaggatacaataaagcatcctcgattataatttgtgtacccattgggagtgtaatagttgctcgtcctgagccaactatcacagtatcgcgcccagcgatagtcaaaactttgccttctctctttttgagagtttgaaagtatttgatctccctaagtatagagtttgtggtaccactgtccacaagacataattcctctccaattggggcgatatccttagacatctatagtgaaagaagaattgcttagtgaagaattctttatccacaatatatacatacatataataatgaaaacatcaaatacatagtatgacgtttacataggttaatagtacatactctaatgactagcaggtcttataaccttacaatgtaagggagtttgtacgtatctacttattacaaccaatattgttttgacaaactataggatatcaatataatgtctcaaacacactgagattaaagcagctttatctctaagtgggacgcactgagattacagtaaatctccaagtgggtccgttgagcagtattcgatgagcatgtcatccactacagaaagtgcagcggtatcctctgggaaaagaacgaggttgttctctggttcaataggagccaggtgagaactttcaacctcaggtctttcttttgtaagattgaagtgagcttcaaatctgagttcctcataagactttttctcctttagggatttctgatacaggagaacaagatgttgttgggatgcggcaatttttagcgacatgatagtcagatccacacctgttgcaatgcttgttgctattgccactaggttgtggtgccttacccttcccttttcctttctaatcgaccatttcatttgcgccgttgttgcatttgcgttttccagtcagattcttagggttattcgaggaatttcccttgaatcctttgagtgtgatactgttggttcaatatcatgtcctctggaaacatagttgatagagttttctctatctcctctgcttccgttggctctttttcataaaacttcaacttggagcaaatgttatgaacatcatgattgtattctgccacagttttttttaaaatcctttaaaatcctataagcgtaaatgaattcactcataattagcctcaggccaaatgagttccttttgcttatcataacgctcttttagagctttccataggttgagagggctcgactccaacatgtactcatgtttgagatctttatagatgtagagcctcagaaggaaaagggcaatatatagatttctgttctcaactggtggatcccaatcattgggttcctaatttgtatgtgaaatcccactagaagaaaaatttattttgatatcggaagcccaaattgggtagttactcccatcgagggcgagttcgtcgagctctatagttgccatgtccctataatcatgattaacattattaatttacagaggtaaattaataaaaacatgatattgaggttgtaatctcaatgcgtaatgtaagacttcatattttgtaatgtttcgaaaagatgtaggctatagacctgacaatttgagttagaattcaaaattaggtggcacaatgtggataatctccaaataattaaatagtggagtagatatcttaatagtgggcaagtaatacttgctgcctaaaacacggtctccaggcaaatatattctggtgaatataccgcagccgatgtttaggactccactaccttgtgctcaaccaaatttcaaataatctcatttttcaaaacatattctcggaaagtaacacatgtgggtaatcatcgtgagatgttgacctctgtgagatgggcgagatgctcgctgcctaggttatgaccagtgcggccaatttgtaggactccatcgggtaatcatctcaaaatgtagatcacttgatgatgggcgagatactcgctgcctaagttatggtcaatatgaccaaagtataggactccatctacatgtgattaatgtccgagtcaaaatgtgaagtggaacatgcattaaatcctccattaatcatgttgtacataattaagagaatttgctaaatcaaagtacaaaacttatagaattttgtaaattaatgaagcgagaaagtagagtgtgtcttgaaatagtatgcaaaaggcatattattaagacaacaaataaatttagtgaagcagggtatttaaataaacacctatgttaagtaacatataacatcagtggtctacaggaccagtacatagtaatttgtacaactgatgaactgcttgtactaaattatcaaagatataggaactaataagaaaatgctgctaaattagaaaataaaaactaaaaaaaataaacggtaaatgggtggtgagccgaaatcaataggattcggcccaccaccgctactgtgcggctggcccatcgggtccgaggggaaaagggcgcaggggggcgtgggggtgttagggttagaaccctaaccgttcccctcgcggtgtgcaccgccgccgccgccgattggccacgcctcctccacctcttctgcagccgccgccatttcgccgcctcctcctccatcactttagccgccgtttccaccgccacctttctcatccaatgccgatccaatttccgccgccaccttctccccctgaaacgccaccactgttgcctctatttccgccgccgcccaccaccgccgtctctactgcccgccgccgccatccaccgtccgccgccgccgcatcccccatgtcgaccggcggtttgctggctagagttaggccgacggccccaactcctcatcggagtcggagaccggttgagcccttacaccgttccccatcccgccatttgagagcgtgcgggagccatggggaacggcgagccatgtggagcggaggctgggacggcgagcagtggcttcaccggcatgacagtgagacgacgatgggttgaagtaggccggctcccccgtgcgcgctaccatggttccgttccggccggactccggtggcgcgggagtgggggagcagcgttggtgtggcgtcggcgacgtcgtggcgcgggtggtggcggggttggagtagcagcaatggtgatgcggcgccgagggttgtggcggtggccactaaccctaggccggcgcctggcatggtgatggtagcagtggtggcgactcctcgttgtacgatggaggaggtggtgcagatggcgggctcggtcatggcgaggaataccaagaacggtgtcgataagtaattgaaggtagacatctcgtacctttcctgttgattctttcgcttttccttgagatcaaaagcgatgtagtttcttctttcacttcacgatcttcttcgcgagaacggcgtcgataagtaattgaaggtagacatctcgtacctttcctgttgattctttcgcttttcattgagatcaaaagtgatgtagtttcttctttcacttcgcgatctccatcgcgagagcgaaagtgctgataacgtattgattccagcctcagacccacgtactactgaaactgaacttcaagttcagaaaattatacatttgcaaagacttgcaaataacctgccagatgcatttaccaattataaaggtgtgactaaatctttcattcccgctcagaatgcgccagaaagagtggaggtaccaaataaaaccactcaacttccgctcactaaaaagagaggaagaagtatggccactcagcgagaaacaattgctaataagcaaagaaagacggtaaatgcaaaccaacctttagttggtacacaccaaattgatactatatatcaagcagatcgtgatagtctgcaacctagctcggtggtgcacaatgctgataacgtgttgaaagtgtatagaattaactgagcgaaagggattgagcgagagagagaattgcactcaagaatgtcgagaatgaatgagcggatcctttattgataacagtgttacaatatatagggagagagagaggtggcaaccagaagacgtgatggtttgggaaccatcgtgtccgttgctagaatcgccgtgacgtgataagaggtgtggggcacgaccaaccgtcgtgtcccagaattggttgctgctctatccatatagatggatgggatcacccaaatatttcataacattcttgatgtacactcatattcgagtgcgcgtttcgcaattttcctcttgctggtgacctcgagtcgtacgtttcgtaggttgttaattttttttccagtcagcagtttaccaagtttataaaaaagcataacaatacttttaatgaaaacgaacatactaccaaaatatacccaatgcaatatttaataacactaattttttttgccaattaataacactaatttaatgttgtggatgttactaaattctcttataaatttaattaaacttaaaataattaattaaaaaaattatagcatgttataatatgaaatggagaatgtggccaatagtcgtgtagcatccgtagaccatgacatcgtcgtcatggcgttcatattcccatgaccaggcgccacgagggaacacgccacacatgctgaaatttttacattttagtcctttttaaaacttattttatgaatagattattgaaaaacttatttcagaaatagtcttttctggtgcgctagagtggctcgcgccgtcgtcgaacagggtggcaccatcacatctggcgtcgtccccataccattgtggcaccacgtggctggcctgcactgacctgacaggaggacggcgcagtggcatggggacggcaccagattactggcaccgacccacccccctcgacggtgccaacacctgtggcgtgctcctcccaggggtgggtggcacttaacccatacccacatggaccccaccccgctccccctccccacccattcgtcccctcctcccccgcccgagcctgagcagagctcttgctctctctctctctctctctctttctccctcctcacctctcctcttcaaatccactcattgtgaagcagtttttcacgagattttttaggggaatcgaagagcaaggaattctccatcaatgcccctatttttttcgttttaattgataaaatttgtagatggtagggtaacactagaacccaaatttgtgattttgaacattgaaattggggattcgttgattatagtgttacatgtgtgcaatgtgcatattggcgccacaattttttggagtatatatgtggtaatgttgatttttaggtgagacattaatgaatggttggatggaaaaagttgctttaggttagatttgtacttatgtggtatattttggttactttaatatagtgattaacatttttggcattgtgggatgcttaggaaggatcatgtgggctattccctggatcagctgccaacaccgggcgtaatgcgctgtcacgtcctgataaattcatcccaaaataaaaatcattctctaaaaggaataatagaattaattaaaattcgaaaagaaattggttaacactaaaatacatacaagaaaaattcgaatgtggcccggagaattttacttggtctaaaaagagccctcaaattttacttgaattttcagagcaccggaaatatttattaagcaacaaaaacaattaacaaagtttatttaaaagaaaaggctaaaaataatccccctcctccctttgggccaagtcaggcccaaagtcccctctctctctctcggcccgctgccaaagtcctctcttcctccctctctttctctccctctccttctctccctccttctcttgggcctcccattcccctcctggcccactccctcctctcctcctccttctgggccgcccctcccctccctccttccctctcggcccagccacccgacccaaaccaggccgagccaagccagccgcgtgcacgcgcgccgcacgcgcgctgacgacgcgcgccccgcgtgggtcccacgcgccgggtcgtcgtcgtcctcccgcccggcctcctctctctctcccagaaacctagcgccattcctccccaaaatccacgcgattcaaaccgggaattccaaaattgattagggggaattaatcccctttccttcctcttcaattccccccaatttcccccttgattcgtgccctctaacgcccggaacagccgcgccattcccggccgccttccatggccgccggccacaaactccaccgccgttccccgctcctcccgttgccggctccctccccgcgcctataaaatggaatccccatcctccgttctatcgttttagcctcatcccgagcctccccgtggtcgtatcacccctccccgccgtcacccttctctttcccccgcgccgaccgcctccagccgcctctaccgcctcgcccgcgcgccagtcggctgtgccgtcgcctccctcggcatcgcagcagcctcctctcccccggcctgccctccgtttcgcgcggagacccccggaggtgcgcccccgccggcaacagtggcgttgtcgccactgttctgcctccggccgcctctgccgcgtctcctgtgcgccgaccgacgtcgccgtctcctccgtcgatgtcgcagcgtcgtcctctcctccggctgctcctctgtttcgccggaacgctgtcgcccgcaccgcctctccctcggtctcgtcgacacccactccggcagccccttccgccgtgccagtccaccggccgacgtcgccgtctccacctccggcatcgcagcggcaaggtcgccctcggcctcacctcccctccacccgaacaccgccggtgtccgtcatcgtcttcaccgttcgtcctcgccgatcgacgtcccatcgttcgcccggctcgtcgtctcacggcgccgcctccgtcgtcggattcacagcagcgtgttccacgccgtcctcgcctctgtgcagctgctgccggctgccatcgtcgtctcctcatcggccccggtcgtcgtcgtcgtcgtcctctcgtcgttcccggtttcgctcgtcgtggcgttcgtccctccgtcaagccgttctcgttcgtcgtcctcgcctccgcgtagtgccgcagccccgtcatcgtcttcgtcctcgcctccgcgtcaccaagcgttgcgccggccgcgtctcgccttcgtgcaaggatcgccgccgaagtcgttccctcgccgttcgcctccgtcgtccccgagccgtctccgccgcgctcgttcgtcgttgtcgttcccacgcctcgtcgcgtggtggtaaggatctctccctcgtcgccctcgtcctcgtccttttggtatcgcccgtgcccgttgtgcggttgtcgaccccagtacccgtgtactggtgtcggtagtcgttcgcttgtgcgtgtggtgaccgtgttagtgtgcccgctcggtagcctcgtggtttccacgtgtgcagcccgtgtggtgtctagtggagtccgtttgtcgaccacttgcctcggttgacacacgggatccgcttccgtcgacccgtggaccatctctgtgtactcggtctaccgtggtcctttaggttgacatgtggggtctgcatgtcaacggcgcagccttcctgtcttttccaggctagcgcttacacatgttttataattgcaaaacctaatcacaataatccgtaaatctccattgtcacgaccggaaataacccaacgggcgttccttacgtgcgtgcattattccttgtcccaggaggcaaggtataccaaaagttgatacaattcagagttcaacaagcggaagcgtaaatagttaatttattacatgggcagcgaaggcccaacacacacaaagacaaacgagaaacagcggaagactagggcgacgaccacaggcgcttgacggcaggcacaagctagacaccaaaaccttcatcttccagagactcctcttctgggtttgggaaaaattgagcaagactgagtacaaccaccgtactcaacaagacacacccacaagtgcataataaatgcaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccaaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgccctggagatgtccatcgacccccgacttcgtccatctctatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacacactagttggggttttgtttatcctagggtgaacaaggtaataataacaatagcaataataatgtcttaacaaaggtaaataggcatggctaaataaaacagtgataacgcgggaatttaaataaagcggtaatgcattaatttaaattaaaataattttataaactgggattcaatatgctcaaggatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccacgggggtggggcccacgcggcagccccacggcccacggtggaccgggcgcacccgggctcgcaccggccggcgccgtgggtcccacgcgtcagccgcacctaagggcgcgggcggctgacagccgggccccacacggcagccgcggggcgcgcccgaaggcggccacgccggcgcagcggcgggaggcggcgcgcccgtgcccctatggtcgccggcggcggccataggcaccggcggagcggcggccgagagaggggaagggaagggggaaaagaagcggcggtccacggctcaccccgggtcgacggcgacgacagaaacggcgaccagagcggaggggtggacgaggtcgccggggatgcggtgaagccgaaggtggcgacgccgaggcgggaggtggtccggggcgacgacggcggagagagagagcgacggcggagagagagagcgacggcgcgagctcgattccgacggggagagagggcggcgagtggcggaaacggtggagggaggcacggggaaggtttatataggattgggagggggagggagctgccggacgagggggaaacgggcgcggaagatccggtcgccattgatggcgccggcgaagttaggggagaggtttccaaacgaatccgagggagagagggagggaaaaatggggggaaagagggagggaatcacggggaatatttcccccctcttgattgcacgcggggcggacgggggcggcgggattcgcggcggcggcggcgctagggcgcgggcggggcggcgggagcggcgggaggaaggggatgacgggtgggccccacccgtcagcgagggaggcgggcgggcccgcccgtcagcggcacgcgcgcggggtgggggccgaatgggccgcgggaaagaggagagagagggagagagatgggccgagccggcccaagagggggggaaaggactttttagggtttttctttttataaaacctttttaactttgtttatttcttcttaattattatttgtgctccgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgcgacatccatgtaacagcattaaacttcggatgatcatatcttggtcatacgaaccccgaatcgacccgttcaagtctcctaatgtttgttataacctaaagaaccgtgtgctttctttttatgtattgttattgcttctttataggcttgtagctttgcttgtgtgcttcgcgtagcttctgtcgttccgaaggttctcgaagcatggtttgcggtcgtcgccaaaggttcggaaggccgttctctctgagcaaggcaagtcacatcatccttgagcataatgaatcccagtttataaaattattttgatttaaattaatgcattaccgctttatttaaattcccgcgttatcactgttttacttagccatgcctatttacctttgttatgaccttattattattgctattgttattattaccttgttcaccctaggataaacaaaaccccaactagtgggtactctatttatggttccactagtatgaatttaggtagatgcttcgctgattaattaggtaacaataggtggttttataactttagactttaggaattctcatatcacttggatactatggaatggttggcttatggtggaattggacatacccctctcttcctatttcaaaacccctaaaacctgttttctggtggggtttgggtgcatgccagttgtgggaagtagcaccccggacaatataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaagctacatgagctgcggctcggtaatcgagatgtctaggcaaatgaagactacacgggtcggtgcccgttagtcgagatgccatggcactggactagtacgcgggtggtctcatccctatgcgtgtggtgcacccggtctagatcctgttgctaggggctcaatcctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgtgccctcggatatgggcaagcctagcaatgtacccaagttagtggtttaattcttaaaatttgcttaacaactaaaatatggaatggttggcctgggttggcttgggacgagctgggacccaggtcgggttgccagttcggtctgaatcatcgtaggccttgggttaaggcaggttcgtgtgggtccacggcctcgattaataatactgtgtagctctaggatcgtatttataaaatagctttgggcaactaattgacttttaaatgctctttactgcaaaacctaaccctattattattaccccatgtactcccttgcattaatcatgcatctctcggtgtgacttgctgagtactgtggttgtactcattcttgctctatctttcccccccttcagtaagagaagctttggagaagaagtcttaggtggagtcctggcttataccccagttgagcgcctgtgaagatggagccgtaggcccgctagtccgctactgtttatttttgattgtcaggcctgaagtgcctttgtaataatgtaaatattatcgatataataaagatgtgcggtttgtatcatgtttgtgtggtgtaccccggcttttcctgggacggggattaatacactagcggtcgggaaaatgcaaattttctcggtcacgacatgcgccctatgggttggtgcggggatgaatattgttttcagattagtgatgacggagatacctacgtctagaggtattggatgtgccagaactatgcgtatagtccagagaaggctaagcctgtgcctaaggaaagaagggaaaggcgaagaagccagtggaggtaaatttatttattttatatggtaccaccttgaatctatgcaactctgccatcaacatataatgtgttgcaatgtgcaggcaatgaagatcccgcctcctttttgtgacttttgtggaatggattgacaaggagatgaatgagtttcatacgagtttgattcgacattggcgcgagtggaaggaagaacctaagaagcgccaacgcgagtgtgctgcaatacagaaggctgagagggagagggagttggcaatagagaactgggagaaggaagagggtgatgttgattgggtgaggaaggtggctagggcgcagcgtgtgaaggaggcggggacggaagtgccaaggaagggcgagtaccctcgtgcacccaatagtgcgatggaagttctaacccaaaattcgattccctaaggcatgtaataccgatactttgaaatgtcttgcattgaactatatgcgtgtatgccatagacctttggaattcatcggaatctttagttcgtcatgtcggtcattggacgtcattggacttcatctcctccgacactgttccaggctcctctcatgcgttcgctgaccggcgccaccttcccttgtttctttggttgcaaccaccctcccttcagcccatgtagtggcagtcacccaccccgacgacatggcgccaatcatcatgtgatgcctgaccgacgctgatgaaccttgagttccactcgacactcaaggttgttgttggctcgatctttcggtgagttatagataactacgatttgggagaagcgttgacgatccgactacaaccgtacaagacgttgcgttgcgccttagtgatcgatacacctctccgtgggttgttgatcttgtcggtgcagatcaaccctattcctgcaagaaaatcgaagaaataagcaaaaaaacaagataaaaacgatatgatattgcaaataaaaattgaatgcaaatgataagttggggtttcgaatacaagcagacagacggtctagccgacacgcgcactacaagaaagtagcaatggctaagctttcatctaaacaaaacccaagaaaccctgaaggggtacctacctatttataggggtgggaggacgaccaagggatgccaagggttgttctccacctggttggggcgcaccccacatgggcccactagggccggggtcccaaacaaagttacaagcccataggcccaagacacgtgatgtagcaccttgtttatgtgattgcagccaaacgacaaggaatttggcaatgaggctagatctgttggaaagagggcttcgagagctttccatcaagtactcatgggccgaaaacggaggtcgtatgcaaattcggcggccgtttgaagtcagcagtgtagctggtggccgaatcggattacagcacttggaggacttgatctttatatcttcttgttcatctatgatgtgagcaatggttgtatccgtagcagccaaggtcacatcatcctccccttcttcatgaaaaatcgttctcggtttttccatatggtgctcattgcgtggtcgatttaaaacaacctgtttcatccaatcaaaacaagagaaactcgaagtaatatgattataaatagcatgtctctctggcttgaaagttttatacacatgtacaggaggttctaaatccgaacatatgtaaactgtatacaccaaatatatttctctatcattatattcaccaaagatatgaaaaatagcattagttggacatggcaaataatatttagcaaataatttctccttcaaactatcgagctcacaaaaatcatcacactgaacatagcccaaagtatttaaagaagatgtcaattcacgttgttgtacttcattagcaaaatgaataacatgcttaaaattatcacataaagaactgacattagaaatagcatgttcattcactagttgtggcattgatataagtgaagcattatcacacaactcttctttatcacaaggaacaacaaacaaatcaacttgtgacaaaggaatctcatcagttggttggttccactaatggttgctctactatagcatgaaaagtgaacaaattcaattcattaacaacacactcaccttgaataatttcagcaccattaagtttacctttaatgccctcttcatatgatggaggtgccttgactttgagtgtgaacaatgggactggtggctctttcatgtctctatcctccatttcatgattatgtacttcctgcaaatggttagtaatagaagacaaaaacatagcatgttgcttcttcatatcctctattttactttcagcattacaagcaagttgtaacaaatgagaaagatatgtatatctttaacaatcaagcatgtcttgaatttctttgttaagcccacgtaaaaagctcaattctatagcttcttcgcattcatctaaatcacaacataataaataagcatgcatatcatgatagtatgaagtaacagttctggtatcttgtttggaacattgccgtttgttgaacagaatgtcagcataatacatgggaacataaacatctctcaaatatcatttcatgtctttccaagattgttgtattttattatgcctacaaagatgtttccaatcatcatatgtaattaaaacactagaggcacacataatcttttgtttctcagacaatccatgctttttaaattcgctatcaaccgctagctcccaattaatgtaagcatgaggatcataatttccttcaaaataaggtagtgcagattcgatcttacctagaacaacatcacttacctcatattggtcatgttgatcacttctcatgtcccgatgaagatatccatgttgagcatgacggtcccctgttcgcttgcttaatcttgtcattgttagtagaaaacaagaaacatacacaagaatatgcacgctcctatcaactactaggtagtggcaactcaaatatcacacacactcaaagcttttaccgagctcttacaagttcttaccaatgcaagcggaaaggtgacatacaccgactcaaccaagcacccaaatggaggttggatgtatcgatgccttggcaaacacttgtcgtacggctgcaatcaaatctgtggagctctggataggcttaagtatgtagcaaatgaatagcaaatgctcaaatcagataatgcaaagttgagcaattgttcaaagtcgagtaccatgctggtcctaggctagaacgtactagagacgcgagcctagacacaaacataacacaaaatagcactagaaacaactcaagcacactctgatatatcaaattcagctcaaaaatacaactgatttttttttctttcttacttcttcttccttcttttcttctttttttctttttttttgatgcggcttttcttttatttttttcttttttatgcaccttcctgcctttttcttactttttttatttatttttttctgcaaaaatgactcaaggacctcaatgcaagattacatggactcaattgtaaatataaaatatacagggactcaagtgtaaaagtccgaatccaaaaaatgaaattataaaaaaaaatggaatgctgaatttatgctggttatgtttttccaaacggatctcgaaaccgacaccaaacaaaaattcaccaagctgtacggcaagtcacggtgtagattgaaatgagggagggagtcggataggtgggaaaccgactatctcggctgaaagtttgggtatctcgcatgaaaggaaacaaaatcaatctcaacagaaaccggtacctcccatgaaaggaaacaaaatccgatcttaacacaaaccgatctgctatcctttctttctccttaactgcgcgcaacagcgatctactatccttcctttctccttaaccgcgcacatcagatcttcttccttgcgtgaagagaacaagcatggtcgaatgcagatggcaaaccctagatgcaactcagcaactccaagaccaaacgataaaaacttctgaaaactagaaaaatggaaccctgacgacaagacaattcaagttttgtaggtcccagcgacaacaatcacacggtggcggcgatgacagtggtactaaccgtgactagaactcgaaactctaaacggactagacactacgaccagcaacacgactcaacgatgcaacacaaaactcaacaaagcaaaaactgaaatgaacaatgcaatggcacaaatatggccaggtacaggatgcaatttttttgtaaagcagttttctggttataggtagataaaaaaaactctccgagcaacgaaagctctaataccacctaatgaaccctgagttccactcgacactcaaggctgttgctggcctgatcttttggtgagttgtagataactacgatttgggagaaacgttgatgatccgactacaaccgtacaagacattgcgttgcaccttagtgatcgatacacctcttcgtgggttgttgatcttgccggtgcagatcaaccctattcttgcaaacaaatcacagaaacaagcaagaacaacataaaagcaatctgatattgcaaatagaaattgaatacaaatgataagttggggtttcgaatacaagtagaacgacggtctagcaggacacgcgcgctgcaaggaagtagcaatggctaaacttttatctaaacaaaacccaagaaaccctgaaggggtatctacctatttataggggtgggaggacgaccaaggggtgccaagggttgttctccacctggttggggcgcactccacatgagccccactagggccggggtcctaaacaaagttacaagcctataggcccaagacaggtgacgcagcaccttgtttatgtgattgtggccaaacatcatggaatttggcaatgaggctggatccgttggaaagagggctccgagagctttccatcaagtactcacgggccaaaatcggaggtcatatgcaaattcggcagccatttgaagtcagcagtgtagcaggtggccgaatcggattccagcacttggaagacttgatcttgatatcttcttcttcatccatgatgtgagcaatggttgtatctgtagtagccatggtcacatcagatgctgccgcccaccacatccccgccagctcgctcctgcctccatcgtggggctggcactgccctcccccctaccccaccaccacaacgcaacccaggcgccgcccccttccaccccccccccacccggctcgctcctacctcgcgtagctagatagcgacccctcccctctctgaccatagcgccaacaatactggcatcctcccatcccgaacttgtaaagtagcaaattgacgcgcataagccaataatttacacaattcgatattgtatcaaatgcaaacatttcaaccaactcgcaatgagcatattaatcaattattcgcacatgacataattgttaacctccacacatgacccaattccatcgaacaagtccacaagttcaaaaaatgcatatcacacatgacatacaaaagttcattcatcacattggaccatgcatcaccaaagttcatcaaacaagttcacaagcccatacatcaccgaagtccatcaaataagttcacaagtccatatatacatcaccgaagtccatcaaataagttcacaacttcatacataacccaagtccatcacacaagttaaaaaatggtctaaacatgagaagtactagtacgtcatcaaactcacatcttccgttgacatcaaagagcccatgactcgggagtgtaccaacatttcaaaatacaatgtgaggcaataacacatcatggataatagtaagtgcactgtatcattgaagtacggagtacctctttttcccttgctgagtgggacataagttgtatgtagtgggctacgacgcctgaggcgcatcgggcagctgtgacatgccgatctcatcagcatccggtgcgatgtatagtcatcgtcaccggcattgtcatcatcatcattcaatccatcatcatcaaaatcctctagacattatcaatatttgataacaaactaaatatatctacatgtttgttatttttaccaaaaaaaaattgatatagctaaaaatagcccttataatgacaaagctaatggcgccgagctaatataataactcttaaaacattacaacatattatgggacagttggatgggcgtggtgtagttgtcaatgtatttgttgttgcatcttggagagctagctggttcggactcatcttccttgctaggaccagcggaagttttttttttctaaagtaattaagcaaacagttaatacgttaattcatgactgaaaggaatgaagaaaaggaaaggaacaaaagaaagaaaaattgaccgaatttctgacctttgtgccaaatttattttttttagataatggaatgaaatagcatcccggcctttactcgaaagagctacagccaattattacaaactagcactctgtaatagtgaagttcaaatagaagcaaacacaccaaccaaactagacaaaataacattattccagtctattggtaaatctccatccatgattggcaaacagttgcataaccgtcgtttcaaccttacgacatgcaacaattaagaaatctgcatcttcatcacacttttgtaactgtgcccatagacgaagccaatatgttgccttgaaaatgacctgcatataagtaatagtaggtgatttatcaaaaaccctatcattcctactcagccacagtgcccaacacaaggcagaaactccaacaagtatcagtttgctctttttgtttatgactccctgaagccaatcataaaaaatatgagatatgctagtaggaatatataaaccaaaagaaaactgaactgccctccaaataaactttgcaaaatgacaatcaatgaacaatgttggatagtctcatttttcgtacaaaagcaacatcttaaattaccagtccaattccgtcttgctaaattatccttggttaacacaactcccttaagcaaataccacataaagatcttgatcttaagcggcatcttgagtttccaaattaacttatttctgtcaatgtaaccattattaattaaggctaagtacattgatctaactgagaattggccattctgatgatagttccatctaaaataatcagaagtattattcaattgaatatgaacaatagatgcacacaattcatgccaaagtgttaaattctgaccaactaaagctctcctaaaagaaacattgagcggaacagaagtcatcacactagcaacagaagaacttctcctactgacaatagcatataaagatggatacttttctctaaaggccgtatttcctaaccatctatcttcccaaaatcttatgtgttccccattattcacaatccaagaacccatagttaagaaagttttttttgactttcatgagtcctgaccaaaaatgggagtcaccttgtttcctgtcaacttgggttataaacttattataaagatactttctcttcaataagtcttgccaaacaccattttcatttattaacttgaacaaccatttactcaaaagacatctattttgaatctctaaattatgaaccctcaaacccccctattctttgggttggcaaataatatcccatctagtaagtctatactttttcttatggtcatctccttgccaaaagaaacgagatctataataatcaatcttttgaagaacccctttcggaatctcaaagaaagatatcataaacatagctaaacttgaaaggacagaattaatcaaaaccagtctacccccaacagacatatgttttcctttctagctgctaagttttttctctattctttgttcgataactttccaatcattattacacagctttctaaaatgcattggaataccgagatatttaactggaaaagaccctaacttacaaccaaagatattagaatattgctcataacactcctttgcctgaccaaagcaaattaactcacttttgtgaaaattaattttcaagccagataatttctcaaagatagacaaaatcaattttaaattctttgcttgttgtaaatcatgctctaaaaaaatgatggtatcatctgcatattgcaaaatagacaaaccatcatccactaggtgagaaaccaccccatgaagagatccattatctttagctcttttaattagtaaagctagcatatcagcaactaaattaaagagaattggagatagaggatccccttgtctaagccctttatgcgtttgaaaattattaccagtttgatcattaactttaataccaacatgaccaccttgaataaaagaggcaatccactcacaccatttaggagagaagcctttcatcctcaaagtctgttgtacaaatgaccattttaccttatcataagctttctcaaaatcgatcttaaaaattacagcacttttgtttttacgatgtaactcatgcaaagtttcatgcaaaatacccacaccttccataatatttctcccaggaataaaagcagttagagtaggactaattaccttttgggcaacagtcatgactctatttgtaacaactttggtaaagatcttaaaactaacattaagtaagcaaataggccaataatgatggattgtcatagcctcaacacacttaggtaaaa

SEQ ID NO: 79257 - DNA, 18094 bp, Oryza sativa
tttcatataaaaaattttcgtacggaatttaaataacgcacctaaaaatctttatcttcatctaatttttattggagaaaaaaatgggaccttcgtgtgccgtgggacggtgggagtagtatcatggcctaattagttgaccgagcgctcgacatccgtcaacgactcaaatcatgcgcgcgcgacgccccagttattacgcgttggcatgtcattagcggagtactactaatttacacttagctctaattcatggcacgtacttacgtgatgtgaattgtgagatgcgagcgtgacgcggcgcgccatgtgcaatgtgatgcgtctcgctcgctcccctcgtgacgatgctggccgcgggggggctctttctcctgagatcaagctgagaaagaagataggcgcatcgccgtcgcgaaatcaatgtgggtgcagtgcctgtgccgcgggggcgcgggggcagcggatcggaagcggttgcgaaaccgaccgatcgagagcgtcaccgtcccagatcggggcgcgggattcgttgccggaagaggggggagccgcgcacgccacgccttgctccggtaatctggttggcaccacgccgcgcgcgtgccgcggccgcgagcaggagctatagggggctggctagtgaactgatccgtgagaaaaacgtaaacctcctcccgtggttttttccggggagaagagacaacggccgtggtctgggtgtgcatacggcatgtgccgtccgttgcaccgggcacggtcgacgggtcgaggcggcacatggaggcgtgcagtggagaaatttccacactggtctgtggacgacgtgctgtgtgcacaagcacaagctatccctacccgtactattccaagtccataaagtagcatggggttaggtagcaggaggccttggacagcgacaaacacgcccgcaaaaaaggcacagtgtccgaggcagccaaagcggtggacggacggagcccggagagcaaggaaaaaaagcaagccctcccaacgtttctcacagtttgtgtcgagccttcgtacgtctctctgactctctctctctcgtctccgtgtccgtggtacgagatgggagagagcgtgagaccccacacgtgtgggccctcgccacttgaaaacttacctttagagcatgtacaccggttataaccatatatcgacaagaaaatataagagaaaaaaagtcgggctacagatttgtagccggctacaacacagactccaaaatgttacgtgtgtataagtggtgggaccgggtattaataatgtagtatattttatagttaactattgtataaaataagctattagattggctatagatattttagagctagtagttggctgtactatttaccctgctcttactccttgggaccgttagaaaacttccaagtgacggctgtgtgttcagttcgctcagttgcgctgtgtcaagtggcatgccaatgtcacagcctcgcatgtccaatgcagtttaattaaacggcagattactatacttataacaactttcatactagtaaagcccatcagcaaagttttacagaggtaaaatagcaagaaaaaaagtcctttagaaaaggccaagttaattatactgtcgtaaaagaccaggaaaagaaaagggacaacatatatacaactatagcaaacgagccagtcagagacagtcatagaatcatactgacatggtcaaggagatttttataacccatcactttaactgttttacagccttcaaccgccttatcctcaaagcacacagcgctttacagcatccaaagctctctccctccctcactcactcgccaccttaatcaaaccaaacccttaattaagtacttaattatgactaaacaaggctcactcccccgttaattagattaagcagcaggcttaaggcgcaattagctagcatcccttgggcacgaagccgaggcgctggccgtcgccgtcgaacaccacgcggaagccctgctgctggatgttcccgatgatggagacgccgccgtcggtgccggcgaacgcgaagcagaaggtgcccctcgagtccaccgggatcaggtagttctccggcggcagcgcggcctcggcgccgccggcgaagtgcatcgacacggtgggcaccttcaccaccttgagcccgctcaggtcgtagcacgtgtcgaacagggagaacccgcccggggagaggcggaggcccgcggccgccgcgcggaacgcgtcgcgcagggcggcgtacgccggccgggccaggcgggtgacggacgtgccggagtccacgatgacgccgccgcggcctgtggacgggtccaggcggaggtcggacacgggcacgcccgggacgcgcgcgccgccgacgctgatgcccatgagctgcacgtagtagaacgtctccatcctggggttcttcaccatcggggtgaaggacgcggcggccgagggccccacggcgccggagccgaacgtgacggtggaggaccgggaggtggcgctggccgacgaggaggtgcggtccacgaggcagtacgagaagctccgcccgaagcggcgggagatctgggaggggaaggagaggctgccgcggccgagcccgaggagccccgccgccgcgacgaagagaccctcgttgtcgtggccgcagccgagggcgacgcgcggcacgcgggccccgctggcgaaggtgagggtctccgtggcgaagtccccggcggtgacggagccgtcgccgtaggcgacctggtagaggcaggccttgcggcgcaggtcgcagccgccggagtcgagcctgcggcagagcggcgcggcgcagtcgacggcgccgtacgagtgcgaggcgcgcgggtcgaacatctggccggactggtcgtagcaccggcggcagggcgcgcactggagccacacgacgtcgctgccggtgtccagcaccatgagcgccggcgtcacgggcgtccccaccccgatcttggtgaagtactccccgctcccctgcgccagcccggacaccaccggcgccacgaacccactcccgccgccgccgccgccgacacgcgtcccgttagccgccgcagcaccccccgcggccgcggagatccgcgacgccctcctcttgtcccgccgcaaccggtgcgcgagcagctcggccgcggtggcgttcaccgcgaagtcgtcgcggtggaccacgcgtagccccaccgtcgacgcggcggcgccgccctcgtccgcggcgaggctcccctggaacagaccgtcatcctccacggcggtggcggtgtacgggtgcggcgagagcggggtggcgacgagggtctggtacctgacggcctcggcgacggcggcggcatttggcccgccggcgatggcgaggagcaggaggagaagcgcggtggcgagcaaagacggaggaggcgccatgagcagcagcagcagcagcaagaggtgtgaagtgggctgggcgggtatggacggctattataaaagaagcggagttgtgcgcgagtagaaaccattattccaggagattagattaggcggaggtgattactgaattaattaagcagggtttctggctttctgcggcgcatgttccggtggggcagcggcagcggcggtggacgggagggagcggaataaatgttggaggtgagctactagtgactagtgcggttttgtctgattcgttcgcagccggcccacgagccggtgaacccggtggtgcggtgcggacacgttcccgtgctcgcgtcgtcgtcgcagcggcgcgcctcagctcagcaccgccagcgtgtgatacccctgtgccacagtgccagcttgcgctcctgccgcggcctgcggcgacagtgtgacgaatcgcgtgtgccggtctgggggcatcgattggctgtgcgaataaaaaccggagcagggaggcagcttccgatcgaccacctttccgctttcgcttcttttgaaactgtccaattttctgaaaaatcttggaactagttgaaactccaaatacatcctacagctgatgctacacgttctctacaatccaaatacaccctacaccgtggatgatgtttcctgtggcacgtgataccatatgttacacgttctatggatgtttcgctgaaattgtgtaaaccaggcctgcggggaacaaggcctcggtggagaattccgttggaccaaggagttctatatgggccatattatgagattttgatggcccgcgacaatcattttgggctggaataagttcactttaggtccctcaatttgtcgccgagtctgaaatttattcgtaaactgaaataccaaatataacgggtcactcaatttacaaaaggaatcacccgatgtcctaagcagtactatgttcggcttttaggtaacatggcaaagctgagtcggtgcgggacctatgtgggacccacatgtcagtgactagcattgtctttcatcctctcttctctctctcccctctcccctctcttcagctctctccctaatcctctccaaggcctccaccatggcgtgtatcacgaacccatccagctccagatctaccaccagaggccgtgggcgtatgtcagcaatgtgggcgacctccactttccgtagcgacaccaacgatagggcaccctccacttcccgagctactccaacgtgctcatcatattgagcatgttgtccaccacctagaagagaagcccaatgcagcgcgcataccgtcggacgctgtccaactcggcctctgtgcccaaccgacaatggtgccggaaacggctgtgtcctcaaggggtcatgtcgtctttgcacatgtggatgtactccagcatggcgaggctaacgaggaggccctcgctctccttattgactacctgtccagcggcaactcccctggtgctgaaggtgctcccgagttggcgacctcccgtagtgtgagcttcgcaaggacaccgtggtcgccgcagtcgtgtgacatgtgctcgaacgcgaggacatggagcacttcctggcgagggctcgggcctacgccgctgacaagcttcggagcaccggagatggagctcggtggcccaaattggagggagggtcgatgagctccccgatggcggcacggagcggtgggttgccgccgcgttgagctcctcggcagtggttgatgcggcctcctccggtcagatctggccgctccctttctgttcccctcctcaccgcctctcttccgatccactctctcctgtggcgcgtgcagtacacaaaagtgtgggcccaatgcaatttctaacgaggtatctgtggcaacatttatctccgcattcttcatggagcaccgaaatactccgacatggaggaaaatctccgacctagcctcctcaagttgaatgccacgtattgcactgtgaaagccccgagagcaggacaagcttcgtactcctaaaacttttccttcctatacaaggccttccatgttccttagagcaagttcaatactatagtctactactagctccaattcatatatagctaatctaatagccaattcatacaatagtttcttactatactattaatatatggtcccacctatcatgcacacactgcgttttggagcccgtgctgcagctggctacagatatgtagcctgctgctcttctctcttactccccccgtcccaaaaaaaaatccaattctagagatgaatctggtgtgtctagattcatctctagaattggacttttttttaggacaaagggagtatcttttatcttattaaaatatatttataactagctaatagcatgctattgtacctgctcttagagcaagtttaacaacgcagccggccagccggctgcatgcgtcgctcttcgcccaccgctgcgccggctgcgggcggtaagctggcgttttgatgcagcctggcccacgaacagagaggcaaacaccgatggcagccggcggtgtgtaaaatacccgcttttttctctctcttcctctctctctcctccgcgtaggatttagcctgcttatagcctatcataatacttgctcttagcaaaccagatcgtgtcacctgctggggttacctgtacagctatggcgtcgtgagtcgtgactcgtgagagcagcggaattcaaaacgcaaaaaaaaaaaaaaaaagaaaagaaaaagaccctcgcttccgtttcctcctctcccaaactcgcctcgcctcgccttcccgcccgccgccgccgtcgccatggatgccgccggcgaggaagggggcatgacctacggggaagtggtggactacttcaactccttgcaggacccgccggcgcaggagcgcatcgactgcatcatcccctacctcatctccctcctccccgcgcccttcgtccccgcgccgcccgacgccgcctccgccgacgactccgaggacgaccacttctccttcacctcgtccgacgactactccgccgccgaagacgcccgctccttcccgtcgccgccgccgggggatggcgaggaggaccacatcagccgcctcgcggacgacctcctctcggagatcatctcccgcctctccaccaaggaagccgcgcgcaccatggcgctgtccacgcgctggcgccgcgtgtggacgaagacctccctcctcgtcgacgacgcgcacctcagggacgccgacaacgaggtctccctcgtccgcgccatctcccgctgcgtggacgcgcacccgggccccgtccgctccgcgcgcatcacccacgtcgccttctaccaccacgagtacgcgctccggcgcctcgtggcgagcctggccgacaaaaacgtcgaggacctcatcctcttcaaccgcccgtggccgctcaacatgccgctccccgacgacatcttccgctgcgcctacctccggcggctgtacctcggcgcatggatgttccccgaagtcgccgctgccgccttagtaaacctccgcgagctcggcctcttccactgcatcatccccgaccgagacttcgacgccctgctctcgctctgcagtaagctggaggtgctctccctcgccatgtcgtacaactgcccgtcgcggctccgcatcaagtccccaagcctccgggccgcggtggagtggatgtccagcctcgacgagattgtcgtcgacggcgcgccatgcctggagcggctgctcctccaccacgccatccccgtcgccgagcgtacgcccatcaagatcgtaagcgcgccaaggctggaggtgctcggcatcctggacctccagctccacgagctccagattggcggcaccaccatcagggtataactccaaactgttgtgctctgcactttgcaattcagttcgtgattctgcaaccaaacaatttcctctctgttgtttgatttgttgtattgggaatgaaatggcagcctgggatgtggatgtttgtgaagtctagcgccaagctcccgagcttgaagatacttgctgtcaaggtgtgtttggcgatcgaacgggagatcaagctgctgatgacgctgctcaaatgcttccctcacctcgagactcttcacatcaaggtagttgttttagtacacgcggttagcacctgcaagcttacttccactgcattcttctactagtcaaataccaattctagattagatcgagaatataattagatagtagtaccatgttattctgttaatttgcatcgtgtagttgatttgcaatgttcattacttctggttgatatgatagctttcctgattgataagctaagcaaagttctgattgttgctttgctaaattgcagtccattcctccatgcgcatcacctgaaatcgcgaattgcgcggatgtttgggaatccctgggttcctgcgaatgcctcaagtcgcatctcaagacagtcagcatccaagggttccacaccgagcgctatgaggtgttgtgcctcaagtacctcatcttggagggggaggtgctcgagaccgtggccttcttctgcgaggataaagtgtgcttcgccgccaaggacgacgaggcggtggagatcgagctgatgtttcccaagaacctcgtccaagatcgctggagcttccagagcgccattgatctgtctctcgacgatcccttcttctacgccgtggagagctgatgggtctgtgcgtttatggtgtttttgtcatccgacatagatgggttcacaaatctatggatgtagcactgacatactaaattcttcagaaattaacggtgaactctggatgctaatttagtactagttgttaggttctgggttgcggaagtactaaaactttggtgcgtattgttttgggccaaaatccacaatcctgtctcaatttgaagttgttcaaaatctccctgctgaccgccagatggaacctctcctgtaagcatgttgtttgataagtctagctttcggtttcggatgtgttgcattttacatattgatgttggaatggtgccagtctgctagatactccatagaattgttctgaagagcaagcacatataatacctctgttgcaaaatctgttaagttggtagtttccctgataaagagttcctggaagagtcaacgtaaatggaattgttttgtactgggcctgataatctgtttttgcaaaggtctatcgggtgtgcgtgcataagttccagtctttctggtagcatgccggttagttgattgtttgaaagatccaaaacagtagctccagaaacaatcagggactgagggtgtgtttagttcacgctaaaattggaagtttggttgaaatcggaacgatgtgacggaaaagttggaagtttgtgtgtgtaggaaagttttgatgtgatggaaaagttgggaagtttgaagaaaaattttggaactaaacttggcctgaatcagtaatactttcatttgaaatggcaagaatctgtatgccaacttgtgatcgaagccaaagttgggattcttgtccctaggctggatgatcggaggtcagccattgccagtctgaatggaggaacccagtctgaactgaatgtcttgtgagattattatcttgaaaatctaggtcaagtttgtcagaagttccaaccagtctgggaggcttccgtagaagttgttgctaatggcagacgatacgaatccagacagacatgatacgtctattattaccttcatgttgcacaggttctttaaaattgatggtttttcacctgtaaggttgtttccagacagatggattccttcgagggctgtcatgtttatactagattgctatattttgaaacaaagggatcggagtagtagcacctgttcactgccatgattacctctcttaatttagctttagctttctctagatgacacaagcatcatggcaaagatgttctttttaacggaaatcaatcgacctctacatcaagatgtatccagctaatcacgtcatggatgtggtacgattgttacatgatactgttatcttttgtatgaaatacttgagatcaaattgatgaaatacaacatctaagccatgtgaagttgctacgaaattactgtgagccttcaactgtgattaccctcacttccattgatggccttgaaaaactgttcacttgtcatgcaaagccgcacccaacaccttccatggctgtactatatctaacacaaagggggaaaaaggctttcttgtgaaagcttactgtgtgctgtacaggtgtgagtgttggaattaatgaatgggccttagcccactcgaagattaattctttggaaaatcacaaaagcccacctcatgggatgtcatgcatgtggagtttagtaccaccttgcttattctaggagagggggacctccttaaaagggatgatgccctcctagtcgcttgaagcatgtgtggtggagagaagaggggaaacacacgcgcgcgctcgcctagcctcgcctcgcctggcagggcaggcagcgcgcgtgcacgacgtacgcgtcgaatggtccgaaaaattggctcctcacccttgcgcagatgcagcctccttttgcagttttgttttgttgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacatgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagcgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagtatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttaacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatgaattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccagacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcagaattttgatatgaaagatttgggagtagctgatgttatcttaaacattaagctaattagaggtgagaatgggattacactcttgcaatcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacagtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcatgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcatgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaatcgctggtatataaacagtacattggaaaaggcaaatctcagtgggattttgagatttggtgggggattgttggaattaatgaatgggccttagcccactcgaagattaattctttggaaaatcacaaaagcccacctcatgggatgtcatgcatgtggagtttagtaccaccttgcttattctatgagagggggacctccttaaaagggatgatgccctcctagtcgcttgaagcatgtgtggtggagagaagaggggaaacacacgcgcgcgctcgcctagcctcgcctcgcctggcagggcaggcagcgcgcgtgcacgacgtacgcgtcgaatggtccgaaaaattggctcctcacccttgcgcagatgcagcctccttttgcagttttgttttgttgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtctagggtttgcctcctactctgtactgcgccgtcgctcgtagagtactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacatgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacagtgagcatctgctggtcagtgatgctacattttgaggcatcaactcatctcctatatggctgtttccctagtcaacaatgcacgcaaggaacaaacattacatgctagaagtgttgcaaacttgcaatctagcaagtagcaacaccaggtttcaggttaggcaaccatgtctgcttcgctgacttctgagtgaatcacaaaacttgggaataccatggtgaggtccctaaagaatatcaccaaccaataataattagttaatgcgcaatacatatgacaaaaacatgactatagtcaattgtgattgtgaagcccattatcatcctttttttcccccaatcgctatcattgacaagcgtctgattctacgttttggcactgacgagtgcaagttctaagaaatattgttgagtataattgctagtgtgactccaagtaaaaacattctacatagcagagcaactctattcatggtggtagtaaatttgtgcatagcacttacttgaggtatgggagggtcatattcctcagcacatatggattatttttgacaaactcattccactcctcctggtctattctctcatcgccttttgtgtcagcctggtcaaatgtctgtttttgttttttttttgtttttaaaaagacttagaacaatacagaaggacatatttacttggtgttctagggagttaggacccataccctatcaacaatcatctcgacagcatcacttgtaatattcaaatctgattcatccagaagagccaacaccatctcctttaactacaaaaaaaaataaagaatagcaaagagaaaataaaatcagcagagttagcatgatttcattgctatagacgaggggagaaatgattaaataccaaaatagaaccaaagtttacacaacaactcttagaaatacaaacaagcataacttctctcatgcaattacaaacatgttatgtagctgcccaatctgttaatttgtttcactaagatgataattttctaggtaatatctatacctgacaatatagatatctgactgtgattcagtaaaaaaaagtgctactgagcattaaaaagtatatcaaacggtgctcaaatcaattttctggaactaaaagaagagaaaagtaacacttacctcatgcctttcaataaaccctgtctgtcttaggtcatataacttaaatgcaactgcaataagaagttataacattaattagtgaaagcaaatgttcaaatctaaacatctatattcttatgcccgacatgtttttggtaagaataaacaattgactgaagagtccttacatccagctttctgttcctcaggtgcatctggatgaaacacactaagagatcgaacaaattcatcaaattcgatgacaccatttcctttttgatcaaacaaatcaaagacctgcgattattttcaaacacataaatatttactgataatactgaatgccaatacattcaaaattacccttttttaaaccggaagcctgtcatgtaaaatctattctatttgttagtttttaaatgttgctctaatgcgcaagagagaaattacactgcttcaggccacttatatggattcacctttaggaaggataacatatgagtgttgatggtggatgactaaaaacaatgagcacaagaatgtaaagtgggaatcttttctacgatttatataatgatatgcagttctcttgcatactattgtgaagtagaaagaatgtggactgcaaacatcatttggacatattaattcaaaaagaatatggagaataaatattattatttttaatataaactgttagcactgaagaacagaggaatcatcaagaaaacctatacaatgacaatttggaacatattaacactcttaagtcttaccctatcaacgaagagatttgtcttcttgttcctaaagagagcaagatggaattcttcctggataagaaa

SEQ ID NO: 79258 - DNA, 963 bp, Oryza sativa
cccccccccccccgaatttttttatttttcttttatttttttgatattttttgcacgcttagggacacataagaaccaaccatagaaaaaatgaactcaaatggacgtaatatgtaacatgtagaatttttcctctcctctcatatctctccgaactaatgcagaggagagagatgtgcaacttttttacttttattttatttttttgatatttttttcatacttaggaacttacaagaaccaaccatataaaaaataaactcaaacggatgaaatatgtggcctgtggaatttccaaagctctaccgaaaaacttctctcctcgaaaacacaatcttgcaagcagaattcggaggttttaatatcgccgaacccggcgaagcgggggaggatcggatgtaacattttctgtaaatgtccgtggatatattatttgcctgattccgagtccgtatgagaaagttacgtctattttaataaatgacatattttgtccgtttcggtagagttttggaaaattttacaagtctgtttgagtttattttttatatggttggtttctatgttctcctaagtgtgaaaaaaatattaaaaaatgaaataaaaataaaaaaattgcatctctctgtactgtttaacttatggctatcatttcatgtggttatattttaaattagattaagtaattttatatagtgatagagtgcattatgtgtaacatgatgatcaaagggttttactaaaggagttatggtctaattttagtgaaggtgcaaagtagactaagtgatatgctagctattttcagacttagctaagtggtagttcgagtttaattttttttttgtggttagttgtatcgtgatcctaagtgtgaaaaaacattcgaaaaaataaaataaaaatgacaccattgcaactccatacagagaaacaggaatggaggcgaggggtggggggcgg

SEQ ID NO: 79259 - DNA, 94612 bp, Oryza sativa
tcacatcctccaccgtaggcggggagtccggtggcgtccgccggcgccacggtagtagtgacgtcgtcggcgcgagtaagcaagagcgaatgcggcggtctctgcggctgaggccggcgagcttcaaggataagccggtgcccacgccgccagaaggagcagaagcagccatggccatgggaagaacgccgccgccgccgcaggccggcgtctccggcgtgtcgggtcgtcgtcgaggagaatgtgatcaaaggtgttcgtcccgtcgccgccgagtggccatggcgcgcgcgggaatctgatggtttaaatatgttcctttactcaaatatattcttgtctcgcatctccaacttagatatattccatctgaatcacactgtctctgttgttattcggggaaaatctatagttcaaaccacaaatatgatgtaaatcgtaaaacttttactctcgctaaaacttaagtatcagagtagtaaatattttactttggatgatatgaacaaatcttagatgtcactttttcatcatatgtagagcctgtttactttgatgaaaaaaaaaaaccttaccaaattttggcgttgccaaaattaccaaaatttggcaggatttcttatatagttatcaaaatttggtagcaaactaaatatagctatttttttggcaactttaccaaaatctggtaaggttgaaaatggcatcaaaagtgaataggcccgtagtttctaggtttgtactctatattttcctctatttttcaacaacatgcctttatattctatcacacccatccctagaatacattatttttagctatgcacctacacatagaggtagagactagagagtggtctaaattatgaaatataaaactaaaacaatgggtatctttaaattttatctaattatgttacggcacataattagtttgttggtatttattttatgaaaaaaattaagttacttacatttttcactgcttcgaggtacaaaaactatccttccacaggtcattcaaaggaattcggatcaggtgcagttgcagtagtaactgcaacttagcaactgcacgcaacatcggccatccatttttgcgatcaatggtcttgattcgtagctacagtaaccatgtgaacagtaattcgtgctacagtgtttactgctacagtagtgtgaacagtcaatacgtgatctaggccgtccagcttgtatccaacgatgcgtactgctactgcttagggtgcagtcactgactgcacctgatccatatcccattcaaagatgataaaattatccttaccagtgtgtacggacggccctgttcgtttcttctaaaagtagaggatgaaaatttggattttcgtggcacgctttttaaatcgttaaacgatacgtttcgtgtgaaaattttcaatatgaaagttgctctaaaatatcatattaatctatttttcaagtttgtaataattaaaacttaatcaatcatacgttaatatcactttgttttacgtaaaaaaaaaacttaatcttcatcttcatcttcatcttcgttttatgtatgatttttgattatgtgcaaatttcaaaaatcaaacgttggtgtggctaaagaaataagaacaggtgcgtggcaaaacaaattggtgacttttgacttttaagagacgatgtgataacattcatcgaaaggactggaattacattgagtacaaaaaagaaacaggattaattttgaaaaagaaaagcagacagggcttgcagactgcaattacacctcatgccaccacacttgcgtggtgacatccaaactggaaaacaatctctaaattacaacggtgaccaaaagcaaaggaaatatattgatgcaaattaaaccgaacccgctttcatatgctagatcttcttgttaaccacacggcagttcttgcggatttctccgtcgtaaccagtgaggggattgatgttccccatcttggttatcgagttcacgtagtgctcgaagaacagcggttcgttttctgcatagcttctgacgagacccgcgatctgcgggtctcgtcctgtccacagaacttcatttgaattgaggagccctcttccctcgatcagcagcttgtaataggtgttgtcgaatttcgaaggggtagcaaactccagtgggcgtaagttgttgtcaccgccgttgcgtgggcatgttgaggccagtgtggagtagaacattctctctagcgttttgtcaggctggttgtctctgtgctggttgtagagcctctgcttgaagctcacacatctggccattccaatggtgtggcttcctgtcaatgcagaaaaatgtatgtatttgtttggtgagaaaaatattattagttgtttcaattatgttaatgcaggaggatggtttggattagcattttaattatcccagtatgactagagctacactatccttatatttgttgttcacttaattttctggcaaatttcattgctagttatgctttgtttcagtgtttttctcatcttttctaggttcttgcagtactttgaaagattaaacatgtgacaagaaactgatgtggagaacatgtacaaacaaatctattttattccgccggatttttttttactacattaccttaaaaaaaatctagtttcaacactgaagaggtggaattaattcaatacctgacagtgccacaaggtccaccttatccagtccttgcctttcaaagaatttcacaagacgatgcagtgtcgcatttggtggaggaaggttcttgtttgctaatttcatatatgctgcctttgaatccttccttcctagtggaagttcccagtatgggccaccgctctgtcatgagataaaaaccattaaatttcatcatgcttgtggtagataattttaaactgaggttagaaacattatttttacttgaaatgccagtgttatatatacatctacatccaaacaagatgaaccaaagtattgtagttgctttcaaaaattctcttattgtgttctcttgaaaaagaatgaagtctatattttaaacagatgaatgaagtttttttttttaattttaagagcagagatgtttaccagaactgttgaacctctcgcagctagggcaatggtgtcagcacaagagactgtgtgtggacaagcttcttcaagtgcagccttgatctcgtctataacttcaaatcctctaatagaatttttgttaggaatagcctttttctcgctcacgaattcttcactgtcatccaacaaaaccgacgcgtcgcatccctgaaatttcatcgagacgatcaaaaccacttctcatttatatcaatgagtgaacactgaaaattgtgtttccttctagaaattttgtgttcttttagaacaaggaggacacttgaaaatgtgctaacctgaacaaagcagtcatggaacaggagcctgagaagagaagcagcaatcctctgctccttggcaatagccttctttaggacagagaccacaatctcatcagcttgtgggcatgtagccttatagtaatctggagaaagaactggctttggtgggctctgcacaactgggtgaagatcctcatggtgagcagggaaagcaagagctacagtgaagcacagagaagcagtgaaaattgcagaaagaacagtcttggatgaagccatgatagcttctggagagtgagatgctgtgaatctgtggtttgattagttctcgcaatttcacttcgtatttatagaactcaagaactctcaaaatgttatagaactcatgttgtttcagctgcaacattccatttcatccactccactagctaagttgtggtaagaaaaaggaacatgcatggagttgctttgggtgtacctgatattctctactgcttgatttagaggctgcttttgtcttgtgtatcagttaccactatctgatgtctcataatgccttgccatgctaaactgacctgcctaaacccttttggtctcttattattggttccacttcaagaacaatgagaattttataatcgggctatatatatgtctttcttgtgtaaggcactacacataattgaggttttcactgctatggttttgcatttttggtgttctaataatacatgttgggaacagaaagtgttggcatttgttcaacctacttctctaaaataatccctggtaatataaatcgaaaatgttggaattagctgtagctactccaaatacatcgatccttgtaacacaactgagagagcttgagaagaaagcacatctacactttagtactaagtagtgtattaggacagctttggtaactaggaatttttaactgtttcatttcgtgtatatttatgcatgcatgacagagcaaaaagtttaaaatctcacgagaccctaatatatacactgaccaaatttagtgagaatttcgacacataacacattagttatccaacaaatgtaattattcagaaatgtaacatatatttcctttgaaagatccttgaccttatacaaacaatgcaagttaaagtcttgcactttaaagcccatgttaaccacaagagcactgctcccgtcctgcattttgtaccgcatggtacatgtacagcgtggtaccaaaacccatccagccgttgattttacgggggtaggataggaacaggcaaagaagcaaggcaccgctccatcctttgattttgcgcgacttctctcccgaatcagacgtgagacccgctgaccagacatcataaaccctagccgccgaacaaatgtccaccttctaaatcgcgccccaaatctcgccgacgtcgccgcccgaaatcacatcgccgccggaagcatctgccgccccaaatcacatcgccaccggaagcatctgccgccccaaatcacatcgccgccggaagcatctgccgccccaaatcacattgccggaagcaactgcggccgtagcagttgccgtcgtctgagtcgctgaagcagccaccattccccttaagcggtgtacatcgccggcggagaagcccttgcgatgcggcggctcaattaggactaattgctagggttaccccttcactccagcactcatcgatccagatattgtgaaaagacatcagtgctcttgcaccaaacgttttcaggtggtactgcgcaaaggatgcaaatggtaccgcgtggtaccgtgaattcctaaccgttagatctgtgcaaatcaacggcgcaaattttgtaccttgttggtaccgcgcggtacctcaggggtgtgctggacgataaaattcctataaccacaaggaaagtaagttcagacttgcagttgtgctgatcagtattcagtggtagagactagagaccactgtaaaactattcaaatccagtattttcaagggttgaatactactacctccgtttctaaattcttgtctttgactattactattccacttaaccgttaacacctcctaaatggttaaattacgatgaacgaaagattaattcttatataagttagaatcctacacatactttgataacacggtatcttttctttgggaaaaaaaaagacgagtggcaagttaaaatgtgaatagtgcatggtgacaactgacaagtttttaaggaacggagggagtataatacagtaaactctcatatggcaatacaggagctatagacagatctcgctgtctgaactgtgcgagactgtgtctgttaacagtagccatcacctggtcggtgctgaatatgcatcaatgaacagttaccactgttaatctgtttcggacgcctgggtagttggatcaatgaactataaacaaaatatactctgaatccctgaactttaactttcggccaaatgcaacatgttgctctgtccgggtttcagaatttttcagacctaagcttagagtgcaattcagtgcattggcgagccttggaatgcaaccattttggaaccccacaggtatggtcactcgctgtctcgtacagtgacgcgatgaatgacgattcccaattgcacggcctaataattaatcgatgaattaacctacttaataaactagtaattaactagccagcttctggagacaaattagaaatagctgcgcacgtacatgatcatgtgcgagtttcgttgctgtcttagcacgcaaatgcccggccttccaatcttatggagatcatgcataacacgaccggttatctgcccggccggggtgaagcagagtaatcacgtgttcataagcgtgcagccccatcgtttcgcttattacagcatatttacaaacgaaaagtagtttgtaaataaaacttttatatgcgtgttgttagcgatctaaaagcaaaggctgaaaaataaacttcgataaaaaatcctaaaattaacttcaaatttaaggttgaaaatttaaattttgactgataaacataagtataagcgaaaagataagaccaatggtttattgggtttatgcaggggcggatatagaattctagtagaaaggacttatgtcctttctcctcaagctctctcatactcttccttaattttctccctcttcttccctctctagtctctcttatctccttctctcaatggtgatccaccggggtagggggacttgagtatccaacacccacgctggatccgtctctagatatgtgagtatgttacctcgtatcaatcagaaatatgcttacatgtattaattgtgtgtagacaaaagagaaactgtagttcagtactcccttgtgctttccataaaattagcctattgttcgtgcgttgttataaaattttaattaataaaaattatcgctaatatgttattattgctattttctttatatatgcatcatctcttaatttgcaggcggcgctttataaaatttggagatttttttaccagctttaggtagtgattaatggcgcgtcggaaaatatggctacggctgcatgccggccgggcggcaagtggttcttggccgaccagtcggcgcaatcaattcaaatgtaggacttgacgtgagaaaaatactatatagagaaacataagagaaagtttaatactatagccaactaccactccaaattatttatagtcaatataatgaccaattcatacaatagttgcttactacactattaatatcttgtcccatctatcatacacacattacgtcttgaaacccgtgctgcagctggctacatatctacagcccgctgctcttctctctcttcttttatctctttaaaatatatttatagctagcttatagcctgctattatatatgctccaatgcactcaaactttcgacacaacagtatactagttaggcccacacactgctgccgctagctgcaagcatatgctacacgtaagcacgttacgtgcatgtccaattaagtgataattaggacatgcattcacgatcaggggtggatataagagggctcaagctggcctctactactgacacgaggatcatgcaagcttcccttacaaagatgggaagatgagcttgtagcttaattttttctagtttgttaagtctggattcatcactgttcaagataaaatgactagaacaatgttggcagaatattaaatgagttatcacatagaataattctccacaacatcaagacataatgagaaaggagtagcattaaatttgaatatgaatcaatagtgtttgcattagaaaaaaatagtatccagtactgattcataatgtggatatggaaatcatggctactttcttttattgcggtggcccttagctacttcctccatgcccatttaattgtcacatttgcaaataactccaagatctatgcaagaaacccttcttctttccaaaactaattctcatcgatcaacatgctgtgttaggcatacatgatacatgtacatgtggatatgcaaaagtgcaattgcatacatgggagacatgcaacgatgtcatttactcatgcacagataaacgaacatatgtataacgatgtcattcacttctacgcagataaacaaataaacattataatagatgatgattaattttgaaagaccttaaaaaatttatatgataattaaatgggtatcatagagtgggcagtgtgcatgcatgcatccatcattcactagtaaaaaacaatatttccagatggcccaaaagtgatttttgtgtgcagacctccggtctgtctgtccggaagggtctacgaaaatccaattttttcacaagggtggcgcgcccgcacacaaaaatcaaattttcacgcgcgggtgcttatgttgtccacacgcgaaaacaaaaatccaaaaaaaaacccgcacccgtcggccgctcgccgcgcacccgccgccggatccgggagggcacgtccgtccaccgctgccgggctcctcccgccgacttcgtcgtgctctttccgccaccgtcgtgctcctcccaccactgctgggctcttccattgctgtcgtcgccgtgctcctcctccaccactgccgtgctcttcctcccaccgctgccatgctcctcctgccaccgcccgatccgggcgggggacggccgccgccactggatctacgcgtgggacggccctcaccactcgcctgccaccacgtgcccaccggccgactgccgcgcgcccctcaccacctttgactcccgccgccccacgccagatccaccaccgcttgctcgccaccaccagatataggcgagggagggccaccgtcgcccctcgccgccttcaacgcgtgaagcgcccgctgccgcacgcccgggagagagagagaaagagagataggagtatgaggaggagagagaggagaggagataaggaggaggtaataaggacagagagagaggaggggatgacttgaaaaaatttgaagtgctaaagagggaaagatgaggtaactcagatttctgggcggacccttaagaagcccgtctgcgaaaatatatttttccgtgcagccatttaagaggcccgtttggaaaaatgactctatttgtatatacgactcgctaagagggtcgtctgtcaaaatagattttcgcatgcgagtcttttaaggagctgtatacaaaaatatgagtcgatttttaatagacgtggacttacgatttgtctgtaatctattaatctgcttattcaggaaaacttgtgacttagcttgatatagccactatttagtcatctcaatttggcagttaactcagttagttagctagctatggcaactaacaacgtgcatgcacgtacgaggagaagttgatcagatctgatgcattgcattggcgagtagttgatcagatcaacatgcgatcgatcgatagatgatcagatgtgctatcgctgtcaaattaaagaagaagagaaattgaagggttcgcaacttcaaccgttgccatcatcacttgattgatgatcgatctatcgatatatcgatcgaggtcatagtcacatggtagtactagtggaatgaatgttagttggataggtgatctaagcatggatggttccgttaatcgtttgttgacctcacccctctcggaaagttgactagctctgatagatctctactagctagcttaattagctaggtaaacgccttagttaattacagtagtttgtgtaacacaatagcacaaaatgattactatgtgcatatgatcgccattagagcatatcctatagcaaactataagccaatttaattaaacacatgtcgaggagataaaataagagagagtagcagcgagacacatatctgatgacagctgcagcacggactctaagacaaaatatgtgtataataggtaggactatatattaatagtgtacgtaatatatgtttatatgtaattattgtatgaattgtctattaaattgactatagatgatttggagtaggttatcggctatactattaataaacttgctcttacgtggctgtaggtaggctatactattaatcgcatgcagcactaaataattaattaacaaaattaagcacttgtaaaacttttctcgtgagctagtactccatctagctagatcatgtcagaagcagagtactctagtagttatatatccaatgcagtcagttttcctctaaacggctaccgtttaacggtcttgagctttggattagcacaagctaattaactaacccaaaactttaccacgaaactgcagcttttttacaaagaaaagagaggtcgtcgcgggaagatatatcgacaacaaaaaaagatataatttggttgggtttgatacaaccgacagcaagccactggagattatgaggctttgacctaaaaagagctatagttaagctagctgaacaacacatatgtgcagatgatcacaaagttagtagctggtatagctaattagctatgtctccatgcatttctcattctttctttctttattttgagagagagtcaatcactccatcagccagtcaggtcccatataattgacacctatactaatcaaaatcaaatttgagtcaagctgttatctctagagattccatggccggtctgatgctgtgtttagttgccggctggatgcagagcaggtgaaaaaggccgtacagccagatggaagcagacgagcttgttagttggagtggggccctgtagttggtacacttgtactttggccacttatacttgatcttgcacaattatgtacttctaatttggtacactagtacccctactactggtcatttgtactagctagctagcactaccacctttgatcttgtacttatcatgattcatgattatgcacttaatttggatttctcccatgcatgatacatcatgggaatttagggcaatagggttatggggcactatggttatctatgtactccagtattagagcatcactaatatatatggcaaagtgatccatatagatgggacccacataaatagtttatccctatggtaatgtccacaatgtatagataaaaggtattattagtagaagagagaggagtagagatagataatataatttatttcatatgggtagtccatatgcatatggtatcttttgctattttttctatatgaactagttgcacaatggtaataggtggctgaatgaaatattctattgcttatggactacttttacaccatattataaaatggatagctagatgtgatttagtttgcttaattaatgtaggggatgataagaacacaaatgtactatccacatgctttcccatggctcaatgcatgtctgccacatctttcctttctcgagaatcgagttgtaagttttaacaaattgatgtgacatggataaaatgagtgtgtcagagtggttagttagttgttgcaaaaatgggaaaaaaatgattgagcaatatattggagaaagttcattttgttttctttttattttttaattgtgcatgcatgtcacccctatacttgaatattcaaatatgattgagctataagaacattttcaaaagaaaaaaaatgtatgcaatatctcgaccctttagtagaaactttttggtattggtgggattagtcccatatatagtgaacttagataaattaatgctagtattagtatataaaccaacacactgtgtaatcataacacatattgcctaattttgatgattgagagagtgtcgttgtgtgtgtgtgtgttaagaaataaaaaataaaaggggtactgtacgttcgtagtattacatttctttcggttattgagctttgatatatgctactatggttatggtcttgtttggatcctctgaactattaaatagccatccgaaatcttgatatttagaagtattaaacgtagattaccgacaaaaccgattccataacccctaggctattttgcgagacgaatctaatgatgtatattaatccatgattagattcatcacgcaaaataacctaggggttatggaatgtgttttgccaataatctacgtttaatacttctaaatagcaagattccgaagggctccggatccaaacagggtctatgtcttatgaaaaaccaacttctgagttccgaggatgaactgtaaaatcatttatctagatttatctctagaagttgtccttttttttacggagggtgtatttattttgtttttttatttgaagttggttagttaaaaaagaaattaggggggatgtttttaatatactctagcaaggacataaccaaacatggaatcgaatctacccacgcgtcgtctttgactcttttggtcgatatacatgccatgcgacttgcgagtaggtacgtacaattgtattatatgttcactgttaatggatcctgttagagtgctagtataatagtagtatgataacattgaatatgttaattatcacctgaaatctgtttctgtaaaaaataatttcactcatcactatacgtgtatattgacatttttttttggataatcaaatttgtgccagctatatatatcttctaacttaggatattctgcataaaaacatatttacatccatgcaccaaattatcaagctaaggcactcatgtttcaactttcaaattaaagcatagagctgttttgacgaaattgcacgtgtttttggatcatttgatgacctaggtaaacccgagaatcagtttgcaaaattatctttgtgatacagaggttaattcgatctgtccaaggcttctgtttctgctatcgcaatagtaagctgcagacaattaaccataatgtttctacactgtaatgaggttaacttaattacccttctattagccacagatttttctaccttttcttttgcagcgtataacgtattaacgtggcatggcaggcttgcagccagtgtcaaattaatattcattcgcacgcacgcttcagattgcgtaaaagtgctaaatattttccagaagaaacgtggaaaagacatgcacaatagctcccttcgccagcaacacacacagcacttgcaaaataaggcagctaactaaaaataaaaaccaatttctcctgcctaactttcaaaaaaaaaaaaaactgtttagccattgaattccttggaagccaagggctagtcttaacagtcaacaaagcagtgatcaacttgccttaatctgtgatcaacctcctaatcccctatcattactaagaccttagacattcttagtataacattttttaggcttccattccaagggaccttgttaaatacttgctttgtttcataatacaagttgccaaaatgtcatgtatgctagtattggggaaaacatgagtaatttatagggctttggatactaactatatcttttcttttttccttaacttaagcttgcttacaagcagatggggacggggtttggtaaaagtataatcagaaaaatacattaagcaaccctctaaccaaatcatttattagtgttcaagtcctgtatacatcggaacaggttagcataagaaaccaatgtcaaattatcttcaatccagtttgaaaaacttgtgttggttagcttctaagaaatgtgtaggacctattcaaactttggtcttctcttgcacagtaagcatgactaatacattgcaaagatcttaaaactatatactaagttataactctgtaggaaggagaggaataggatacaataaaagtatcattagccttacaacacaacagaagtcaaatgagcaggtactcttgctcatctcacttttgtctcctctaaggttttggcagtagggatgccaaatctgtagcctcctttgaggcatgtggcgtgtgtacttgccatggtaatgccctaccacatgagttgtgagtacattacaacaataattactgggaccaaaataataggtatgatacaaacaaacatgaaacctaaaggcattgatcccatcaaaacaaaatatatattgtgttcaggcttaagagataaataatcaacacaaaaactaccatacgcaaaatgaagagagagaggttaatgtagatcaccattcagattcagtagtactacacccttccaaaaatatatcatttttagctacaaactttcctcgtcatggcaaatatgaagttttttttgggacggccgtattaagatgaaagctcctagatcgatttatgtcttgatttattcatcttgtgttcattgagtcaggtacttatgatataaaatcacatagtaataatgttctttaaaaaagagcctttttctgcactacatttgcagatctacatcagaacaagggttctagagctatacacgtagcatgcatacctgtgactgtctctgtgagcctgtgactgtaacaaccgccatgctgcttccttcaagaaacggccactgatatgtgcttcacagaagaacaaggctgccggtgacaaagccttggaacagttgaagaacctgctttgtgacaagaatgtaggccatgcaagacacctaacgccgaatcatcatcacgcaccgtgtgttgagagttggtacatggcacatctcgtttgacctgatcgaccgatcccccatctccatgcatgtgttagctaggatatcagcacctgtgttgtacaacaaaatgcaccatggtactacacatcctctctccgaccattgatgagccatcagaactcccagttgatttgatcgctgcaacaacatacaaaaggtaacttagtttggcagtacaattatacaaggacaacagcatatgaaaaatgttggatattatcctttgatataacgtttctactaataagtatacggaatgtagcatcatactttaaatgagccatcaaaaatgccagtttgatcgctgcaataacatagaaaaggtaacttagtttggtggtatctacaaggacaacagaatatatgaagaaaccttagagattatactgtgatataacgtttgtagtaataaatatacggcaatgtagcatcatacttttgatccccaaagacagggatacgaatccaagtttgatgaccaccaacaatagaaaacattcatgtgaatagtccagcatacataaggtattgcattaaacaaagccgtatgatctgtagtgacacttgtgtataaccaaagtagtaggattaaaacggaagcaaaaccttacttttgtctacgcttttgtgctttgtcagtttgatttcacacatgatgtgcaaattatcatgtgttttgtgaggttaaattttggatatggtccagggaatatatatatatatatatatatatatatatatatatatatatatatatatatatatatatatatatatatacatactagtacaacctgtcaggtgtgggcctactatgaggcaaaaaggttaaagtgagaggaacgactgatatatctttgtgcatatgcattgcctcattatggtaatttaaaacaacatctctaacgttctgatacaggagggtataatataatattatataatccatcaaaggtttcgataatgagtagaaagataatgtgtagtgtacaggggcagattatgctgccttctagtttttcatagtacaagcagttatatgaatatttaattggaatgcttatttttaagtagcattttctgtttcatcagaccattttatcctctctccaactgctaagcaatattgagcttcatttttgagagattatcacttatcactccatctacacttgttgacaatgacaagcattaaatcttcaaatgactttgctaaaattaaagccccaaacaaaacaataagacgaccgaaaagccttgcaagcaagttggagttactattagctgataattgatggaattactgaagcagttgagcacaatgcgtagctagctgacttattttatacgcatcaccctaacaacccaagctgccctgccgcgtctcatctcactgtcctctgctccaaaccacccttcctacatgcacccccccacaggtgctatatatgccaccccatgcccgcctcttctcgccacccacaaccaagagaagtagaaacaaacagagagcaattctcttctcctacctagcaacctagtgcagtgcagtgcagtgcagcgaaggtttacttggcgacttccatgggttgcctgttgatgctctgcttggtttctcccctcctcctcgccacctctgtccacggcaacccgtggtatgggtatgggtatggcttgttcccgcagttctacgaccactcgtgccccaaggcgaaggagatcgtgcagtccatcgtagcacaggcggtggccagggagaccaggatggcggcatccttggtcaggctgcattttcatgactgctttgtcaaggtactgtgatttctcttctgctgtagcattctttacttgtcttcacaaagctaatggtgctcggttgacatagcacctgcagtgtagcctgcaaaaacataattcaaatgagttgtatgcttagtgcaactagaaaggcaattatatgcgtttcacttgcttttgcgatggttaaatccatatgaaggtattgcaaatagtcatcaaaaatagagaaaaaaaagacatgtatttgcagatgcaactttagctgttacataacgaaaacgcaaagtgtaggagatcaaacctttgttatatttgtacctaggtattaaaaaaggtacccttaggagcatggaagaatctatagttattaggcaaactttttaccactgataagatagcctaccaacattgcccatgcgagcactactttctgccttggtgatatgatgagtccgtaccatgatttcttgattattcactttcttttcaaagagaggatgactatttaattcaaatgcacaataattggcgctctcgatgtttcatttatcagagaccttcacccagtacaggaccctaaatcaatatatattttgctgttccgttgcatgtgcctaatctatgtactacttccatgtacctaatctatgtaccaacattgtgtaggggtgtgacgcgtctgtgctcctggacaacagcaccaccatcatcagtgagaaggggtcaaaccctaacatgaactccctcaggggtttcgaggtcgtcgacgagatcaaggccgccctcgaagcagcttgccccggcaccgtctcctgcgccgacatactcgccctcgctgcacgcgattccactgtcctcgtatgtagcagagataagctctatcagaaccacacaaaagaatatcacattcggaaatagaaggagaaatgaactgtgtattattattatttctgtatgagcttagagaaaagaaccgctcctaggatgagctcaacagtgccgtgttttgtgactgaatttgcactcaaacctgcaggttggtggcccgtactgggatgtgccacttggccggagggactcactgggtgccagcatccagggctccaacaacgacatcccagctcccaacaacaccctccccaccatcatcaccaagttcaagcgccagggccttaacatcgtcgacgtcgtagccctctcaggtgaacttcttcttaccatcttatgagtatgtgcgtccatttcttgagagagatctttcttacattgcacaaaaatgggtgcatacatacaggtggccacaccattggcatgtctcggtgcaccagcttccgtcagaggctctacaatcagagcggcaatggcatggctgactacacactggatgtgtcctacgcggcacagctgaggcagggatgcccccgttctggtggtgacaacaacctcttcccgctagactttgtcagccccgcaaagttcgacaacttctacttcaagaacatcctgtctggcaagggccttctcagctctgatcaggtcctgcttaccaagagcgctgaaacagcggcgctcgtgaaggcgtatgctgatgatgtcaacctcttcttcaagcacttcgcacagtcaatggtgaatatgggcaacatctcgcctctgactggatcacagggggagatcaggaagaactgcaggaggctcaacaactactaccactgaggttgtcttgtgtgctgagttttacaaggtggtggtagtggcatgttttgtttaaataagtaaagctggttgtaatgcgtcaaggctgtttgatcatttgtgttattgtgattgcgttgcaaaacgtgtatgtttaataattcaatatataaaatgagttcatttggttgttctagatctggttgtttgacttaccaaattctgactctcgagtccgaactcatggtacatatccacctactcttcatgagttaccctagtactccagccgtgctagctttgacatttgtcccctgtcaaaatgatatgatgtagtttgtaagaaatacctacagttactcatgtagtcatgttgtatgctgtatctcaagaaatctcccagtccctgatgtaatcatagtctaaactctaaacatgacttgaccagtccctgatgtaatcatttagtctaaactctaaacatgacctgaacaatttcataataatcaccactaaggtatacaaagtatgaaaattcaaaaggtttgcaacagtaccatggaagaagtaaaccatccaatttctagaccaagaaatcaggcaaaagtgatatatttcagtgtatttatagccgtggactattaacagtctcatctttatttggcagctacagaacaacaattttcaaggatttatggccacaatgttttttttaaaaaaaaaatgaacttaactctatgctttttgatcattaagtttcagaacacctaattctacagccctacaggtggaggtgaccaacaggtagggcaggtcagcaagccagtaaactgtgttttggttactgttgattttgtcaaccttatgagttatgaccttaaaacacagaataatgtgacactagccaaattaaatacctgccgatttctactaatatggccacaaaacatatttgtgttatttactgaaagaatgtgtctggacatcacatgagtacattctttaaaagaagttaaaaaaacatagctcctctaaaggatgcatagaaaggagtttggctgacagtagctccctttctttcgtacaatgttttttctttaatcatagaatctttgtatgccattccctaaaaaaagaatctttgtatgccatagttgtctagttgaatacacccactaatgtgaagagaggaaaccaatgtcaattaagaaggaaaagacctaaatgccaaacatatcaactgaggttactagagttgaatgcaacaagatagacactgaatttcaggatcttgaacaatgtcaccatattggacaaacatatacacaacaattgaccaacatgaatgacaaaaggaaaatacatgtacccgtatgtccaccatcagaggccttctctaactactgaagtttggaacctaaggcattcagggtgctcatccaggttgcactgctcaggctgtaaagagagacaaaaacagttagaccataaaggttagataacgagtcaaaaggacacatcatttttgttagaagagagaaatgttcctgcatgtgatagttaattccacctttatgaaccctattttgccaactgacaagacagttcagtcatgttgacaaatgttttcctcacctacagaacacaggacagaagcaggtctaagatatctcgtggtttcttaagtatgcatcaccaagcttcagttatatctaaaagaacatgatgtacttacaagttagatgacactttgtttgccaatgatgatactacaaaccagcaatactttgctaacagaatgaactagctaccaaattcaactagaattctgaatcattgcttcaattgctttgttggccttaatcagttccccttttaagcaaagtgaagcgattgctggataatatgtgtcaaagtcatcatggaaagaattccgtagcaaattatcatagtaaatatcagtatcatcacttggtgtgcataaattctcagctccatctattgtgggttgaactgtgccttcagaaattccatgaagacagttgctagaaacaccataagtagttgaacataaaacttgtccaggattatccatattacgatcataagccacaggtgtctctacgttcttcaggtgactaagcgtgctacaattattagaatctgaagaggatacagacatgagcgccacttcatttaggatagtcacgacctcatcaatcctcccttgctcacaggcagaaaatagaaggccaacaaaagattctgcttggatcttatccccaacactgtttatgaactctgcaacttctttgcactgaaacatctctctcaagatgctcctagattcttccattcttccttttgcatagagtcctttgaccaggctcatgaagccaacaaaatctggaaccatctccttatgatagtattcactaaagaagcctaatgctgattcaatgtcaccttttaggcagtgtccattaattattgcaccaattgtaatagcgtctgggaatagaaatatttcctcaaaatgtgatataagctccagtgctttctcagttaacccgtagttacaataaccacttattagcaagttgtaaacacgtgtagtgggtttgatacccttggtggacattttctgaaacaactcatgagcgtcatccaaaaaaccttctctgcacaaagcagctataagtatagagtaagttaccagtgtcggaagcacttcactgctttctaggtagtcaaatagccggaatgcttcagtaaggcatccctgctggcacaaaccattcagaacagagttatggatgacaatgtttggctgaatcccttcttctttcatgctttcgcataggtctaatgccttctcaagataaccacttttacaaaggccttccactaatatggagtacatggcaagatccactgaataaccattttgttcagcttccttcaaaaagttgcatgcatccagaattctaccttccctctttagtgtgtatacagcttctcttagaacactgacaggaacacggccattgttcatgtaattggaaaacccaatagcttcaccaacactgttcttgctgaggtggcaagatagcatattaatcattctaggttcatccaggccatgaattttaatgaactgacttaataatggctggatggtctgttcatgaccatttcggagcaagcatttgagtagcctgtagcatgttttgctagttacagtaaatgatttcattcttagaagcttgtaaacatccaatgctccttggtagcaatctcttgtgcttaagaaagcggaagcataattacatagagatgaaaataagtcaatttcagatccatccaccttaagaatgaaattcagcacgccatgttcaccgccttctttaaagtgtgtatggatcaacttcttgtaagtacaggaatcaggccttaaatttctttggataagatcattaaaaatctgctcagccatgtttacctttcctccattacacaatgctataatcaggcaattgtgtactattgtagaggagaacaagatgtcttctttgtaatcatcaaacaactgcagtgccctgtcagtttctccaagtttacacatcatgtcaataactgtatgatatgtgacaatattaggccttaatctcatctcgggcattctaagaaacaagctgcaggcatcatccaccttcttaatcataaataatgctttgataagtacattgcatgtgacaacatcaattgtaacaccgctgctctcaagcctaccttttattgccattacaccagttgcatcttctaccttaatgtgaccatgtaacagcgtgctatatgtgaagttatcagcagcaataccttcatatatttcaacagccttcttggtgtgaccaaccttacatagaccatttattactgaattgtatgttacgattccaatctttatcccctttttatccatctcttcaagcaaagagaaagccctatccaaatatccctttttgcacaaattgtcaatcaaaattgagtaaacatattcatccaccaccactcctgtctgttccagtttcctcactatagaaaaagcatcatccaacctgtttctcttgcagaaaccaccaatcaatgatgtataagtgatcaaattcggcttagcatcccttcggttcatctcatccaagaatcccatcactttttccacactacgttctctgcaaagtccatcaataacagtagtataactaactacatcagctgcaatgcccttatctaacatcacccgatgctcacggagccctttcatcaataacccgctactcatgtatccatgaaccaagctgccatataaaacagcatcaccaaccaaccccttcccttccatctcccttaccaattgtgctgcctcagtagttctccctacacggccaagcacatcgacaaaagcggttaatgtgatcaagcctggctcaaatccattgaactctctcctcaccctcctatagaattccagcccatccccagccttcccgaccttggagaagcctgaaatgatcacgctgcaaacacgatcatccacctgacaccccgctgcagccattacgtcgaacaccttgagcgcggtctccatgtcaccgcgggcacacagcatcgtcagggccacacgatacgtggacggagaaaacacgagcccgcactcctctacgccggcggagagcacctccagcgcgcggcgagcatcgccgcgcaccgcgcaggcccggcggagcagcgcgtcccagaggcggcgcgcggaggaggttgccgggccggcgagcgcgaggcgcgctgccgcgtcgcgcggacgggaagaatctagaagcgccgaggcgaccaggaggtgggtgcgcgcggtggggcgcacggagttggcgaccgcctgcgaggcgagcgcgccgacgaggcggtgcctccgccggcggaggagcgccgccagtaggatgtccacgcggcgcggcgtgacggcccttccgagcttgaccagcgacgggagcggcggtggtggtcggggctcgccgccggcgagcggcatggcggagggtggtggtggtggcgccgccgccgcgtgggaagcgaagcgcaaacgttcgaaacgttggaagccgatggcgtgggccgaatttggatacgagcttgttggatctgggcctgaatagatatgggcttgtattggttctgggcctgtttggatatgggcttatttaagtgaggcgttttttagtccgaagcgagaaggggagaagaggaagatgcagcaagcgcaggcgtcggcggtggtggccgcgccggtggcggctgcggcggcggcggcggcgggggcgacggggcaccagcactagggggcgaggggtgacgccccgccgaagcaggtggcgcaggcgatggagcggctggggcgggcggggcggctcatcgcggacatccggctgggcgcggaccgtctgctcgaggcgctcttcgtcgccggcgacgcgcccccgcacagcgccccgcagcacgttgagaagaccgcgctcgccgtcgcccaggaggaggccgccatgcaccgccacttcgacgacctccgcgcgctcgggaggtaaacccatctccgccccgtgcccccacactctccgattcagaagtttttcatcgattccttaacctttgactgttacgtcgcaaaatacaactaattccctccgagaagaaccattcccgtcatgattccacggttgcagtctcaaaatgaaaaaggaacattcccgtcatgataccacggttgcagtctcaaaatgaaaaagaaatattcccgtcatgataccacggttgcagtctcaagaagaaaaaggaaaacccttgtctagataatttctggaaattggtggctgggatattgatttaacttctttggattgtatgattggactttttttaaagtaataatctccttcccagtttaggcatggcagcacattttttttccactaaattgttctgtaataatggttaatcaccataaactgatgccacactcttctttggtgttatccaattgcttgtatcttgtgaaacccttctacctatgaaaccttgctacgagagatgcacggacaggcttaactgctcaactttggtatatgaactttagcattctagaatattggctgggtgcctgggtctatcagattgggatgcatttctggaactcgtgttccttggcttgtaatagagcaatatttaaccttaattgaacagcttcagcttgaacttgttttggggctgtttggatcagggactaaaattttagtcccggtcacatcagatgtttaacactaattagaagtattaaacgtagattaatgaaaaaatccatttcataaccttgaattaattcgcgagacaaatctattgagcctaattaatccatgattagcctatgtgatgctacagtacacatgtgctaattatggattaattaggtttaaaaaaattgtctcgcgaattagctctcatttatgcaattaattttattattagtctacgttaaatacttctaattagtatccaaacatgcgatgtgacagggactaaaatttagtccctggatccaaacaccaccttagtgccactcagggctcgaactagttttagtatcactcgtggatggtaaggatgtagggtaggtgctcactctataatattgtctcagcagagcagttatgtgttgggtacaattgtttacatgtgaccacttgaccagtcgtttgttgaagaagtctgcaggcatttggaaaatccatgtttcatggcaacatggtactattctgtctgatgaataaaatgtccaagcaatatgaactgcttgttaaacgatggtttttgagtctttctgcaacctgaagttgctagataaacggaagatgaaatttgcaggtgatatagttatgattttagacagaatagttagtttgtgaaaatcctgaagttaggagtactagataagcttaagccatgtgactgagatttttttaagtcaaaggatattaggagccatcttcaataaagttaggtatgtgaacaggatggattcactcgattttgctggtgctttcttattgttctttcacagtattcttgttatagtgtttgggttagttgtgcttgttgctattcatgatgtttttactttgtgatgaaccatcaatcattgcttacacagttctcctggtaagttccaattatttttattgaacttcaagtttcaagttccactatttcttcataagtgttggcctagccaactgaaagtaaagatctagtttttaaactgtagcctaataaatatcttgtatccattgctgttaggaaggcaattggaagagtctggagttctaaatggagcccttaaagccagaggcaattcatggggcttgcacatgccacttgtttgtccagatggtgcagttgtggcatatgcttggaagcgtcagctggctggtcaggctggtgcatcagctgttgacagaactaggtaatttcattaccatcattgttgtgttgtatgtttgctgccacaatatgatgtgcttatttgtcttatttatattctgttgatgtgtgagatttcatcaaccgtgcattgcagaatgcagattaaatatttataccatgttatttcttcctgcgatatacgataattttcttggccgataaatttgtactgttgtttccctctttcccctttaaatttgtactgttgtttccctctttcccctttttcccttatttctcctttttccctcttttgtttcttcttttgcactttgctttctctaatccttctactatgataattacattcttccaaggtgtggagtgcttttgtaggaattgaagtattagatcagttcttgttttcgttgcatccatattttattttgattttacacagaatgcatcggaaatattccaacgcccttcattcatgtgcttctttagatgtatgtacttatgttgaaggcttcaagccttcggatcatcccctagtccccatgacaagatacccgaagtttattactatttacaaaaatgggttactatactaaacttaacagctatcagccacatgcgattgtacctagtggcctggcctcaccttttttaaatttaaaatttaaaatgtatgccgctgcttaatgcacaaattatttggcttgtgaacaggcaaggacatatggaatttttattatccatttatcatgtgtttataatgttcagaggtatatcaatttcaggtttatgctaacatatagatgtttccaggttagctctcaaggccttcactgaccagaaaagaaggttctttcctcatctagatgatgaagggtttaaccatctgcatgatggtgaacctggtctcgctaaaaagccaaggctgcctgctagcaatggggagcttgaagaaagaactttatctgagatactaaagaatctagaaaatgaagttcctaacatgaaaatattcacataccggcgtctggattggtcaaaaagagctgcatcattagcaacccttatgaatgatgactttgtggatccatctaaggagctgaacctgcaaaacatgagcaaatcgggatctggtgatacaactccaatagatcaggttgcgataattgagttgctagctccttctatatttagagctatagtatcactgcatcctgcaggatctactgatcctgatgctgtggctttcttctctcctactgaggtaatcatgttttccaaaagctaacttgttaattagtggtcatggatgcacaataccttttcttaatgttgacacatgaagtgaatcttatattagggaggaagttacctacatgcaagaggcctatcggtgcatcatgtttttaagcatgtatcggtaaatgcttcttctgtgttctcttttaatattgttttcaataagagggcattacggtgtaacgaatacactgttttttattatatgtaggagcatgcagataaagcattgcaatactttgtcagtgtggaaccaactaaatcactttctctgttgctggtaagtttcaacaagaattggtaaattgttcagaatagtaatccagtttttttcaaaggttcattaaaattatttttactcatcgttatttcctttattttgaacaatcctattgcaataacgtcacattgtaatgctaattatttaacatgttaacttcttgcagcgttggattgccagctatcagactctatttacaaaagtttgcaggtacacacacatattatatatctaacagatgtctcttgtactatcgtcacaattttacattccactacataagtaacactcttcattactttgcgtgcagtaaatgcggacggcttctgctgatggacaagtctttggctctgcttttaccccctgtccagcgcccataccatcatcagacttctagtgttggttcagatcctcaggatgcctatcacattggatgttcttcctatgatgcctgactcttctaatgaactctcgacttttagctaggatgtttcaattctgaggatatattgcctgacaaacatgtgcaagactaatttgtaatggcagttctagattctttttttccatggggttcctgcagtgtagctgttaattttctacatagaaaaaggcgtggttatttgatgagttactgtagttgcagtttcatcttggtagcatgcatttcaggaacagatggtgtaaaacttggaaaggtgctttgagtcattttttgtgaatttcaattatcattttggccctctttggaatgtggcattttccttttggtaacattttgtgaattttctaccaaattccaaagcatgttcttaataagtgatgcctgccgattaggccggtcatactgctgatccatggacttgaaacttcagtactgactttaacgtattgtactcaaattgcccagtaaactagtctcttggttggaacaaagaatttaagagtattttttccttttggaagagaaaatgcatccagtttttttctacatctttcctttactatgaaacttttatggaatacatgtgcttaaatgagtcttgctggggtctggggatcatttgatctgcataattttagtcacggggacaatgaaaggctagtgacagggaaagagctgaacggcaagaatcttactccctccgatcgtaatttgttcagttcgctggtactccctaatacgggatatgtaaagattctccctccgatcgtaatttgttcagttcgctggtactccctaatacgggatatgtaaatgttcaaactaagggtgtagctatatttatggcgccatatttttcattaaaaaatagtcggcatgtatttacattgtaagtccctaaattacatatgtaattttagtgtatttacaatgtaagtatcaaaattacatatgtaagtactaaaattacatatgtaaattcgaaaattacatactaattacatatataagtggggtgtaaatgaggtgtaactactgtgcaagtggctgaaaaaaaatcgactgtagcatatggcgccatatttctagcaaatccgatgttttatctcgagatggagggaatactttttaactctaggggtaataacgacttggcattgtcattctactcatttttaaaagttcttctaatgaaaatgtggattttaacaataccaaatttttgaaaggtgaattttggtaataaattgtacaggtccttcatatttatggcaagtttccagtcatatttttaaggaagttccagtcatgtttaggctgtgttctttactcctatctttccaactttcactctctcatttttcacacgcatgtttttcaaaaagaaaaactaatttgtttttataaaaaacttatataggaaagttctaaaaaaatatattaatctgtttttttattttttactaacaactcataattaatcatatatcactccatcgctcaatgttgcactagagatgaaagattctcaacccctgcaaaaccatgcagccaggtccctgtgttctctcccacgataacttacatccttatttttcgcttgtacgctttttaaagtgctaaacggaatatttttttaagtttctataaaaaattgttttaaaaaatcataataatttatttttttaagttttctttagctaatacttaattagttatgtgttaatgcatcactccgttttatgctcgaaggaaagaggtttctaacaccacatccaatagaacaccacctccaagagaacccagcccaaaaggcctatcatccacggcccacgtagtaggacaaaagctcggaaaggcccacgtggcgcaccgcctcacgtcgccaccgtcccaccgacttgtgatttccaatccctcaaatactgtaacgccacgtcgcccaacttttagtaacggcaccaatctttcccaccccccccccccccacccccacaaacctgaaaaacgccgtcgccggctcgccgccgggatggtgttcctccgcgcgccggacggcacgacgcgccacgtcgacctcgaccccaccaccgccacgctcgccgacctcacagcctccgcctccctcgtctctacctctcccaccgccgcctcctcccggccgtgccgtcccctctcctggcgtcccttcgggtctcgccctcctcctcgctgctcgtccacctccccctcctcggaggcggcgggatggcctccccgaccgcgaccaccccctcggcgcctccgccaccaccaccgccacccgcagcttgcgccgcgcgctacgacttcctcaactccaagccgccccccaactacgtggcgagactgggacgcggcgccgccgggttcaccacccgctcggatatcgggcccgccatggggcgcggccgtgggaagccgcctggggacgacggcgacggcgatggcggtggcgacgaggaggagaaggggtacgacgagaaccagaagttcgacgagttcgagggcaacgacgccggcctcttctccaacgccggccacgacgacgacgacgacgaccgcgaggcggacgcggtctgggagggcatcgaccggaggatggactcgcgccgcaaggactggcgagaggcgcggctgaagcaggagatcgagaggtaccgcgcgtccaaccctaaaatcaccgagcaattcgccgatctgaagcggaaattggtcgatttgtcagcgcaggagtgggagagcataccggagattggggattattcgcttcgtcgcaacaagaagaggcgatttgagagctttgtcccggtgcctgacaccctgctcgagaaggcccggcaggagcaggggcatgtcaccgcattggaccccaagagccgtgcagccgccgctggcgcagagacgccatgggcgcagactccggttactgatctgacagccgtcggcgaaggccgtggcaccgtgctttctttgaagctggacaggttatccgattcggtatccggtgttactattgttgatccaaggggttacctgactaacctgaagagtatgaagattactagtgatgctgaaatttctgacataaagaaggccaggttgttgctcaagtcagtgatacagacgaacccaaagcatccaccaggatggattgctgctgctaggcttgaagaggttgccggcaagcttcaggttgctcagcagctcatccagcgtggctgcgaggagtgccccacgaatgaggatgtttggctcaaggcatgccggttggccagcccagatgaggcaaaggccgtgattgccaggggtgtgaaggaaattcccaattctgtgaagctgtggttgcaggcagcgaagttggaaactagtgacttgaataagagcagggttttgagaaaagggttggaacacattcctgattcagtcaggctgtggaaatcagtagtagagcttgcaaatgaggaggatgcaaggctgttgcttcacagggctgtggagtgctgcccattccatttggaactgtggcttgcactagcgaggctggagacgtatgaccaagcaaagaaggtacttaacaaggcaaaagaaaagctccctaaggagcctgccatctggattatggctgcaaagctggaggaagctaatggaaacaccgagtcagtaaacgaggtgattgagagaagtataaaaactttacagggaaaaggattgggtattgacagggaggcatggctaaaggaagcagaagctgctgagcatgctggatctgtgatgacttgccaggctattgtgaagaacactattggcgttggtgttgatgatgaagacagaaaacgcacatgggttgctgatgctgaggaatgcaagaagcgtggttcagttgagacagcccctgccatctatgcacatgtgctcagtgtcttcaaattcaagaagagtatttggttgaaagcggctcagcttgagaagagacatgggactgaggagtctctttatattctcctcagtaaggctacaacatacaatcgacatgcagaagtgctatggcttatgtatgcaaaggagaaatggctggctggagatgtccctgctgcccaaaccattcttcaggaagcttacgcttatcttcccaattcagaggagatctggctagctgccttcaagcttgagtttgagaacaatgaaccagagagagcaagaattcttttgtcaaaggccagggaaagaggaggcactgagagggtctggatgaaatctgccattgttgaaagggagttagggaatgtagacgaggaaagaaagctgttggaggaaggtctgaagttattcccctcattcttcaaattgtggttaatgcttgggcaaatggaagaccggcttggtcatgtagccaaggcaaaggaggctaatgagaacgcactgaaacactgcccgaactaatctagaggagaagataaatggcttgaggaagtcacgtgctgttctcaccatggcaagaaagaagaacccagctacacctgaactctggcttgcagcagttcgagctgaattgaggcataggaacaagaaggaagctgatgctttactagccaaggcattgcaggagtgcccaacaagtggtatcttgtgggctgcagctatagagatggtgccacgtccccaacgtaaagcaaagagctcggatgctataaaacgatgtgaccatgatccccatgtcattgcagccgtggctaaacttttctggcatgataggaagtttgataaagctaggagttggttgaacagagctgttactcttgctccagacattggagatttttgggccttgtactacaaattcgaactacaacatggaaacgctgatacacataaggatgttgtacaacgatgtgttgcatcagaaccaaagcatggagagagatggcaagcaatagcgaaggctgttgagaactcacacctgtcgattgaggcccttctgaagaaagctgtggtggctcttggccaggatgaaaatccaaatgctgtagatccctagtctgtatcacttttaactttaaattaaggtatttggtgcaatctgttctcagacttctctcatagagaactttgctattgtgtcctttattgccatactttatgaggtcatattgtaatgcttttcgctgtgttctattttactgttcagctataagatatacagtatttattatttaagaaatatcatgaccagtttttaagatttgacctccaagtaatttgtttgagacaagcagtgttatcatttattttgttggtatcattaagtagctctaccttaaaatctagctaggttgtgtgtcaaggtagtcggaaaactcaattataagcactacgactatgaaaatctgttgatgctgtattatgctctgtgcacaaatgcagcaaaatccatggtaattatacaattgtgtttattcttggcatggccttaaggttctgaaagaatatacttatcaccttctcatctacttaattatatttcggttgaagattgattttgttttactccttaggttgactatgttacctcaactgaagtttttggggaatgtggtgtggcaattctaggtcaaaatttgtcaatcttactacttccgtgccataatatagcaacctagtatatgttcagattcatagtattaggatatgttacatcctatactagcaagattatgggacgaagggagtaacaatgtaacattgattactgagcaatctgactaaaaactcaccagggggctgctccaaccatttgtgatttttgaatgtgcattttagccagtataatggtcaagctatctaattttgcgagaaaacagaataattatcctcttccaattctaactgttggagcagtgggttgataaaatgtctaggacaatataccactttcaggagcataatttaatttctttttgttaccaaatttatattttgtaagaaatcaagcataactatgttacctgttctgctcacaggtcttcttctgcaggtcgataaagaaatatgtagagaaagaaatacaactagacagtgaactgggatgcactcaagcaactgcttctgctacgacctcgcattctctacccaccgaactgattgctgcagtcccccaaccgtgaagcttacctgaagaagcaccaggcatgccattgctccaatgtgattggctatctctagttaatggttagcaatattcttgaactaccatgaccatgtagacaatattcttgaactaccagcaccaggtatattgtttttatgtccttaatggttagcaatattcttgaactaccatgaccatgtagacattgtccttgagatacctaccacaaattcttagcttggtgtatttgctagtcgtcactagattctcaggaatgatgcaatgtttcttggggctctatttattatctgtgcactagcgactttttctatggttataatagctctgtttgccagttagccacattgttcgtggattagtttgtgattgacgaaatacatgtttgcaagtgttctaactttatttgagattagttttctaatttaattccgtagcaaagaattgcttgcaagtaacaaattagttctaaatctgaggttcccagtacagccagttttcttatttggcaggtcattcaaaacttcttttgcaaaggcacaaacgtagtgctgatcgtttacagatataatttagataaaattagtacacatatatcgtgcatctttgtttttgttagtttatttttatgtttgttgaaaccacaccttctggccaagccttaaagagtcatatgaaggacttatcttgttgcaaaatgctaccgcattgtatgaatcataattgaaccttcttaatagatcttccttctatataatcccagtacatgccttccttgttttacctgcatctggctgtaaaccatcatatcgattaaataaagattttagttttacttatttaaatttctgttggaaaatctctggcagaccaggagcatgaagcattacaagatcaactttcagggaaggatcattttcaaacagttttgtgtataaatgggacagtcccactgctgccttccttggcgtcggcagaagagctttgttctacatgtaaggtatagtgttatacagatatcatgccatcaaatgaatgtttctttcggcaaagctcttctccatttcatgtgactaaattatacaattctgaagaaacttcatttcacctagaattttcatgtattccatttcatactatacttaaacaagaaagtgttagtgcttgcatttgatatgggcatccaatgcaatgcttaaaatattataatacttaagcaagaaagctatagaggcattaattgggacggacatccggcagcagtgtatggacgatctaaaattttgaatcatctaactaaatttcttttttttcaaattgtaactaattttctcttattgtcttttaggtaattatcattgtgaaaatactattgtatgtggctgaggctaagatcaatttttttccttcatatattgtcggagggtgaacccctcaagcgggggaccgtgggaccccctttccggttcggaccggggacgcgggtgaaggatcgagaatcgttggggagagagtgagagggggtcgggcccctcaggagcgatgaaagatactaggggtttagacaggttcgggccgccacagaagcataataccctactcccatgtgtggttgatttcggtgggagaatataagtgcttcctgtttttgggatttgtcccccctccactggggcatagacctccttttatatctcaaggggttaccacaaaggcccaagacctagcttcaagggtaaggaaaacattctttacagacaattaatgcttgtcttgtcttccgacgagcggagccacgcgcgccttaccgcggcgtgggtccatcccatcacgccgagcgacacaggtggacacccgtgtcattccttcttaattaacgacgatttccggccgcccgttcccaccgttgggcggggatttctcgaacggaccggtataagaagatttggtatgggttcaaatgagaggcaaaaagcccctcattaatggcgactagacggggtggtgtaggccacgtcccgtgccagcagcaggcgcacgcgcagggcgccctgcccaccgtcacatcagtcactccggtcttgagtggccggttagtgcgcctgcacgccgcatttaatgcgacgtgccacgttgacacccctcaataaatgccgtaggtgggcgctgagagtgcccgcccaagccgcacacacgaggcgcaacatggagggggttggggcggcccgacccctgccgtggcaggtagccaacacatcaaccctaggcatagggatggcaacggggctgcacccgacgggttttgccatcccgtccccgcccccgtggctaaataattttcccgttcccatccccatccccgcacacgggggagggttttcccccgtccccgcccccgtccaggtaggaagcacccgacaggtgcccacacccgacgatgaattctcagatattggaggagcagcaggcagagagtctaatttgtggtagagaataaaaaatcacccagagaaaaaactatttgaaataagcatagacatccacaaacgtcttttgaagatacacatgcatagatctatttgattcatccccaacagagagctatagaagcatagagtccaaagaaatacaagaaaataaaaagggcaagtaaatgctagtaagagtttgatgtgcgatggagctcttgctttgtcgcacaggacaagcaagactagaacacctcgctgctgcagtgcagctagcatccgatggttggaagcttggatgtggtaacggcggagcgagagcgacgcagacgcttgtgtaatgttgcctttgatccggcgacgacggcgcggcacttctgctgcttggcgtggctcgtgcaggcgtgctaccttgaggacggcgacggcatggatgcgtcagtgcagtgcggaggaagggactggaggagtgcgtatttggatctgagaggaggggtgtgctagggtttcactagaatatatatgtggaccttcgaattgggccgtgtaactgagcttttagcttctatctgggctgcggccttgggggatatctacctgtccctgataactcttggccccatggggattcagggccggggtgtgtagaacacccccggcccatgcccacccgacgggtggctcatttggccgacaacacacccatggggagtgatatgctcccatttacagaccctaatagaggttttccccgcgggggatcgggggtcgggtcccattgccatccctacccaggcacaaccctcctcgaggggggggagcgtcacgtgggcttgaggcggccttctctctttgtacgtggtacccccgggcccatatcaccgacagtagcccccggcgttagctctgaccggcgctctttgcagatggctagggttgacgccactcctctcggtcaatggcttgtgggcccggtcttcgtcccacgtggacggattcaacgagtgtggcccccacgcctaggcggggctagagccacgagataacctcgaaaacgtggaatccgggcgaagtgggattgcctcccttgtaatgatgggccatcacttcgtgattactgcatcttacgggggccgtgaagataatgatgggtgcacgaaacgaaaagggtagttcttcgcggtaaccgtgcgcaattagggtagtcgtggccccacccgcattctgaccgaaacggccgcgcgcgtgcatggcgcgcgcgctggaaacaggtgcgtggtgaatcgagggggcggaggaagtggccgcgagaaacgaggagccgaggtgcagagggaggataaagggcgcatgaaggggttttcttcccctcctttcgccactttgcttctgccgctctcctgcgccccaactcaactcgcatcttgctcttccttcgccacactctcgctccccgttccccctcttgatgacgtcatgacgcggagctcagcgccgctcgatggcagcatccttcccccctctcgcattacaaacgagaggttcgcggggttgccgaggaagttcgtgccaatgccgtccgggcgggcaacggtgatctacggcgaggctcgtccagcgccgcagtaccccgagcgatctgtgttcttcctctcctatgcgatggtgggactgatcccgcccttctcttccttctacgacatgctggatttctatgggatccaaatggcgcatctcaccccgaacgccgtgctgactctggccatcttcgtacatctatgtgagatgttcatcggggtgagaccatgcctccagctcttccggtggttcttcaccatgcagctagtgtcctccgacggaggccgggggctgctacttccagccgcggccaaacacgcagcagcgctacatcgggcagacgctgtgcaagaagtggaacgactagttctacaccgtccaccccgaccaccctcgtcagtgcacacggcgaactggcaggaggcgccggtgctgggggacgcgttcgacacggccctcgattacctcgtcgggctgcggtccctggggctaaacgacactatggtcttcggtgattacactcgccggcggctcgcgcctctccaggagcaggcccggggcgagtggacgtacaccggcccgaacgactccacccggacccaccgggaggagacctaggactggagtttgggcgacctgaaggcagtggtctagagggtgctcaacctcggcaatgtcgagccgtcgctggtccccgagggcatcctccctctctgctgtgacccggtgcgggactccattttggccattatgcagacggtggctgccgacgcggggcgtggtggtggtggcggcgcaggtggcagccgcgttcatggggagcacgccctttcggccgggggagtcaacacggaggacccgcggccgggagttcaggctacgctcgtccctccgacttgagaggaaagcggaagcagagggattcctctcctcccccctcctcggcccccgtcccactagggcggcacggagcgcgtcgctggcgggcacttagcgggtgccacgtcgacggcccacaaccgccgcaccgctagaggccggaagaagaagaggctgcggaagatggggaagaccgagccatgccggggggagttcatcaagcccccggaatggagcttcaaacgttgcccctagaggttcgatctcgacacgcacgttgcacacgcccttccaaactttccaccccgactcttgcttttttcgtcctttctcccccccccttttttctagcgaggtctcttctcggggtacaccatgggtaacccccctccccccgcgtcggcccaaagtacccgggcgcgatgaagccaggcccggcgcgcgggagaccgaggcggagagatcgggtgcggaggcggagccccgggtccagaggaggcaaacggcctctgacaccgcgcccgaggacgaacccgaggcgagggccacaggaggcgacccgggcgcgggagacgatgcgtcccgctcggcagatggcgaggattcctcggccgtgccaagggcggaggccgcccggggggcctctgccgctgacgccgccaggagcgcatctggcgttggcgggggcggtgcccaggacaatgggggcaacgcattcctcccggtgctgcggatgctacggcctcacgcgcgcagtgcggggaccggctccccttccaccccctggaccggggccccgaccaccggcgggtcgtcaagagggcgcggtctcctttttcctcaccgactccaacgggctcggagcctcttctgcaggtgatggcgacgacaaacagcaccgtcatcgaggggctcaacgcccaactgcaatccctacacgatgagcgagccgcgctgcaggaggagtgggagcgagtggcagaggggcagtgtgccgtggaggccttggtggccgcaaggcgcactagctccgcctggcggagttgaaaacgcgggccaaggcgatggaggaggtgatgcgggagacggagcaggagagggttgcggccctcatcgccactgacaccatggaggaggcagtgggcgacatccggcttgccgacgacgcgtactcggctgcgctctaggagaggagcgacgccgtggcagttcgggagctccgggcctcgcaggccgacgcgtccctacacctaagcgaggaggtcgtggaggcccgagctgaacgagcgggccttatccctgctgggggcggaagccgctgagcgccggcgcgaggaagtcgtcgagctccagtctcgggagatggagcggcgggcttgggagatggagcggcgggcttgggagatggaggatcgggcccgggctttggacgcacgggaggagacgctagcagtgcacgagtccgcggcggtagagcggaggaggcgaacgccgagtggggtcgcgccctcgcggacgccgaggtggccgcgcggcgcctggaggagagcctgcgccttcgggaggaaagctggcggaggcgcgacgggaagatctcggagcgcgagtccaaggtctcccgccgggaggcggtggcacggcggctcgccaagcgcgaggatgcatggcgggtcgcgagagccggcacctggagcacgctagcatggagcgggccgacctggaccagcgttcagccgagctcaacgctcgggagaggagcttggccttgtcggctcggggcggcatgacacttgagggcgggggagacgccgcacgggagtgccttgccgcggcggagcgcactatcttggatagatcgaggccctccgcttcgagatccacgctgggcctcaaatgcttagggatgccgttctcctgctaactctcacaggacgctggtcggggattttggtcgaccagaacgccaagctccccgccggtctgaccgggctcgcccgtcggctggaggaggtggccgtcgagttggagcatatccccaaggaggtggacgacacggtgaagttgtcgtcggcagcgctggcacaggaggcggtcgagctggtgctagcgagccactgggcctgcgacccagacttctcgcccttcctcacgctggatgactccccccccccccaacaaggaggcggcacatgccgcggtttgggaggccgtggacgtcatcgtgggccagttcgaggggacagcctccccgttcacctttgcttctccctccgatgacgaggaagacgagggcgaatccaaggacgccaaagcctaggagaagcccggcgatggcgacgcggccgatgctccaggtccttcggggggagcggggaaagctagcccgcactgagccgtagcccgtccccctcgcccccccccccctccctcctttatttgcttgatgtacatagctctttatctttaaagcacttttgttttaccttaaaaccgcgtgttaagcttttttaagtgaacgactgcctttgctcgccgtatgtcttatccacgtttgatgtctttcatgtgcctgcatcgagatatccatatgtttgtgagttttgcgattgacgaagggtgccaacccacttcttgctaccaccaagcctacttgactggggtctgggctcgagctgcgttctcatgcgatatgggccggtgctagaaccgtaggggagatccactagcaggctgaccaggccgagggtgttgcgacctagggtcggggacgacctgatctcggccctttcgaagcctcctgctttcgcaacacctcagggcacgactcgcgtctgggcccctcttggcgtatagacggctcgagtcaccaagagcaacgcgaatgccgagagcgtcccagttcgagtaagcgctcgagagaggaaggcaaaagtgggcgtagcggataaggtagagaacaaaaaaaaaagtttgctatttaataggtacaataatacaagtggtggcagcccccggccaacgcggcacgacgcgaaggtcgtgcggggttggcccaagcccaaggtacaaacacttgttgtcttcacgggtagaacttgcagaggtgctcaatgttccacaggttaggcagctctatgccgtcctccatgggcagtcggacagagcccggccaggggaccgatcactttgaatggtccctcccacatgggggagagcttgctcaagcccgcgcgcgcgtttggacgcggcacaagactaggtcatttacttgtaatgatcaggtccggatatggcgctggtgatagcgccgcaagctctgctggtagcgggcagcccgaagggctgcgcgtcacctttgttcctcgaggtagttgaggtcgtcacgccggagctgatcttgatcggcctcggcatacatcgtggcccggggggagcccagggtcagctcaaatggcaggacagccttgcaccgtacacaaggaataaaggggtttctcccgttgcacggctcggagtggtccggttggtccagagcaccgctggtagctcctcaatccatgagtccccgtgcttcttgaggacattgtacgtcttggtttcgagtcccttgaagatctccgcgtttgcgcgctccacttgaccgttgcttttggagtgggcaggtgaggtgaagcagagcttgatgcccatgtcgtcacagttgttgccaaagagctcactagtgaactgggtgccgttgtttgtgacgatgcggttaggcaccccgaagcgggcagtgatgcccccgatgaacttaagggccgagtgcttatcgattttcacgacagggtaagcctcgggccacttggtgaacttgtcgatggcgacgtagatgtactcgtaccctcggcgggccttcttgaaggggcctaggatgtccagcccccagactgcgaacggccaggagagcagtattgtctgcaaagcctgggccggctgatgagcatgcttggcatggaactggcatgctcggcactaccgaaccaagtcggcggtgtcctggagcgcggttggccagtagaaatcttggcagaaagctttgctgaccaaggagcgcgaggaggcgtgggcgccgcactcgccttcgtgaacattggtaaggagctcgatgccctgtttctgagggatgcacttcaggaggactccattggcgccgcgtcggaagagggtctcttccaccaacacattccttttggagactcgagtgattcgctcgcccccttcgcgatcctctggtagagtcgcgtcttggaggaatgcttggatctccatcatccaagcaacctgtcgaggggcatcaatgctggcctttgcaggccccggggcctggactccatcgggctcctggggctgcatggtcgcgtcgggctcccacgcggggggattgagacgcgcagatggatgggcgagcctttcttcaaaggcgtcgggtggggttggggctcgcgaaaatgcaagcctcgatagctcatcaacgacgtgttctcccatctgggcatgtgacgaagttctaacccatcaaagtggctcttcatacgtcgcacttccgggatgtaggcctccatttgagggtagaagcattggtactccttagagacttggttgacgaccagctgagagtcgcccaacaccaggaggcggcggatccccattttggccgccgccctaagtccgcaaggagtccttcatattccgccatgttgttggttgcccgaaaatctaggcgaaccagatacttgaggatgtcgccggtcggtgagttcaaagtgaccccggcaccggcgccctgcaaggtgagggagccattgaagttcatcacccagtgcatggtcgattggctatgactgggggcatctccgagctcgggggcggaaggcccgagcgttgggtcgggattgaccgatggggtccattctgccatgaagtcggcgagggcctggctcttgattgtgtagcgtagctcaaagtggagatcgaactccgaaagctcgatggcccacttgaccaccccgccccgtaccctctcggttgcgcagtatctgaccgagagggtaggacgtcaccactctgacccgatgcgcctggaagtagtgacgcaatttcctcgacgtcgctagaactgcgtacaacatcttctgggcttgagaataacgggcctggaggttagtgtagtcgatgcacatcctgagcttgtcattggccttagggacgacgtccgggttcaccagccactctggatggaccacctcccggatgaaactggccttcaggagatgcgccacctcttcgcggatgaaggcctggcgctccgaggcctgccgccgcaccttctgccggacgggcctcgcgtctggtcgtacggcaaggcggtgctcgatccccttcctagggaccccaggcatatccgatggcttccgtgcaaaacacattggcatttgcccgcaggaacgagacgagcatgtcttactatttgacgtccaagttaccactaatcttggcggtcttggacgagtcgttgccaagctagacttacttgatgggcacctcatcgctcgaagtcctctgtttcttcgggacgcgtgaggttgaggcctcgtgccttccgccgccgtcctcgacttcgaaggctgctcgcgtgcaactccacgcaagccagcgcgatcttgacatcgccgtggacggtgatggggcagcccaggcccagcatcttcaactgaagataggcatagtgggccgccaccataaacttcaccaacgcgggcctcccgagcaccgcgttgtagggcagattgagatccgccacatcgaagtcgatccgctcagtgcggaaattggagggcccaccaaaggtgacggggagcgagatgtgccccagcggctaggtgtggcatctgacattgcatatggtgggtgaaagcaccagagctagttgaccccccctggcggcgcttgcggggtggtcgatttggtcgaaggtgagcttcacctccgaccagcgcgaccaccgtgcagcctcgtgggtggggacagtggccagaagctcgtgcttcatggccttgaagcttcgacgggaggcgtgggcacatgcccctccgtcgatggtggtgatgacgtgttgcggctcctggaagccgaggtctgcgtcatcgggttcctcgataggggccttttccttggcctcactttgccgggtgttggacggggccgctggggctttctcctcccggcgtccctctttccgctcctgctcgtattttttgacgcgtttggccaaattcttgaccgagcggcaatcggcgaggttgtggtgggaggtgttgtgcacggagcaccatttgtccgccgaacgccccccgctggaggtgccggtgtccttttgcttgccacctgcagccttccccttgcgctggggccgcgaaacacctttggcggcaaggacatggccctcgtcgttggagcgggccgacctcttctttctccgcttcttccgccgctcgttgcgagcggcaagctcgggcgtggctgcggctgcgccggagccggaggagttccaggtccaggccttctccttgcaagccacacggtccgcgagctcaaagagctctgcggtattctggggctccttggaggctattttcttgagcatgcggttgtgccgcacgcccctcccccccccctgcgcgaatgtatagatgaccgcatgggcgggtatgcaggggatggtgttgcgcacctggcagaaacattggatgtactaccggagggactcatcgtcccgctgccatactgcgtgtaggtccacttcctctcctgggcgcggatacgtgccctggaaattaacaacgactaccggcggcctgttcacaccgttgggcgggatttctcgaacggaccggtataagaagatttggtctgggttcaaatgagaggcaaagagcccctcatcaattgacctgtaccgctctgtgccaggtgaaattagtgtgatacacatcaaattaacagggcttcgttaattttaatgatgggtcagatgggtactgactactttcgcattattttcagagagaactagtgtccatcacgtcacatgcagtacttgattatctgaaattattctatgaaacaaaagccgaactgtttgcttcttttgagtaattgtctgaagttaaatttcttggcagcggatatggattttaataattcttatagatgcttaatatatgtacggaaaaatgaaggtttttgtgttgacatgctctgctatcttaatcctacttaaccattttatccaagtttttctggaatcattgctcttgtatgtcttgaaatttgtttgtaatgttttgctatcagtgcataacaactgataatttgaggtctatttcaataacttctgtttctatcaaagattgtgtgttattctgtacggatggatagctttcagcaacttcctcttaaatactgataaacatggaagtccacaatcgaagtactggttgaaggaaaaggtcggaacatggatgtatgaacgtgatatctgcatctaattgtatactgtgaattcatgggtgataacttgatcagcgtatttacaaattaagactacttttaagataatgaaagtgatgttcatggatgaccaccttttagggaatcaagctttgtttttcatgcaccagtaaaatttctcgttcatttcttcacttctatttagatttttaggataatatgatttgaaaacacttatgattggttgttttgaattgcattggtattttggggtacggtttgcttgctcaatttgatgcatatccttttgttcttttgccgtttccagagcctacgttcgaaggaccttcagcttcatgttattacctccaatatgatgattgacgctttgctcaaaggaggcagataggaatatgccatggatatgtttagtccagaataatgtggcctacaatttatttaatgattattttcattggagcttctactgcttcccagctacctctttttctcaaagaggaaatatatgcagcatgtgcagtccctccctgagaaataccgttttcaagtatcacatgcagtatttgataatcgaaattctggtctgacaataagaccaaattgctacttcctccgtttcatattataagactttctagtattgcccacatttctttgtaggactcatctgaatccttagtttttataatcgaagtattgtttaaagtcaaagatgtcagaacatggatgtataaacctgatatttagatcagttatgtaatgtgatcatattcttgggagataacaagatcagtttttcagttgttatgtgcttatgagttaagactgccatttcgggaattaattatgctgttctatgaacagatatattttcttaatcccttattcgtttcttctaagcgttctttatgttggttgtttttgagtctgctagctcaatttgattcatctttttggcctgtgtcatgaggtggtgccattgggagcagaacaagctgtgtgaagattgatttcccagagaacattggaaatgacatatagattcttacgcatggcatttaatctttttcaacttactcttgctgattattgtcataatttaacaaatacggttaatgatggtcctattgacggaaccatcaatatcctgtatatccattcagatgctgttcatattcatcttttgtccattactgcacccaactaaaaatctgtgccatatgaatcaaatcaagtgtggttagattgattaatctgaatcttttgcactccttttttttcttcaaaaacaaagatagacataccaatgtagtataatatactaggagagctaaaccaggtgagtgtattttcctgacttaacctagatgtacacaaccagtttgtcaagtatttacaatacatatacatctcgatgtagtttctcatgaaagccctttgcaactcctatccacctcaagttagtggctgcacaaaaagctctctcctgatccttctgaataccgcaaaacctctactgctatacacattttacagtacacacactgtgctgacaaaaactataggaaattcaacaggtaaagagtcaagaagtctcctggaacgactgcgaccgcgacaatgcagctgggtttgccttaagagcacgagcaggacgagtctctgatgctgcttggcctttgctctcacctttggactggaacggcttgaagatgccagggtctccaggcttgatccccagggtggcccagatggagctcttcgccgcctcgtcgggatcgtcgatgcggagcgtcttgggaacccacagtgatttctcctccttgtcctccttcagtgggagagaggagtccctggaatgcttccccagaggggagccattgcctgaacagctgctgttgctcgacgacgatggagacatgcagccgccattcgttctgatccacggtatgttccatgccgtggccggccagctggataagcaaccccatagtgcaggtggcactagagggtatggaaatggtggtgcagaaagcctcgaggcaaccggcatcatgggggagttcatgttcatccatggagctgaactggtgctgcagctctcagattgggaagcagactctggcatgcttgtacctggcaccatcataggaacgttgttccatcctatgttccatgggtacatgtaaggagctccaaggtagtactgcggcactgggccgactccgttgcaatacaccggcgtgctgttcttgtcaacttgggctgcattttcaggtaacacgttgtgtgatgtgattgaagagatgcaagagttatcttcctgattttcacccgttggtactgctgcagcattggttccattctgctcctgaatgttcagcactgatgccatcgattcacagagtggcacctcaggcccaaatttgagaactgtttcgtttctgccaattggttgtataggggtcgaatgcgcagatgcgaaagcttcagggttcattgacttggatatttccactctagaccccatcatgcaatcaggggccatcagtaagtgacggtagtgcaacgatgagctcttgcttttgcgcctcccagcaccaacaggtacatttctcatggttcccccggcagtccaatacctttggcagttcttacagaagtgcctgggttgattaacattgtagttgttgtaataacaaaactttgtgtccatactgttgcaccgagggcaagggagaatcttatctggcttcttaagtactttgtcctggcctgattcatcatttgctgtcttttcattttcatcttttgagtctgatgctgctttctcttcaacgttgttcatctgaccctgatcttcttttttattgtccaaggtagatctgctgactggctctatgctttctattgactctgatgcatcaaccctcatttcatcatttcccttctcttctggcacatcagccgtcacttcattatcctttttctcttgtggtgcatcgaccttcatttcgttatcttcctcctcttgtggcacatcaaccttcatttcatcatattttctttcttctgtttccttgtgatgatcctaaaatattgccgtagtggatattagcaaggtacttcagttcaaacttcaaagaaacctctaataatgaaaccctttttgaaaaaaaatcactttagcaggaagtttggaaattaaagaaatgtaataggatcacaagtctatggcatggcaaaagataaataatatcatgaatgaatctttcaagcaaatgatatgcaactataatcacctttattcagctttgtgtttcttttcttccaaagaagagacatgttagcaagcagatattctacctttatgggcctaacacttattgtgttgctccaaacattgaaaattgggagcatgaaactatgaggtgtacaccggtatgtaaattcataagttgggtatctgaacaatttggacatgctaatccaagcccagttgcacagatcctaattcaatcgactttagcttcatccatccacagaacatgctgcagagagatatgccaagatgatccgaaggacaacggccaatcatcactaaaaataaaatcatgcaggtattctactcttatctattcaccgtctcgttctgcctcagtacaatcggctacgcggattaattgcttttactgaaaccagaacacatcctaattactagctgagaaaaaaagctgaccactctttcgctaaatgaaagcgaaaagccatggtgtagaaagagaaagaccaccacatgctcaaaagaaccttagattttgcatggatgtcctactttacactcctaaccactttttgaggaggcaaggatgattacacccaaagtacccaaccaaccaattatgctaattgccctctctcacctgcaaatacccccaatcacaattagcaataacacagaacaattatgggcaattctctacttaactgccgcctaagtcgaagacaaggacaaaacatggtgtacggacaggtaggatcatcctaattcttggccttatccacacacctaaaatccaaactgaaccttttttttttcatacacaccaactgatcagggaaagtgcaccgtaactttcacccatgacccatagttcgaattcctcaccttaatctgatcaagaagagctcaatttcacagaaacacataaataacagcctaaattaagccgatcatatcaatcttttcctttctcttccccacaaagcaacaaaaccctccaaactcgaatgaaaagcaacaaaatgcgcacgcgattattctcacctcatcctgcgccgccggctcaacctccgccgccgccgccgccgccgcctccggctggtcggagccgtccgccgccgcagcagcctcagcctctggagccagcgggatcacccgcccgaagagctttatgcccggatccttgtcacacatcctcgatcccccctcacccaccaacaacccgacaaccaccgtgatcctccgccgccgccgccgcagccgctgaccggagcggcgagagaagagaagacgagaggggctaatttggaaataaaactagctaagctagtctcctctacgcatgggacgaaatgggaacaaaaaagagcacgagaaatttcatttcagaggggattgctcttgctatattaaagaaggggattaaccctcttataccctcccaaaacccactattctcaaacacacccctataaaagttcggagcaacatcggttagcataataagccaaagcaaaagccaaaatttgaatttttaaacttgattttgaagttaagatgttttcgatgtaatttcttgatagtattggcttttaaatcgctacgaacaaatatatacctataaataacttttatttcctaataagctgctttgtcatatccgagaatatgagcaatcgatgaggctcttgcatactccctctatcccataaaaaatcaatatagtagtacttaatatgacacatcataatacaacgaatttagatatgtctctgtctaaattcgttgtattaagatgtgtcatatactctctccgtcccataatataagggattttgattttttccttgcactgtttgaccactcatcttattaaaaaaaaattatgcaaatataaaaaaggaaaagttgtgcttaaagtactttgtataataaagtaagttacaaataaaataaataataatttcaaaaaaattaaataagacgaatggtcaaatagtgcaagaaaaaaaaccaaaatccctaatattagggagtacttggtttttttggacggagggagcgtaggtaaagcctgtactgacagggagtgtttatgtaaatatcggttcatataggggcgtggaggcgaattgtccgaggctcgggatggcgacgcggggggcaccaggggcggacagctggcgtccaggtcagcggcgcggggggctcgtcagccacgagttctcgtggctgggaggcgcccggggtgacgtcagctgctgcgggcggaaggcaagcgatcgaatctcgcgaaaaagcggagccaaaaaggggcggtccaggcggccaccccgccccccgctttttctcttctcctttctttttccttctctttttttctttctttctcctcttcctttatcctacgtggcacgtgctggacggaggtgggccacgcgtgtcagtgggacggcgcgtggtggggggcctagcgcaagtggggagttggtaggggttctagccttctaggggagctgacggtgggcccggttggcgctgattggctgataatttttgtcactcttgagctgaactggcgtgggaaatacaagataaataaaatcaccaagaattgtagtataaaatccgaaccccaaatacccaaaattggggtaaagtgacaccaacgtgaattatatttttttaagaaaattaaaataaccaagcgttttagtataaaatattgaaccccaaataccggaaaattggggtaaaatggcaccaattgttttttttaaaaaaaaacaagattagtactctcccgttttacaatgtaaatcattctaaaattttccatattcatattgacgttaattaatctagacatataaatctatctagattcattaacatcaacataaatataagaaatcctagaataacttatattatgaaacggaggaagtataaaacaccgaaccccaaataccataaaattggggtaaaaatgtcaccaagcgtgaattgtttttttatataaaaattagtatcaccaataattttagtagtataaaataccgaaccccacgtccccacgctctactaaaaaaaccagctgcagatcaaaatccgttagctcatgagaatggtcccgtcgtgctcgtaggccacgtggctagagatctttccctggagacaatcccatccacaagttttgttttgagtaaattttttgaaaaaaaatagtgggattccaacatttattcgtggcacttgttactcgctctcggtctaagcaaatcatggatttgggttggttttgtgtgcacatgtggggccctgggttgctctcgtccacgtggtgttgcggataaaatggtggtgagaaaaggacgtccatttggtggaatcaatgtgtcaaaattttggatttagaagtacgtgtttacatatgcaaggtcgcaagaaacttgtttgagctacggcttataagtagaaatggtaaaaggtttaaatagtggactaatttttttcctcatctaaaaatatatgagagcaagatgataaagttgtataagaacatcccctgcagctcatctaaattttatcctccatactcccatttggatggccatccaaaaaaattcccactctatataacttttcacttcaacagatcatccatattacatcctacatataccaacatcctatattttactaatatttttcaattaccacacatttttactcctattgctctcacctttcaccacttaaaaaaaatcttgggaagtgggtagttgaggatagagtgaggagagagaacctccatatttggcttgggaagggctaggtttggaggacctccaaaaatggagtacgtgatagagactctgttggagcactgtttttctcctccatactccaaatatcagatggatgactagatagagaagctgctggggatgctctaagtacccatagctcatgacccattaccacccctatttataagccacaaacaattttggactttaaactcaattctctcattttaaaacataggggttcacaatgtgcacaatcaccgttgtaaatacccacgcccaacttttataaacacatcgagaagactgacatctgaaaaaaaaactcaaccttaaagttagtttagtgtgttgttttatcccttcctaatcttttaactctaaatttagactgctagaatttgaagtacaaaaatcttatccaaaattttctactccatttgctacgtactccatctcgtcttggtttatatataattcacagtcgtagttatacgagcaaatgccagtggtgtgtgctagcgaaattacccagaattgatacgcatgttgagtatcatgttgatggcttgtttggagagtttaagattaagagaagcagctgataggtagctagcttctaagaatctgaaaaggctgggtttccgagcttctgacttctagtttatttctgaattctataactacaacttaagctgaactatttgaaagaacttttgattgtaagaaaaactgcggcagctataagctccccaaatagccttaggctacgctcaggaggagggttggcacgtaaaacgaagcacatattattgcatgattaattaagtattaattatttttttcaaaaatagattaatatgatttttttaatataactttcgtacagatttttttttaaaaaagcatactccctccgttctaaaatataagcatttttagcatagtgttaagtcaaatatttttaactttgactattaataaaaaaataaaaaatcaatcatataaaattgatgttactagatatatcattaaacaaactatcataatatacaactctttttatttaaaacatcttacttttatatatattattagttaaagtagtatgtcgtaaaccatatcaaacttaaaagtgtttatattttgggacaaagagagtatccttcagcagtttaaaaagcgtgtgcgtgaaaaaaaaaaaaaagttgagttggccaaacttgggggaggaacgcggcgcacgaagcggaagcgttcgaggctgcgaccgagcgaagcgtccttggccacaagcaggcgggcaaccttttttctcttggaatccttttccagtttgaggatcagaacgggcccacccccatctgccgctgtccaaccagcagcaatccaccatctactagcagcggggaaaagggaaaatggctcgcggcgcgggggccactttcctttccacccgcgggccgcggccacgtccacttgtcacgtcttcttctctccgccgtccacggttcggtctcccggcgcacgaacgacggcgcgaacacataaaaataccgcggcgcgccgcgcgtcgcgtactcgagtccaccaccgctgtgggccccggcacctttttcctccaaagcgggtggtgtgggaccaggagaagtacggctacgtcgcctgctatgctgtctactagtatatgtttgtgaggcccacctgtaggtggctgtggctcggagtcggagtgaggtttgtggtgggagtgctttttgtaggtttgtggtgcgggttgcgtccaccgtacgcgcggcggctcatgggccgtgccaagtggcgctggtggggcccgcaggttgcagagaaggattctccggtgaaccacactgttcgtggctgccgcctgcagggattttgcctccggcgaaaggcataccaaccggctttgcttcgtttgtctgactataacaaagatcatgcttgtgagacatgaataaataaataaataaatagaatgaaattttctggatcccaagcaaatatttcatttgcatttttttccaatcatggaaagtacattcattataactgttttttcttatccttcctcgtgtcctgtcgaaacagcctagctacgatatttttactctcttgaccctcttcctccttaattttggtggccttgctgctgctagcgggagagagagaggtcaaactcctcccaatcgttagtactaataccgtagttgagttagtctcgcagtcgagccattctcgttgatgggttctcattttaattttcttcttgctacgacttaaattacttcatttttcccgtgtttcaatcaaatgctagttttgaaactttcatgtgttttaaaaattttataagaatctaatgagcatgacattccattcctatattttctctatccctatgttttgagtcttgcatttcaaatggggccttaatctctaactcttgctcaatggattgggcctggttgtagttttacaaatttacaatacaataatgtagaagggaaagtctatttttttctcccttgattataagtcgagtctgattggcatccactaatcgcacaaccagatatagagagtccttaaactatcaaaccggcttgttttgactcctcatgtggttctgatggtggttttgtcctatataacatttgcatggctttacagacaattgttttatctaagagttggtatactcatgccaacatggggcttagtggcaattctagcatgagaaatttacaaaaacctatgtgggcctacaagtcaatcacatgaaaaaggaaaaaaacctagtgccaccatcccacccctcccttctcttctcgatacggcctcgatcccaacacagtcaacggctacggtgaagggctcctagatgaggtagagtgttccttgacaatgtttgtacctttgctattgctagatctggcgatgccctggatgtccttggccatgagcctatgcaacatgctctaggcgtagttgaggtcgacaaacgaccaccgccggcgacaagctagagctagagctcgcctggtagagatggtagtggcaatggtggccaatgagcccatccattgttgctaggcacatcacccccaactatgcgtccatctgctaccattgatcacgttggctctggtagtcgagcttgcttcaatcgcacaaagtcgttagcgtcaaggactatgttacggagctcaaacatatgctataggtggtcgagacagagcttgcaagtgtgcaagtggagttggagatggagaggaccaagaagaatgccaccgtgcctcccccaccacgcctcgctgctcggctgcttgcgtcctcgacgaggtcggacgttgcagctgcccgtatgagctcgagatcgatgaagccacaccttcctttcttttcctcgggtgttgccgcctttctgcttgtgtccctcaataaggttcactactttcatcaccaccgcaacaagctcgagctcgacatggtgcgccatgcccaatgaagagaggatgggagaggtggaggaagaaggcacttatatatgggtcacatgacaattgtttttctaattgtgatgccatgtagacaccagtacgcgacacgtcagatgaaaccactgataaaaccactatatgagaaaaattgatcttgttttgatacttgagggatgtgctatacttggtattacggttgagggaggcgaatcaaactcggcctatacttgagggaagaaatgtagacttttcctatgttgaggttggcagctatatgtgcagcccaggctcaatattgactctttgtttgaaggaataagttcactttggatccctttatttgtcacccagtctgattttcgtcccttgatcgcaaaaccggatacgacaggttccccaacttacaaaaccgtttaaataaatttgaccctggttttaactgaggtggcgcctacgtggctaatttgactcggtcttcatctgacatggcattgacgtgacgcttacgtggcaatttgatccgaataataataaaacctataggacccacatgtcagtttcaattgtgaggcccacgtggaccccacctgtcatcctcactacccttttctctatccccctctctctatcctctctctctctccctcttctctctcctgccggagcagcgggccgagcggtgccggcggcggagcagcggggaggagtggcggcggccggagtggggcagggaaggagcgtcggcggccggagtggggcgggaaggagcgggccaggcaccccgacgaggaggccaaagaacaggaggtgcgcggccacggcgtcggaggcagccgccgcggcgccgcacgccatgacgaggcatgcccgagagaccttcctgatggccctcaccaccttcagcttcctcgccaccttcccgtggctcgacttgatggcgtggagaatggacgagtacctgtcgtggatccgcccgaagctgctccgtgtcgccgcgtcgctgaacgggacaacgggttgctccgcacggcggcgagcggcgccacggtgccatcggtagcggcgacgctgtcggagatggtggccaggaagctgtccgtggacaggtagtttctctgcgcgttcttgatgttcgtcagcagctgcttgcagatctccgacgcctcgtcgttggcgtcgaagtagcccgccatcgccagcttgatctccgacgacgtcctccggtgcatcattcgctgcaattccgcggggacgacgccttcggtgcagcgtgctgatgtactcctcaatgctcatggattccatggctgtgttccaatacaaaccagaatttctcaccattattgatggcaaaatgaactgacacacaagaacatataaacagatgacgaaaagctcaatgttctatctcttttttttcttctctctactgatctcaccttggtgtgatgggcacatgaattgccccgattccaaaactcaatttcttcgagtttcttgatcttttgggacaagcaaaaccggagtcaaatactgccgaaggatcttatttaaacggtttcgtaagttaggggacctgtcttatccggttttgcgaccgagcgacgaaaatcagactggacaacaaatagagggacccaaagtgaacttattccttgtttgaagcctagctctttccagatgggtagaattcggcccagttcgaaaaatgaaattcaaaattagggcgcaatttcattttgtttagaagaaaacagaatccatccatgtattgcagtactgggaaggtcgttccaatcacagttctaacttctaatcatctagccatctagacgcagtattacaatttgcgagagaattccggctggttccatttgattccacacgagatgcattttgttctgcccaagcaaaaatcaatcaagcagagccctaaacaaaaacaaaacaaagggtgaattctttttttcctttaaccatagtccaactccatccccatttccaccgcttcgagaaaaaaaggtaaaaaaaaaagaagcgacaggtgaggtgacagcctgacaccaccctccatgttccgtggtctcggtccacaagaccagtgtgctccccgcccctttctccccgtgtgcggaacccgtagaccacgaccacggtccacggggcctcgtgccggaagcgagaggaagacgaatcaacaaacaaaaagcaacgccacgccacgccacgccactgcagcgtccgcggggtttagggagggttcatggccttctcgtcggaggcgtggaaatcctccgccactgccggccacggcgacggtgacggcgacggcgaccggacccctcctccgacgcccccgctgccgacgccgctgctgcctcctacgctcgctccactgcagcgttcgctggtttttgggagggttgagggcgaggcgatgtcgtcggaggcgcgggaatcttccgccaccgccgtcgaccgtacccctcctccgacgccaccgtcgccgccgccgccgccgccgcctcctcctacgaacgggacgctcacgccgccaccgtcatcggcaccaagcggcggtcgtgctacctcgtcggaggcgcgcgaatctccccacgccaccagcgtcgacgacggcggccgcgctcctcctccgccgccgctacctcgtcctacaagcgctcgtgctacgcctgcgaccactcccagcgcggacggctcctcctcctcctcctcgtcgacgtcgggcgggtcgcttccccgcggtgaaatggcgcacgccgtggagtccatggagaagcttcgagccgccgtgtccaagctcgacgagatgaggcgagttcgatctctcctttttcccggtctcctccctcgaatcgatcgttccgatcctctttcctcttgcaacttacatgcttatctctggcttttcccctgtgcagtgacgaagacaaggactccttcatgcacctcgtctctcgctacctgatcaggtagatggagattatagtagattcgattcggcatgatttctctccattttttagtttctcgtttcgatttgttgagtttttttgggtgcatttgtagggaggagaaagagatgatcgactggaacaaagttgagcgacccacccctgagatggtggtgccgtacgactcactggtgcaggctccccgaggtacgcacgttgttctggatgcctccttcgatttcagcttgatgatccgatgttgttgtgctggtttcgtttgtaagtgctgtgagattcacatgctgtttctgcgattgaaactggatcgtgtttggcgctgcagatatccctgagattagaaatctgcttaataaacttgctgtgctcaagcttaatggaggacttgggacgaccatggagtgcgttgctcccaagtaagcatataaatattcgaattggtgcattttacctctgaattgatttgtctggtcagcttctgctgactgttgttagactcttcctcagtggaacgggtgtacggctgtagtcccaaagcaaagcaattagatggttcttcctccgtagggtgtttatgatgatgcactgacgtggaagatcacattatcatattatagcctgatgatgctttttcttgttattttgcttgtaactcttttgttttaacaaatgtatgttcacatcatattttaatgtgcttggtaagatgtataattggttatagcatactagaaatctgccttgatatgtcttgattttactgccatgtttcttttctggacactgcatgctgaaaagaacatatttcttgctcagcgtgtatctatgatatctgaatggtgtcctaaatgttcttttgagtgctttatgtttctattccttttaatttcctacactgcagctcaaatgacagatcgttcctttccttgaatggatgacattgatcttggttatgcatgttcattgtcattaagtgtcctgatatccacatatatgaattatcttaggtactacattcttacaggcatattcatcgtttcggttgagctatatctgaatgctctaccactgtgcttaatttttctgtattcaaacattcaaatcattacaggctcactgccaacatgttttttctaacatatttgatgcaatgcatcgatattgggtggactaggaatcattatgttctccttgcaccatctttgagattttgccttctgaaacaagtaattgtgcaggtgtacgattgaagtccgcagcggccttacctttcttgaccttgctataatgcagactgaggtattcttaacatatattggtgttttttctttaatgactggatataacatgtaattgtttgtgccttacaagtttcacccatctgcagtttctgaacaagaagtatggatgcagcgttcctatccttctaatgaactcattcaacaccagccttgtgaataaggttgatattcccttcactcatcatttaagatatccttttagcatcttgattatgaccttttatttttgaagatcgtggagaagtacacaaacattgaaattcacactttcaatcaggtataacattcttttcataatattttcttcattttttcttgatgaatatcacatatttacacaattatgggttcaacttacaagaatcatattctatacagaataagtaccctcgtatcattactgaaaagttcttgccactttcaagcgaaggaagtacagggtcccattgctggttagttttctccaataattctaaagttatcacattccgagtgaattgtctgcttaatgaatacatttcaaatacacagtcgtttggcctgtgctatattttgaaatgtttatatttaactcatcccatttccttaaacctgaacattccaatactgtgatcttttgatgaaggtatcccccaggccacggtgatgtgtttttctcattgtgcaaaagtggaatacttgataccatgttgtcacaggtaagaaaaagtctgaagtcttacccttttatataggcaacagcattagcacctagcactattcgttggtttacaatgattgtgtaaaatatattgtattgttttccagaaatatgtaacttgatttttgatatgctcatggtgtttttcatatctttgtaacatggaatgttaatgtcttgcggtaatcttatcatccttgagaaggtaacatattttctagtgtaaaatttagtacctcgaggtactttttcaaggattataaaatttctctaatgtttctccataagaaaagaaacatggtagatttttttttcttttgcattttatataagtgatacacaattatgctttagtcataaatcatgtccaatgatgaagtccaagtatctgtcgtgtaaggggaactttcagagtttgctaaaaacaatattgttgctcagaatagttgaggcataaaaaatgtgttagggtgggaaacaaaagagggggtagccaaaagaaattgaatgcaacccctaaaattattttagggactagattttttaccatacatgattgataaaaaaatgactataaatatatctttttagtaatttattgcatattgatattcctgtgcttagtttcttttccaaatcttctttcagggcaaggaatatgtcttcatagcgagttcagagaacttgggcgctacagtcgatattggtatccaaatatgagtacaacatccttattaatgtctcatggcttgcatcagaaattgaatccttaaccagcacagaaatcctaaaccacttgatccataacaaaaatgagtactgcatggaggtatgcaagtgtgcaacaagaactaattcccattgaatttggataatacaaaagtcaactcaagtatttatgccaggttactccaaaaacatcggctgatgttaaaggtggttctctcatatgttatgaagggttaaggtatacttatttaatcttaactttgttgccggcgcttaattacatactgctagttcaggagaaaagactatgatttacatgcaagttgcaatgttaaatttgtagcaaatcatcatgttgcttgtttctactaattgcacattgcgatataaaaccgtaaataattttctctgttgttatatacttgtatgcagctgttggagatttttcaggtcccttatgagaatgtaggtaacctctactaaattattttgttccaactcgtcaattttaaggtctgatggatgcttttcttcttttcttttgggggggggggtggccttcaggtagatgaattccagtcaattgagaacttcaatatgctcaacactaataacctgtaagaaacccaggttgtctgtctcttattaagagtttgaacccttgctaacagcttttggatataggcgggtgaacttgaaggccatcaagaggctggtaaaagctgaagcactaaagatggaaatcattccaaacctaaaggtgcaccatccgggtgaatttgttctctacttctcatttgcactacatttatctaagcattgtttttttgtgttacaggaagttgatggtgtgaaagtcttgcaacttgaaaaggaagctggttcagcaatacaggtgcaagacactttcttagtcttgaacttatgatatgttgctcctcctttctgttcatcttcaaaataatatgccctaatgcttttcattctatttatctagtgctttgaaaaggccattggtgttactgttcctcgctcaaggttccttgcagtaaaaaatacatccgatctgttcctcatcctggtatatttgaatcttttccatgttcttgttggtctagaatcataaatgattggttctaagtttattttttttgttccagtctgatttatatattgtgatggatggcactgtaacccgtaacccagctagagataattcaacaaaccccttgattgatcttggacctgagttcagaaaggtatggcagttgtatttaaaacatctgagatattttaaatttgaagatcaagaagggtcattgaagaaatcaagaaatcagtgaataaatctggaatttgactgtaatttcccttctttttcctcacaaaactgtaggttgacagtttccttgaccgatttaaatcaatccctagtattgttgcgcttgatagcttgaaaatctctggggatgtttggttcggttcaagaattactctcaaggtaaacctcacaagtcacagtaacatattgttatttttttttactccttggttgccattctgtggtgcttggtatgcctcctaattgcagttttttttctgcccatttcaagattttacatgcttttgggctgtgtacgtccattgtggatgtagaggccggattttaatccattttctaaaaaaaaaagattttacatacttcacaattcaatgcctctttttgaacgcatctcttgcggaaaaatggctttaatgatgctactcttattacagggtgaggtgacgattgctgcccagttagggttaaagctggatattcttgatggcagtgtttttgataacaaggtaaaagttcatctctggataattatctgttttgtggttattttggaaactgtactattatttcaatgatgttggcctttttatctcacagcattcaacacatagttctggagccatcaaatatacaatgaaattggatgagggagcggactgtgcatctattgattctgcgctcaatcggctgaacccaggatcaactttgatcctaaagaaagatgatttctatcgatacattgacccaattcaggcacggaaccgggcaatgttccattcagaaagcagtaagccctcatccagcaacaacgagttactccaagacaatggaactcccttcactccaaatgataatagtgacaggatacaacccctaccccttgctcccttctcttcttcacttggctcttcatcactgcttcccttatatcactctagagcccgtcgagcgccttactggtatacacgatttattttcgtgaatccgcgaggggcactgcattcacaatttaggtggctgtgggggcgtataaagtttagcagtgcgaaagatcttgccatattttatggtatttatcatatcgtactgtatggaatagattgcattatcacagcaactttgaaggacaattggtttgccaaactggtgcaaggaaagctgtggcttataatattggtctttcatcagttcaagttgcttagccgccggcgcctccgctggggtgagaggaggaggaggacgctcagatctattcatcaggatatccagagttacttggacaattactctgactccgacatgtggcatttgattgtacacagtgttgctagagtgatatccaatgtgctggaagatgtaaaccgcaaatatatgaagaatcactacctaggctttcttgccatacattcaacggtgtttgccatcgaagtgataggttcatacgctgttgaacttaattacgacattgagcactatgcagaaccgccagagttataggtatgcaaattttctcttatctcattatttgttcccatcttgctctatctcattacttattcccatctttgaacataaggtgaacttcacatatctttgataagtagatggttaatgtcgttggaacagcaatagatattggctttatctgagtaatatattgcttctactttgttacttataatttataagacaactaaaacaatatttaataaatatcattggccggaagttccattatctaaaaaaaattgatagtggaatgattctgtagccatatgaggggctttggttagtgtttaatccagttgcaacacttgctaaatatgattggtatgcttgttggtctgtgagcaaaagctctcaatcgtaaacattttgtcaagaattactcatcagcatttagtatcattatcatgatgctaattcattaaggatcatgtcatgttcaatacataacgtatgccattggtagtgctctgcgcactgtgcccatgttcaattagattgatttgtactctcttcaaaagggcatatctgttagttttttgccatgttttacttgacttgcttcatcatgttaccagtaaacatgggatttcctttgttaatcctatgcactgttgtcagcttatttgttgtttcatttactaatcatcaccagatcatccttgctagaattatgtatgactgatagcttctaacttctctggtagacaggtactcaaggtcccctttttacaaggggaacccaaaatcaagttcaagatcatgatgcctgcacagctcaatccagtacctgatcctgatcccacgcaaggtatcaagaagccacaagaggttttaagccaattgctaatgctacgtatgatgccatctatcacttactaactcatgatgatattgttactgtaatcacacaacatgttcctgatgcgtttctgtggttaactccgtatcatgttctgaatgcgtttttttgtggttcatggtatccatatatgcttacactagcatgactctgtcgtatgtcgtatatctcgtatgtactatgtgcttgactgtggcgtatgtcttagtatgtaattatgtgcaaataagtacttcctttgtttcatattatgagacttctagcattgcctatattcatatatatgtcaatgaatctagacatatatgtgtgcttagattcattaacatctatatgaataatataggcaatgctagaaagtcttataacctgaaacggagggagtactttatagtactttatcttattatctgcattatagggttttgttgaacggggacagctgtttgtatagactagttgtgccagctgaatactataaaacataagtataatggccataaaacataagtatgcgtaaataatgtattcccttgcaatgctactatcccaacaaactgaaaaaaaaaacacacacatactccacgtagaagatgatctgaagaactaggaacagagtacagactggcagtgtgaaactgtgaataatcaggcagcgggtggcttgggcttcttgttcggtttgaggatgagatcggctagaggataccaaattattggtcgcttgtaggcttgtgcgccggcagcgaagaagaggagcagggcgcattcccacatcacggcctggtacaccctcggcaaggggaggaggctcatcaccacgagcagcacgccgcacgagagcgagaagcccatccccaccgccgccgtctggaagtccgacgatctcatcgccgcgcgcgaggccgccgacgccagatccccccctccgcccgacgccgagagaattcctttttttttttttgctgatcgatcgattccgccgccgccgtcgtccgtccctatcaactttctctttcaatctgttgtgtttaggttatctgattggggttggggtatatatgaaccggaaaaatatatatactcatgtaatccgtgtcctaaaacatctccgtctccgatctgtttggttatctgatgcggattggctcgcacgcgcgcgcgggtcacgaggctggtttcggtcaagcaaaagttgcaaaacggatgtggattttcatctctgcacttaggccctgtttctttcaacttaggattattataatccagattattaggagtaagctgaaagaaacagataatttattgaagtagcttattataatctgataagctcatttaggtgagctttttccagattattgggtgaaaaattacccaccatgccaccccactccctttttagacttgcaaacccaataatttaggctctaataatccgaaaagaaacaactaaccgcttattatactacagattataacaatctagcttatagtaatctaactcaataatctagattataataatcccaagctgaaagaaatagggccttagttcatggatggaaagatggatctatgtgttcttgctgaattttttttataatgctattcaaatattcaagctatttttgatggtgtgtcaattatatataatatttgttattgctgaattgatgattatcttgtatttttttctgattggagagagatactacctaatgcgaggcctcggaggggttgtggacggggcttgatttgaccccacatctccagtcggggccaggggcaggggcgaagtcgagggcgggggcgttctagcccaacccggccccgcactgccccggtgctatctttactaagatgtataataccacactaaaggcccttctcaactgtatgtatatgcggcatctaacgggattctacgctttctaaaatatcccacatggtaatcagaactaggggtgggcattcggtctaaccgagaaattcggttcggttcttcagtcttttagaaaattcggtcttcaaaatcacaagaccgatcggtcttcaagaaaactcaatatcgagagcttggctcttcagttatttcggttcggtctcagtcaaaccgaactaaccttagcagcgatttgaagttttgaacaacaaaataaaaccgaacaagatcgacgaatcaaaggaactcaagtcagatgaaagacacaatatgctgccactagtgaatagagcatgattcaggaaagaaaaaaaaaaagcaaattgagcaaatctatcctaccacgacttggatccccgtcgatctccaccactccaccacaagctccagatcccatccatctcgtctcccaccgtgggctcacagccggcctcctctggcatcgaaatccccagctaacggcatcttcctccaccggggtgtgactggccggcagaagcagccggtaggggtcgctactcaccagagggcggaagggtggtgcggcgccagagacggtctcttccactgcgaaaggcggaagggcggcgcggaatggcggaagggcagcgcggtgcggcgtggaagggcggcgcgacaccgtgcaggtcgcgctagcgtggagatgggagaggataaggttgcgcctcagagaggccgaaggagcgatttttttgtcgctaaacttggagtcacgggatcacgggatggggagctaaactttagccgatggggagttagttttactctagatgattttactctagatgatgaggcggtattgggtctagtgggctgagatatcacatgtgttattgggccatttatatatttcggttttttcggttaattcggttacccgagacccaagaccgaattaaccgaactaaattcggttagttgaaattgcagatcgaatttgtgaccgaatctctcggtctcggttatttcggtttctgtctcggttatttcggttcggtctttttctgcccacccctaatcagaaccattttcctcaaaccaaaaccaatcatatgcatcctcgctgtcactcgcgtttgtccccgtcatccagtgactgacaaactcaagaagaaaatcatctcctgtggaaaagcccatttgcgccgcttagagcaagtttaatagtatagccaactaatagctctaaatcatttatagctaatttaatagtcaattcatacaatagttatctataaacaaatactacaatatcaatacctggtctggcctatcatacacacattatgtcttgaaatctatgctgcagctacctgcaaatctatagcccactatttttctctcttttcttttatctcgttaaaatatgtttatagctagcttaattatagtctgctattgtacctgcttttgctgggtttcctggatagaacgaaggtagcaccaccaaagactcttgaagtcaccaacaaatacaagactttgacgatgatctccaataatgagtactagtatgtaacttgggaggctcgagaccagtaggtcttgggcggttgggctatcttttctcctcgctttctcgcaaggtgctcataagtcataacagccgctgcactgaagacgtctgccaaggtgtggtagacgattgaggacatgtttgcatgtcagtctcaaacttgtgttctcaacacgcgtattttctctcgtggccactcacaaagagtttgagtatgttaaatatggagtacaggtggtatttgaatcttctgaagatgaagataaagattaaggacctgtttgttagagctccaacgcctaaatttagctctaggagttgggtctggagtggagttgtgtagttgcctaaacccagctccatctctctagtttattttgtgcgctccacccaactccactcccactttagtggagctgaaactatttgatccactcccactttaggtggagctgaaactatttgattgagctccagctccaggagaagtagaggtgaaactgtgccaaagtgccaaacatgccctaagtgttttacgcaaaacgagcaaaacgaggtagtaataacgcatgcttaattgagctttaattattacaaacttgaaaaatggattaatctgatattttagaacaactttcatatagaaagctttgaaacgcaccgtttagcggtttgaaaagtgtgccacgagtatcgaaaagtttatccaatttttattggagaaaagaacatagcatgtcaacaagatgaaattaaaggccttgctgacgagatggagtccgcaggaaagcatcttgacgatgatgatctcgtctcctacatcgttgctagtatggatgttgattttaatcccgttgtgacgtacgctagttgcaaaccggactgaagctatcaccgtcggtgaactctttgctcaacttgttagcttcgaaactcgtatggagattctgtaaggtggctccaactatgattcgttggccttcactgtagcttgcgaaggcttcgaccgcaggcaaggtggtgactgcatgcggccacgtacgtcggcgcgaaaacaatattcatcccatagaaacaaatattaattgttagatttgtcactataattgcttccaaattatttctcttcctccatttcatattacaagatactttaaatttttttcaaaattttaagtttaaccaagttaacaggaaaaaaagcaacatctataaaattaaattaaattagtttcattaaatctaacactaaatatatatttaaataatatatttttaaaaatatcgttacatttcttttatgaatttaatcaaacttaaaagaatttaatttaaaaataagtcaaaatacgatatgaaatggagggacgaatattctttaaaatttagggtcataagtaacaaataatagtcataatagttgtttatcgaagaccgtcttataatatataaacaagccagttagtttttttgccatgttttacttgactcactttgtcatggtatcaatcgattctgttttttctgtacatcttttccctaccagtaaacatggggtttccttttgctaatccttctgcactgttgtctgcctatgttgttgttttcttttactaatcactaatcatccttgctagtacaactatgcatgactgtgatagcttcttactttcaggtactcaaggtcggaaggtcccctttatactcaagatgatgatcctgatcccaggcgaggatatcaagaatccacgagaggttttaagagcatcctagcagatgctccattcggtactccatctgagatttagcgcacgaaagtgaaaatcggagctccagcagacacaccatcgaatcatccaaaaatagaggatacgcaaaaacggagagaggaaggccaaatatagcgtttctctctccaaacgtcatatcgcaacggccgcagctcccgcccctatctgaagttccgcaaccttctgatgaaccctgagttcctctcaacactcaaggctgatgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagttggggtttcgaatacaagcagacggacggtctggccgacacgcgcgctgcaagcgaagtagcaatggctaaactttcatctaaacaaaacccgagaaaccctgaaggggtaactagctatatataggggtgggaggacgacctaggggtgcctagggtcgtgctccaccagcttggggcgcaccccacatgggccccacctgggccggggtcccaattgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttattgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatatcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtatcgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctgttttttttggtgcggctttttttttctttttttttttgcacctttctaccttttttttcacttttttcttgatttttttttaacaaaaactgactcaaggaccttaatgtaagattacagggactcaaacataaatataaaatttacagggactcaaatgtaaaagtctaaacctaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaataatcttgactacttccaaaatcagatatggtaattcaccttcctcctctcgtgcacgacagaggcacggccaaaacaaacacacacaaggatcggcaaactctagatgcaactcaagaactctaaaactaaccgacagaaacttctgaaaactacaaaaatagaactgtggcagcgagtcgattccgttttcgtaggtcccgacaacaatagagacacggtggcagcgacgactgtggtacaaaacatgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgattttttttgtatggctattttctggttataggaagataaaaactcaccgagcaacgaaagctctgataccacctgatgaaccctgagttcctctcaacactcaaggctgatgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagttggggtttcgaatacaagcagacggacggtctggccgacacgcgcgctgcaagcgaagtagcaatggctaaactttcatctaaacaaaacccgagaaaccctgaaggggtaactagctatatataggggtgggaggacgacctaggggtgcctagggtcgtgctccaccagcttggggcgcaccccacatgggccccacctgagccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaccttcccctccgtcgtcgactcgtcgtcaccggctggaaggagagggaggggcataccagatctagaagataacgtcgccgtggtatccatgctcccttccgcccctccatgcccgtcgcctacctccacccctcggctatcgcctgtctccaccacgcccaccggccgccgccgccgcctccgcgcccatctgccgccaccgctgcctccgcacccgctgcctttcacgcgcgccatccaccgccgctccacctccacaccatgccgcttcgctccgcccgctcgggcgtatcggttctgttcggctggagaaaatggatgctggggttggggtttggtcctgggaacgttgatgtttatatttttttttctttgctctcacagtaaacttggtagactgttgttaatcaacctcaatatacgtgagagattaattagtaactatgtgaagcatgtttagcaaataacattattttttaactaattcaggcttaaaaaacatatacataacaaagttggttagaagatattattaaaatatatgaaaggtgatatggaggatgtaatatggatgatttgttggagtaggaataaatatagagagagaatctttttagatggccatccaaactgagatatggagtaccgaaaactgagatatggagtaccgaatttagatgagttgctgggcatgctctaagccagatgctaatactacatatgcatggccatctatttcacatactctcatgatgcaactataaaacaacaacatacgtgttcttacttcgtttttgtggttaatttcgccgcatgttcttaatgcgtttttttgtggttcatggtatccatatatgctacaagactacactagcatgactgtgccgtatatctcgtatatgtaccatatgtgttttgattgacagtggcgtacaccatgtagctgcactaaatttagtaaaaagaaagaaaacatgcatctgaattattcatataaaagaaacacgtattcatagacagatctgaactagtaacggacaggctgaatctgtagtgaatctagtaggcagcgggtggtttgggcttgttgttcggtttgaggatgagatcggctagaggataccagattattggtcgcttatgggcttggacgccggcagcgaagaagaggatcagggcccagtccgacatcacggcctggtacaccctcggcaaggggaggacgaggctcatcaccacgagcagcacgccgcacgagagcgcgaagccgatccccaccgccgccgtctggaagtccgacgatctcatcgccgcgcgtgaggccgctgacgccatcgatccccggccccctcccgccgccgccgccgccgagagaattcccttttttttttcttttgctgatcctatcaatgtttctcttggcccttgccccccttctctttcaatctgttgctgtttaggttatctgatgttggttggggtatatatgaactggaaaaatataaatcatgtactaatccgtgtcctaaaacatctcggtccccgatctgtttggttatctgatgcgtattggctcgcgcgcgcgggtcacgaggctggtcgctcaccactctccacgcctcccgccattgccgtccagttcctctcacacggagcttggccagctcggcctcatataatagcatatatgttttctcattatattattcaaatatattaaaatgacaatataattttaaattttgtaataactttacaaaactactaatgtgcaatattcatatggtattttatatacgtgtttgttattaattattttttaattccaaattttctgtaaataatatttttatatagactataggctcttcttccaatattatttatttttatttttgaatttttattatttctaattgtatttctatgtgtactctaaactcatttttcaattttctttagtttttaatttcgaatttcaattacttctaaattgtattcctatattgactttaaactcttcttcccatgtttttcttaattttgaatgttagttatttctaaattatatttttatacggactctgaactctacttttaatttaattatgtttattccgaattttagttagttttaatttctatatgaactctatactctacttctaatatttcttatttttttaattccgaatttctatttttttaattgtatttctatatggactctatactctacttctaatattctttatttttaattctaaatttctattatttcctaattatatttctatatggactctatacacttctaatattccttatttttaattccgaatttcagttatttcctaattgtatttctatatgactctagtctcatcttctaatattccttattttttaattccgaatttcaactatttctaaattgtatttctatatggactcttgtctcctcttctaatattccttatttttaattccgaattttagctatttctaaattatatttctatatgtgtaagttcaagtgccttaatttggtttcggtgattaatgacacatctaattatatgagactaacgtttttatgagcctttctttgactagtcttatttggatatgaaagtaaaaatgatgagaggtatgtattaaaaacttcacatattctaacttggtctctcttgtggatccaaaatatagtgtgagctccctcattgatcttgattgataatgtgcatatgcattccttcatatccatatatatatgcacatcttgagggggagcttattctatattttattcattataagatctctatcttgatttgaaattatctttcatctcatcttattgtattgtttatatcaggttattatctatcacaaaagagagaaaagattgaaagattttggattaaacaatttgtgtaattgttgctttggtgatagatgataaatcgatgtttatgggattaacctctctttttcataagttgttaactaggttatttcccgatgatgagatgtggtagatatgcattctttggtgatggaccttaatcatgacaaggatgaaatgcatggaaataaaacgatatgtaccacttcttatctcctttttgataggtttatatgtatgattttcatgttattgttatataagtgtgagactaatgtttactcgagtcatatcttatttagtctaatttacattaagagcatggagattatgaaggtatatgttttatattggtctacatcattactacatatgccttctctatgtgtataggataaaccccccattggttcttctttacttatgcatacacttgtctctcttgtatatttctttgtatgcatatacttagggggagcaaatcctatacatttattgtgtatgttctagatccatgttgttcacctattatttatatcggatctttgcacttgagcttgcatacgggtatatgacacttgaggtgtaaatgaatactcaacaaacatatccatatctttcatatgcaaccggttggtcatcaagtgaaggatgacaaccgatttgttgagactaatgttctcctttgagatgtgaaaaggaataggttccatcgtaatgaggctaatggatgacaacatgggttgatggtcaccaagacaaggacatcgccatgttgacaatagtgaagtcaagattgtgatgagaagaaaggcttgacaaaggatggtcaagacctcgggataaacatggttcaagcaaatggtcacgagtgttgatcttggctcaagcattgaccccaagttggatggcgcaaggcaaagatataatagaactaaaaatgttttcttagtcttttcccggtcttggtgtttggtgtagaccggatttgctagataggcgccgtactatcaagaggggtctatgaagcgagcatgtggatgatcttgtgccatattagttcatatgcatataggtgtattttgtgggcttgtctagacaagtgtggtgagttttatcaagtcccaaacaaagagagaagtgggcacatcctataggtttgggtagcctcatgtggttatgtccggtggagtatcctttggagtgtgagctatttctccctgataaaagttgtgtttattggatggattgttcatgggttggatagccctttgaataagctttccatatagtccaagaacgccaaattccgagatccgagtcaagagatatcgtcgttttactaacggttggttgtgctgaaaagtgacctgcggtctgaccgtaggccttaggtcggtctgaccggggctgttagccggtctgaccggtgtggtaaggccggtctgaccggccctactggtctgttgcactggtctggtttttggtggcgatacagagccgccagagccgcaaccggtcagaccgagccgacggcggtctgaccaagccgtggacggtctgaccggccactacactgctgtcagaccggccaggttgagtgggctcaatgattgccctgtaacggctagttttctagccgttacaaagtagtccggtttgaccggccactctatggcggtctgaccggccgagcacagagttggggatttcgactccaacagctagtttaggtggttgggagtatatatacctactccccagcagcaagattaaggttttggcactccattgcattatcttgaacctttgcaagagctctcacatccttgtgaacttagtttatctagtgatgtgttagagagtgggataagccaatccaagtgcattgcttcattgttatagctagtgtggcacttgatcatcctcagcaagcatcctagacttgttactcttggaggttgccgcctcctagacggcttgtggaggtgttgcccggtgacctctccgaggagattgtggaggaggcccgacgccggttgtgagtagtttggagttcaccaacttcggagtgaaggaagaactactctagtgatcgaggcttgggtagtcctctccgtgggccggctcccaccttgcccacctcttgacgaagggggcgtgcggtggcttcgtggttgagcggtggagttgggctcgcctcaacggggattaggaaaccagcgagtttccgaacctcggtgaaaaatccctcatctcttgtcccatttatttgttgcatttacatttgagcaagtttacatagtagagcttatttgtgctattatcaccctaggcttgcaaaccttaacatagagtagcttctttgtgcacttacgtgagactagttgatttaggttttgaattgtgcaaaaccgttttgatttacgcttccgcatacaaaactcgattttagccaaaagttttaaaaccgcctattcacccccctctagtcggccaaaagttttaaaaccgcctattcactcccctctagtcggcctccttgatcctacaatatggactatgcttttttctttttctttttctccgattaatgtgagaatttataggtcatgagagcgaacgaggagactcctttttctatttctttaataatataatagatttggacaggcccttgttcagatttattggactagtatatattctatccaattccaaattgatgcgttgaagacgcctgctgaggtgtgatagagtaggtagacgatcgatgacatatttgcggatttgcctctcggactttattctcaacacgcgcatttctctcacgaccactcacacaaagggaatttgatttgagtgttgtggagtaggtcaatatataagatgaaaggccttgcggacaagatgcagtccgcaggaaagcaccttgatgatgatctcgtctcctacatccttgctagtatggatgttgattttaatccggtggtgacatcagttgcaaaccggactaaagctatcactgtgggtgaactctttgctcgacttgttagctttgagactcgtatggagtcgtggaggctttcgaccgcaggcaaggtggtgactgcggccgcggacgtcggcgcgacaataacattcatcccatggaaacaaatattaattgttagatttgtcattataattgcttccaaattatttctccttccattttattcatattataagatactttgattattttttcaaatttttaagtttaaccaagttaacatggaaaaaaagcaacacatataaaattaaattagtttcattaaatctaacactaaatatatttcttaataatttttttgggttaaaaatattgttatatttcttttatgaagtagtcaaacttaaaaagatgtcaaaatgtattctgatatgaaacagagggatgactatttttaaaaaatttagggtcacaattaacaaataatagtcatatactatgtttattaaagaccgtcttataatatataaacaaacctgcattttggatttgatcgattgatttagttgtgagggaaaaaaccccattaatccgtaccacctcctccaaaaaatactcaatccttgatactctgtaataaatatggccatatatattgctaaatacagtctgcggtctgcctatacttttgatttttttttcaaaccaccctgttaggggttaattaatctaaccatataatgtgtggtccaaaaccgatacacgcatcatcgcaggggagaggaaacggctcaagtgtgtactggttgccagcatgtttgacttggagcttcgattattctatgcgtgtcttgtacccaacgttgcagttgcactgccaccgagggcagcaacttgccacaaactttctttgccctaatttggtacgagcaccaagggattagactaattaaacctattgagaaaccggtcactaatcgttaactacctctacgtatactctaaaaacctcgtgaacagtcactggcatgtagaaccaattacgcctaacctgccaacaaatactataacgttagtgtgtctagctccgtaagagcaagaagaataatagtaagctataaaactgatataagctatagtaagctataaaattgatataagcttatgtgaaaaagagaagtaacaaaaaaaataaataaagaatattggctgttatgcaagagctagtttaacacgtgttgcaagacaaatatattaaatgtataagtaagagagaagaagaaaaattaaagctaatcttataactaatctatcatatatgttggttttaaaatgggctaaatgagtttacaattaaacttgctataacaaacatattctcgtaataagataaggtgagaacacatgacagccgccgaccaactaattaagccccaaacatgagacaaaaacgacctcgaattaatcatgggtggcaagtgcgagcctctgacagaataattggacctcaaatcgatcgcttagttaggatttatttctgacttgtgatctgcgagcgctgtgaaggtggggggtgatcttgatttgtttagcccagctgtggggcaagatcctaagctggctgggtttagcagttttcaaacgcttaaataatgcgtcgccgggtttggtgattagcgctgggaatctcttcgcagatgggaacaaaagtccaacacgacaccacacagggcaatcgggggcagcgtcctgccattttccgctgaaaattttgatcggtggttgacccctcttccgtgtgtgggacacgggtgaaattaaacggcattacgtccatggaaatggttctcgattgatcggtagttttcgtattttatgaattctacaaattgactttatatagatgtttaaaaatttattttacttttatagaaattatgtttgatcactcagcaatttctgtttcgtttatatttgacattctccctccgtaaaaaaacatagtattagaatgtgataacgactctataagaatgtccaaattctttgtattattatatgccacatcttagcacaaggttgtttttgttttttttttgacgaatagagtagtgcgcaggggtgcggtactctctatagtcgtcgcagctttcgattgtgtaacaacagggctcgtttgaaacacgagaggggaattactgtcaacgatcactgtgaaaaaaagcctgtaaattttctcgctgtcgcgagcactagcaacgcactcgcgactcacacatgtgtgtgtggcacgctttatggtggcacgcgtgcgtatgctagggctaggaaggtctcgcaggcaggcaggcaacgagaggcttttctcctctataaaaagtggttactgtgcagaggtcaagccacacacacacacactgatacacagatcggcagaaaggaaggagaagcagccaagcagaggccccggtcttgtcaccggaaagagagaaaaagagaagtgaaattgaggaagaggaggagaatgtgatggcgcagcagcagcggcggcggcggcgcgggggctctctcgccgtgctcctcctcctcctcctcctcgcggcgctgctgctctccctctccctcctcgctcgcgtcgacgccgccgccacggtttcgtcaggtagtactctgttgcgctatacctcgccgtcgccggccggccgtgcttctccctcttctttcggtttgcatcgtcgtcgtcgccgtcgttgcgctcatgcccgtggttctttctttctttcttgcagcgaatctcgattggaatgagggagaggtggcggtggcgactccgctaggacaggtttgcctgccttcccagttcttgaatctttgatcatctatgtgcatcctctcctcctgattacgctactctttaattaatcttgtttttgctgtgacaggaggcggtggcggcggcggaggaggagggtgaccggccgccggagagggtggagatggagtccatcaacgactacggccaagccagcgccaacaaccgccacaacccgcatccgtgacatgacctgccaaccggagctggatcttaattagctactactagttaattatctatgcaatgttctcctcattatctaaaaaaaatgtaatgtgttctcctcagtataatactctctccgtcctacaatataagagattttaattttttatttgtaacgtttgaccactcgtcttattcaattttttttgcaaatataaaaaacgaaaagttgtgcttcaagtacggtagataataaagcaagtcacaaataaaataaataataattttaaaaaattttgaataaaataagtggtcaaacgttacaaacaaaaattcaaaatcccttatattataggacagaggagagagagtacttgttagtgccaagctcacacaccactctccctgctggtcaacctgtacttgtagaggcatgcatgtaccttcacctttgcttcgttttcgtattagaaagagagatcaagagaagcatcgatttctagctttgtactttcgagttcgtattagctgaaagggacaaaatctgaagatgcaggcagtacatttgtcactcgcaggggaaaaaagtgcatcgactaaatttgacccaaaattaattcagcagcttcagtcacaactaaaaagttcagagagcttgggagctgagcagaacaaacaattcttgcaaacgtatgtaagttgagtccgccccaattcatgcaagtttctagcatctatagcttctttcataattaaaatctccccacaaacaacccagcttttcatccgatgatgaataatgctgagatcaaggccaaagcggtgactggtgatgacgccaaccggcggatggagcagccgctatcctgactctgctcggaccaggggctcttatgcaaatactcagacgctaccattggtaggctggtagcgatccaatgttttgcaaagattttgcttctctcatctcttgcttttggttaaatcttatctctcaactctaaaactgggtataacatctcctctaactttaaaaaccgatgtaaattaacacctttagtagttttgaaacggtttctgctcacgtggttggtcaactggtccacgtgtgttgatgtggcatcccgttatcaaagaaattgaaaataaaagtggggcacacaagtaagtgacaagagtaaaattttaaaaattgtgaggcccacttgttagcccactactcccttctcaatcttgacgtgtcaccgctggcggcagtggacagtgacggtgatgacatgcatcacccacaatgacaacgagcactgccgtcgcacacgctgtcccatactcgtgcttgaagagccccccgtggcggcgttgaagttgggtccggagacggcagtgtggttggcgacggcaggggtagcaagggaaagagagtagcgaagaagatttactgcttccccatgccaccggcctgtctcaccttctgagcgtcctgctgatatgagagtatcacctacctctgattggctcgccagggaagagaggaaagagaaagaggaggagaggtgaggaagaagatgaaagaggaggaagtcattggcatgtgggtcccacctgctgactcagtgagtcaaatctgccacatcagtagaaaccactccccaaacacccaaggagttgatttacgccggtattcaaagttgagggaggcgttaaaccggttttgcggttgagggttgtgattcaatcagaaccagagatgagggaggccaaatagacttactcattttgcaaaatgtcgtacactggctttaatgggctaggcccacttgtccattgggcgcccccctataccttgggcttccaaccaatccatgggccgggaaggcatcggacggccgagatcctcccatccatcgcggtgtcccgatcgcggccgtcgcaaagtcgcgcacgggacacaagccgaggagggttttgaaaccatcctgggttttccaccttttccagcggccgcgacaagtccagcgaggcgcttcctcctctcctctcctctcctctcgcgacttcgcggcggctcgctcgcctgatccatccgtgtctcgcgcggcggcgccatggcgggggaggcttcgccgcccgcgccaccggagatccccacgaggtgccaccactgcgccggccccctctccaaggacatggtacgcgtgatcccgctccccccaccccaccacagctcgtcttcacctccccgggatctctccccttggtcgtgcaggctccgctgcaggagtcgtgggtggctggtgcccctgcgtcgcgttcgagtggggtttagttttcgtttggcgtccggaattgggtcgtggttctagttggtaagttatggtgccatggtggtgttggctgttcatgtatataggttgtttctcccccttgttgatttggcctgcaccgtggtttgtttttggatcatgctgtgtggatggctacctaccctaggacaagtagtttcggctcgggagggaagagttttgtttcaggccggggtcaaactaatttgtgcgattgaactgattcgtcgtgtgtggttgcttttgaaggaaacgagcagctggacggtgcctccactggttcgagatagcttctccatggtttgtgttcctttgtcttcaactgtgctgcacacataaattactctctctttttttgtggttgcacaactttatcgaattcggcttttctttatctgtttttcttgtgttaggttgatactattgtacattcttttttctatcttgtaaattctgatcggtatgttgctaaagttgattagatttgtttcatgacatgtatgtgatttgttataattacaaacttttacataatactaaagttgtcctagaagatctttgctaataatatttgtgttatgttctgacagattggttctgctattgggggtacagctggagcattttatggtttcaaccacagtaagttgctaacccatttcattcagttactcatgcacaagttggtattttgcaggaaagtaaatcattaggtttctaacaataccttttagcaccttgtttgcacttaatttactgtggggggttctaatagttagcttactgtggggagttctaatagatagcaatatcccctttgcttgcttggctagtttactgtggggagttctaatagttagcatacttataatagtcatttgccttattggtgaacctcagtcatttcaaagctcagaaacatatgtggacaagataatctgtagttttttattgtctcggaaatgtattgttcatgttgtccactcaatgatgattgttatcttctttgtaaaaacaacaccttgcacactatagaacacctttcttgtacatcctctctgtgtccatgtctatatgcatggtaattcctcctgttttaagttattgattgcaacttttgttggcggatgcatcttgaacaaaattgattgaccatgtttgccctttcataaaagttgatatatcttctgagcagcactgattttgaacttcttttgtagctatgccttttgttcgacggtacataaaagggccaatgtggatgcattttcttgttggtgtaagtgacaattctttttcaaagtttatattatattattatcaatctattgagcatgaattaggctgtgttcgggagtgagggttgggtcctagaacgcaaaacgaagcagtgtttagcgcatgattaattaagtattagctaaaataaatttgaaaaatggattaatataattttttttaagtaactttcatatagaaattttttataaaaaacacaccgtttagcagtttgaaaagcgtgcgcgcggaaatcgagggaggtgagttgggaaagtagagataagaactcagccttagagtgttgcagtttttagatggtgtattattttttcacttcctgattatgtttcacaatctctaggtcatctcaaaactagaaacacaatttgatgccttttcttgacacctccgtttctatgtaaattattttaaaacactacagagaaagcattcaaatttcatgttctatctcttatcgccaaaacatctcttatgttcttttacttggacgggatcgtgagttcaaattcacgcgtatggtcacagactcacagttgcatccaaagggcagtctcagccaaatgctgtgcagttccttctggttcaacaaatgctgtgcagttcctgactttcgattaactaatggtgataattactatattcacaacatttaattgactgtctcatggttattacagataaaagtgttctcgctattactgataaaagtgtataaactgcgcagagatgctaccttttgaagcaaactgtggacattgataactctgatctttttttaaaaaaaaaaatcttgcaggcacctccagttattgtcttctcttctgcatgtgctgggttagcaggtcagttactactattttattttattttggttttttggccatttaactatttttttgctcatagttctgttgtctacaaactcaaattattatttgagttttgtgatatcgtggattcgtggtcattatattaggtttcaagccgatcttatttaagttttctgcagagttaatctatcttcctgtttgttttattcctgatgatgactagttgcgatgtttctatagtgccttgatacctgctcatcatagacagttacttgaaactatgagtcttatgactacacatacatattctgtttttaaggatgttctatgcactctttaaaatatgtatgtgagtacctttcttgttgtttacatgtaaacaatgccaggacgtagtgttatattgtttatgctgatagatcttatgagctcgtgaaacattgactagtcatctgccatctggttactgtgtggtccatgttatttctcattgacgaacctagcgagtcaaggttcatcctggaaatgttttattctcttcctcaaatcttatcttctattcaatggatctccatgaaattgttcgctacagatacattgattggaggccaaaaaaaaaaatcactaaagcgcagcaatgacacatgtggttttaataataatagaaagaactaatagttggaatattcagatgtagttcaaaacctcattaaaattgttgatttttgccatgtcactgtttttattcactatgcgtgatggatgatctgaaggttgatatgtttgtaggtgggacaataccagcgcttgcacagctggtatcatcatcctatcactcagccacagcgtcgtcctttgcccacacaacttctcgtgatgaaatgcataaggccagaagctcctcgacattgtgatctacagtggcagcaaattgttaactggaatcctaactatccaaaacaccatatactattataaatgtgcatgtgttaccacatatcatctgttttatgaggaatgctcttgtaaatggtaaaactttcccctgtggaatagtgcttatatatgttcccaattttgctatttatcaccatgcacaggctgttatttttgttatggtgtcgcaataagcctggagtgttgcgaattgtgatctgctttaaccttcaggatgccattttcgtttgcaatatatatgcacattaccttttgctctctacttgtctaaacatttaccatgtacgatgtctgtcgttttgactgttttacgcgcatgccattgaagtgagtttttacttatgtgatctgtactcctgcctcaatttatttgatggcatgtggcagattaaagtgtgttgtgccaccctaggaatctaatctaggatacccctgccggtgccggatcaccgtttgtgatgaccgtgcatgatagggtgtggcatggtgtccaatgtttttgcatgcattgaatcgtagccatcatacattgaattctcgcgcctcgtttcggatgccatttgatctatctcctctcgctccatccatttcatgtgccaaaaaggccactgatgatgcaaaacagtggcgatctctggctgaatcctcgcggaatggcagtgtgtggacgtgcctctctttgcagccttgtgttgtgatgtgttggagtacatgcttacatgtgtacatacgccgaggcactgtgagatgcatctagccacctgcgtcactgcgtgcgactgccaagatctctcgccgaaagttcgacgagatccagtgctctttcaagcactcactcatttggtgctttggcgatgcttcgagatgtttgggaagcttgttgaactagagtggagatagatcatgtatgcttgtgttaattttggcatgttcctttttagaaccaaagggagtaatacagctactatcttaatataattcacgccctatttgggtataactctaggctgcgttcgttcgttgtgatgagttagttagtttgtgtgttttgttttccgcgcgtacgcttccaaactactaaacggtgtattttttgtaaaaaatttttatagaaaagttgttttaaaaaatcatattaatccatttttaaaatttaaaataattaatactcaattaatcatgcgctaatggctcacctcgttttgcgtatcttcccaatcttctccatctccttcaccccagctgacaggattggaatccttgcgtccacaaatattacacatggatacttatggttggattttagttaagtcagcaaaattgtcactggactttatctcttgtagtactccctccatactcacaaaggaagtcgtttaggacattgacacggtcttcaaaacacaactttgacttcttgtttctataaaaatattcattgaaaagtgatatatgtatacttttataaaagtatttttaagacaaatccattcatataatttttatattttcaaactcaacaacttgagagttattcatgatttatattttcaatgtttgacttaaacattatcctaaacgacttactttacgagtatgaagggaatatgtgttaagcgagtgtactcgtaagcatatgtgctcgtctgaattgaaaaattaaaaatctgtcgtaggatgttttctaaactgaaaaaaaaataatatatattttaattatttgcagcagcacaacgtgataatagcaggttgtatggcgcattagccttggactgatcggtcctggccgaagtgcaacgctgtaaacgcagagcccagtgcaccgcaacggaggaaaaccgattggccgccgccggtgtcgtccgcccgcgcgggggactcacgtacatcgttgtaccgcgcccgccgcactccttcgctcgcgcgacgtcaaccacacacaatttcttttagagaaaatataaaaaagcaatccactgctccctccatcacataatataagggattttaagtttttgtttgcactgttttatccctcgtcttttattcaaaaaattttaaaattattttttttttacttactttattatccaaagtactttaagcataacttatcattttttatatttgcacaaattttttaataagacgagtggtcaaacagtacaagcaaaaactcaaaatcatttatattatgggacggagggagtacaaactagtctaagctaataaaaaaattttgagacacatgacacgtactttaagaaatgaaaaccagcggcacgtccctaatctcactaaagtctggttgaaaatccacctacatgtgcgtaatattcgtggacaccaggatttaaaccatattgggtgaagtcatgcactcacaactccaccaccacaccacgggtgcttccccaaattgaacataaattttaattagcttttaacaattcttagggtgaaatgatcttttatagcggttaacaagtaccgctaacggaaacctaccggcagtgatatgtctagcacaaagacacttgtacaatatcattatcggaaagatgggtttgtcaatgattcttcttcgattgatacgcttgtcgatgatatttttaaaatgttctcttttttaatacttcctctgttccatattatatctaaatttattaatattcatatgaatatgagcaatgtaaaaaaaagtatgataatatgaaacggaaggagtataaggaattagatcgcgcgagcgacgcggacacactcatgccgctcccgcttgcccactgacgcgaagcgtgctcgagtgctcgaccagccttcgtctccgctcgcctcgccgtcgccgtacgtcgccctccgcgacagcctgtgctcccgtggctccacccgctcgcctcctcctacaaatcctccatcccgcctcacctcacctcacctcacctctcactcactcacacgcgataaaagagtttgcaacaagtggtctccttccatggacaggtacagggtcgcgccgcgacctgtctacctctccgccgccgccgccgccggcggtgatcacggcgatgggccccgccgcctgccacgcggtgtcgccggcggcggtggcgccgagctcgacatcttctccgccgagcgctacttcaacgcagacgacgtcgtcaagaaggaggagtaccgcgacgaggagcagccgcggcaggaggtggccgtggatgcggccagccagagcggacgcaccgtggcgtgctcatcggaggcgagctggaccagccgctccgggctgctctccggccacgcccagtccgccgcgtcggcgggtgctgctgctaagctccagatgggtggtgccaatggcggcggtttaggatcacggcgccgcttaaataatacctaagttttatgtttaacgcaccctcttgactttttcgcataacggcttatttaaaaatttaatataaaatattttaaaatcctaaatttatattataatttttttatcataaaacaagttacaacaaaactatgcgatttatataattttttttagtaagatgtcaaacgtcatgttaaaagacaacggcttgacggaagtacttcttaaatgccatatcctttatatactttttttcgtgtgaaaacaaatcttgtttcgtttgaaagaaattgggatttaatctaactgcactttgggcccccattttgggtttggcttttactatatcagctccgaattttaaaaaacttttgctgcgtgcgtcttctgtaataatatataatagattcttctattgtgtcaaaagctcctcccaaacttctctaagaagtgggcctcatttttttcaaaattttttttcccgccttttttttaaaaaaggaaaaaacggattcttattggttggtctttttccccaccttgttaaaaccaccaatctttttccaacttctagcttggtgagaatgttacccacctttctacg

SEQ ID NO: 79260 - DNA, 2804 bp, Oryza sativa
gttgggttgggtccaacgggaaaggcctccacaatgtcggtcaaaactgtggggaggtgtgggccgggggactgacaggtggggcccaccccgggtgtgggtgggggctggtaaaaagatctccaggaataggatgtttcttgactggagggcatatttgcccagttgtccatccatgctgatgctggggggcggtggatacaaccaaggttgtctctcaggatcgagataggaagtatcattttgctcaaagtaatatcgtatcgtagtatcgggatactatgagattttctttttttaagtttaattaacatttatattaattatatatatagccattctatataaaaaaagtagtaatgatatatgtcatgcaaatagagagacatttatcaagagaaaccatgttggttttgatatatttaactgattttcatataaatttgagcatatttagttacattattttcaaaccatgttattttaaataatattttgtagtatcctagggattgtacgtttcggcttggtaggatcgtagtatcgtaagatactgggatacgaatcgggatactgacaaccttggatacaacttgctgccgttcgatctcctcttttggagatattttcagcgcatgtaaaacgagaaaaataattaatatataattaattaattattaataattataaatttaaaaagtatttatttaaattttttaaagcaatatatatatatataatttttttaaaaaatatcatttaacagtttgaaaagcgtgcaaaccaaaaacaagaaaattaaagtttgaagttgaagaaaacttggctttgtgttattttgtttgatagaatgtttaaatatattttgcattaatttcaaaatattaaaatgaaccaggatatgatgtttctaatcacgtaggttagtagtatattttaaaacagagggagtaataccttttatgtccgttcgagcacgtaaaatgagaaagccatttgtgtataattagttaaactttaatcattttaaacttatgagactatatttatatgatattttacaataacttatatataaaaagttttcacgtaaattatactgtttaacagtttaaaaagcacactaccgagtgccaaaataaaatatatatctttattaggggcatttaacatatcccatccacagaaatggtgttctcaaggaaaggaaagaaaatccactgaaatggtagtacatctatcatatctggtggtttgccctgctggtttccgttggctgtctcctgcaaaccgtgcacgcgcgccttgggagcgaagccgagtcgcacgcagaaattgaccgggcgcgtcgtacgacacacacgcagaaattaaatgcgtctcgttctagaagagttggagtcacgggggaatttctcgtcctctttttttgttggaaactttgaacgtctttgaacccaaaaaaaaaaaaaaggtcggtgggagaacaaaatcgcaaatggcttatgcatttcggatatgattaaaagaactcttttgatttcaatctccatcgtacaaatatcaagtttggcaccatgatgttacaaccgtttttgtatttttgcaaatgtatagtgcttcagttgtcagttcgataaaaatagcccttttttaaaaaaaaaaatcggtggagcatttcgttttctctcgtgtttaatagtggtatagacgtatagctgtttaaagttaatataataaataatatgtccccacagccagcaatagcgccccacctgctggtcgagatcaattagtacttattctattaaactaaaccatatgttcagattctcttctcgagcattctctctttaatctatgctctttccaccgaatcaacttaagtcctgtttggttacatgggctaatgtttaaccctcatcttttagtctcaaattagtcctcaaggatttaaacaggtgggctaattttgagctaatgtaaattagcccctcctcgaaacattagcccctccaaggggtgctaatggggctaattttgtgtggggaacatcaaaaagcagctctctctctccttctctctcctctctttctactctctccaccttttagccttaaattataccatggatccaaacataccaccctaggctaatgtttagcctaccaattcataactaaacattagctctcaaaattagccctgagctaatcttccaaacagggctctatacatatgccacgcgtatcgtgcatccgttctggcgaacattcccaacaactatatataaaaaaagaaaagacaaaatatttaaccatcagcgttcactaatttaacacctaacctacatatggcttacacatatggtaaatatctaaaatgataaatagttaaaatgccataaaaatgaactagtactagtacacttggtccaaattggtatccgtctctttacgaaacaatgagcttcaacttcttttagaatatccagctatcaaaagctcgtcagacaatttagatttttcacctaaaatctaactaaaagccagagattaggtttcctagcttgtccagattcttaccagctgtttttaagaattttaagttccacaaataaacccttatattcatccctaattggagtaatccaaagcgattttatcaaatttcacagtttcacttttcaaagatttttccatttgtcctattagcaaccatgaaaacgaccaaaaagcacctaaaaatctaaatttaaattcggcgttgaatttataattcaacaacgagccaagcatacaaca

SEQ ID NO: 79261 - DNA, 1807 bp, Oryza sativa
tactgccacaaggaaaacaataggaaaagtgcttgcctagatcttggatttggggctggctcctccacatcgattcctgccacttgtctccacttgatttgccaaaagcaggtagtagaggccaccggtccttctctcggtcaaaaggccatccaaaccatctccaaaaatctccgccgccctcttctccaaccaactccgccgccatatgatgaaccctgagttcctctcaacactcaaggctgttgttggcccgatctttcggtgagttgtgataactacgatttgggagaaatgttgacgatccgactacaaccgtacaagacgttctgttgcgccttagcgatcgatacgcctctccgtgggttgttgatcttgccagtgcagatcaatcttattcctgcaagcaaatcgaagaaacaagcaagaacaagataaaagcaatctgaattacaaataggaatgaatacacaagataagttggggttccgaagaacaagcagacggacgatctagccgacacgtgtgctgcaagcaagtagcaatggctaaactttaatctatcaaaacccaagaaactctaaaggggtacctaactatttaaggaggtgggaggacgacctaaggggaccctagggtcgtgctccacctggttggggcgcaccccacatgggccccacttgggccggggtcccagagaagttacaggcccataggcccattataggtgacgcaacaccttttttttgtgattttggccgactgggttggaatttggcgatgaagctagatcattggaaagatgactctgagagctttccatcaagtaatcatggatccaaaatggagcttgcatgcatatttggcggccgtttgaagtccacactgtagcaggtagccgaactggattgcagaacttggacggcttgatcttgatgtgaacgacggttgtatctatagtagccatggtcacatcaccatagatctagcgctggagaggaagaaggaatagaacgagaatgactcgacctaaactacgggaaaacccaaccagaaacctacactagacaccttaagggatgcgatctgacccctcctcccatcgtcgctggcgacgagccgccggaaacccggggaagagaggttgggggagaaagttttttttttccgactcgctggtcgcttcaggaagcctcctctctctccatcgtccgatgtaaatagatttattgtactaggatgtgtcacattctttgcctatgttgagtttttttttttacggagggagtagtacttttatctgttttctttactccctagcgagaaattggatattacgccactgccaagagtgggattcgccacaatgccattccgcggaatggcgtcgttaaaatgccactgccaaaactgggcttacatttgttttgctatttggaccatttcactccattttcacctaatttttcacccaaaatgcccttcgatctgagtggtggttgccagtggcgacaccgagctaaccgtggcagaggccaaggaggaagaggaagccacccacgacggcggtggcatgcacttccagtggctgcgcgccgcggtgctaggcgctagcgacgatcttgtctccactgcgtcgctcatgctcggcatcggcgcggcgtgccccgccgacgagcatgccgtactcctgtccgggctggccggcctcgtcgccgtcgactggccatcggcaagccgtcttcctgtccgggctaaccgggctcgtcgccggccacgcgcagctcgatgtctacctggccgaaat

SEQ ID NO: 79262 - DNA, 11824 bp, Oryza sativa
ttttgccatgccaacctgcattacatggacaaaggttcatatcatggaaataaaatttagaagaatttatttttaaaactaaaaattaaaatgctcaaaaaataaaaaatatattcttaactaacctggtgaaacaaaagaagcccaacagtcaggccttatccaggaaagcggagcccaagcccaacaaacccatttacccccagcgtgggcaggcgaaccctttccctcccgtgcctatataaggccacaaaccctaacgcccccactcttccacctcgcagtcgccaccccgagcagaagccgccgccgccgcccgaaaccctcgccgccgtcgcttctcctcggggcgcagccatggtggccgcaaagaagacggtaacgttgtcctcctcccggtctctccctccatcacctcggtccgccgcgcaagcgagcgagcgagcgagatcctgcatttctcatggcgctaacgcctctctgttcgtcgtggtgatggtgtgatggtggttgtgtttgcagaaaaaatccacggacaacatcaacaacaagctgcagctcgtgatgaagatcggcaagtacacgctcggatacaagctcgtcctcaggaccgtcaggaactccgagggtaagagggatcaatgctctccgttccttggtagattacgccaaattatagtttaaggttagcatccgtgttgttagtattgcggttttatagtgagtttgggcatcgtaataactgattaccggtggatctcatcgccgccgcgtatgagtcgatgccacagtgattagccccactgtctctgttcttctgaatgtgcttgatattgctgttcagtagctgatggtggtgtatatacttaggtaggatttacatggacttaccccaagacttaaaacattcccctcttacattcaatctttgtacccaatgaaacttatacccgctctctgtttttttattgcctgtatgttgacttgtacccgctctctgtttttttattgcctgtatgttgtattgctgtgtgctgttgtctacattttagctttggatatgtccatacggaggatatgatgatcctttccccagatgatcgacaatgaacataccgtgcgattgttttctcttaggagataatcaagccagaaatctgatcctcgaattttaatgtagagtttttttttctgaaagatttcctttatcttcaaatgagttggttcttgattagtttcattgtgcttatttaccatcatcctttggatggatgttagtgtgagtatgcgcatcgtataaactgattaccggtggatctcattgctgctgtgtatgagtcgatgccatagccatgccccactgtcattgttcttctgaatgtgctcgatgttgtggttcagtatttggcagtggtgtatatacgctttatggtttagtattaacatagacttagccaagacttgacatattcctgtatgctttttgtttggctgtgttgtactcaaatgtgaatacgttgtcaagctatttctagtttatgtgtttatcagctgtttgtcctagctgagtagcctgtatgttgtagtgcactttctttatttagttttggttgaattggtagtggaggatatgacgatcctttccccagatgatcgacgatgagcataatgtgcgctattgttctcttaagagataatcaagccagaactatgattctccaaatttaatgcagtctcttttgctgaaagatttgttttatctgaaaatgtactgatttgtggttaatttcattgtgctgcctatttttcctgattcttttagcatgttgtggtgaaattttatttggtgctgcttaatatggagaatatgatgatcctttccccagatgatcgacaatgaacatactgagcgctattatttctcttttgagaaccaagccagtattctgattctccaaatcttatgcaggcatttccttttattttgagcaagcagtggttgtttcctagactgtgatggatttattgatatgttcaattgtttagcttgggtatgataacatagataattgtctattatgatctttgcaaatttgttgctccaggttgaaacctttagcgttgaaaactgattaccggtggatttagtaccaatatggccaatgtgtatgagtcaacgccataataattctccattttctgcatacagtaactgtgatgtcaactgcttatttgcagaagtggaaacatgctttatgaaaaacgtttttttactatgagtcttcagtatgattgcaaggaaaattttctgtaactgtagggaattaagcttgtagagtgtccttttttctctctgaccatttgcatgtaatgttttactttcatcagctctttctcattgtgtaaacttttcagagcatggctgcatactaccctactttgttttgtcatctttgctggcagactgatatctaatgtccccgcatgtcttcattacagcgaagctagtgatcatttctaacaactgcccacctcttcggaagtcagaaattgagtactacgctatgttggccaaggtcaccgtccaccatttccacggaagtaagttgacacccatgcttttcgacatctcttgacctttgcaaagatttaaacagtgaggcatgcttgggagtaaatatgtaatcaaattatatcgtagaaacgccatgctaattatttttatgcgtttttttaaatgaaactgaaataaggtgcacagttctatcttctgttgccatggcaatgctgcatttgtttgtagcaactgcaaagtggaccaaagaagacttacaaattcatagataggacaaatgaataaactgtgcagacatcggtttctgccatatgcccatattgcttgattagccagtcttattacattagctgtgtctttgtttgaaaaataacagctatctgtttgttttcagataatgtcgatctggggacagcctgtggtaaatacttccgtgtttgctgcctcagcattattgatcctggtaacttccatacgtctacctagtatttgaaagaaactaaacaaaaccgttatttgatagtaatactgtacaatgcgcttgatttccaggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggcccgaatcatgttttcaattagaacgcttggctgtttgttcactgaacttcgcatcattacacgtggttgttaaagagctctttagatgcagaccagcttgcgctgctgcatttgcacgagggttgacgataccgccggtaaccgcgtggcttaccgggggtacggaaatataaataccgtggtaacttccttaaattcatataaatgttaaaaataatttgaatttttgataaattttgtctggttttgtacggtttttatacggtttgggaaatcctgatttgcatgcacgatggagaccggcttcataaactgaccgaccatgggagagctttgccgattcataacgctgtattgagcaaccagcatttcggccatttgaatagaatttatacatctgaattaataggaaacaggacttgtgaaattatctatatatattcctaacattacaaatcattttcttattatttagttgaaatcttttaaaactctgtgatttaacatatagagttagagactttgaattcagtatagtcaaaacagactctgaatacattaagagtaaatttcacagaactacatgtgttttatagttcaagtcgcagaaaaattacatatattttagcagtataaacttggaccacaaaacgtgtagttttatgaaatttactcatatattaacataggccacctatgtctctccatctcgacacctcccgtaggacccatggtatttaactatttgtcactcttagatttgttgtttaattatttaccatccaaatatgtgagccattatctatttatgacatacgtgctcagatgataaatcattaattggcacatttaagagtgataaatagttatataattcttaggaacctgctcgctgctagagctcgagctccgtcgcttccagaacgtctccgccgcgagggaaagcgtagaatgggaggaacgaacagctccggcgacgtcgaaggtgatctacagtggcaaagttaggggagttgagggcatgcggtgatccaagcagccgctcgagctcaagccacgaccaggcatcgaacttagcgtcagggtaagacatgatggagacacacagagcagaggagataggaaaaggagagaggaagtgccactgacagaaacggtcaacttttttcgtagttgtaaaacgccaagtcgagacaaccttcaaaaccgctcagggacgtaaattgatctggttttaggctgtgttctttgccaccccctcttcctcgtattccgcgcgcaagcttttcaaactattaaacggtgtgtgctttttataaaaaagtttctatacgaaaattgtttaaaaaatcataatgatctatttttgaaaaaaaaattagttaatatataattaatcacgtgctaatggaccatggaccgctatgttttccgtactggagggattggctcccaactaaagcaaagaacacagccttaatacttgagtgagcttttatacccgattttgcgacgttaatcttactcggtacatagttgagggagcagttatgtacttttcaagtacataaagactgggttagctcgaagtcgagcccgacccgttcgttgacagccccaaaattaggcccatcgacgacagcccataacatcgagaataaatctgggccgcccgtgccttcgtcgcggtgtgcgtcacgagccgtcggatgggaggaaaaccctaacaaaccctagcgtctccgtccgctctctgtctatataagcgccgccgctctccattgccttcgccctctcgtgttctagggtttgcacacgcggtctcttctcgtgatggctgtggacttctaatctttgctgctgcgctgcttgctctttccagctgggttgatttgatttgatttgttctcgctttcaaatctgtttgcttttttttgggctgttttgtcgatgggattttgtttgggcttgaggatgatggatgatgcagatgaggaggcacaagatttaatgggtaatttgcgtctgaggcatctctgtgatgtcacaccctttttcaccttggagatctgatgcatctacaaatcttctgccttctttttttttcctcgattaacttttattttcttttaaaaagttttcctctattagcccttgttcttttagtctttcgaagaaaagaaaaaacgctggggattgatgatatgatgatcaaatttgattccctattggtttgattggccgccatgatggcctcaaattgtattagctctatctgatcatcttcctccacatttttcttgtttcattttttccctcctggatctttctgctgttttttttgcaaaattttatttgctgtgttcattgtacttgattcctgtatgttattgttgtgctgttgtctacattttagttttggataagtccgtactggaggatatgatgatcctgttcccagatgatagacaatgaacatactatcctccaattttaatgcatgagttgattcttttagcatgttgtggtgaaaatttatttggtgctgcttaatatggagaatatgatgatcctttccccagatgatcgacaatgaacatactgagcgctattatttctcctttgagaaccaagccagtattctgattctccaaatattatgcaggcatttccttctattttgagcaagcagtggttgtttcctagagtatgatggatgtattgatatgttcaattgtttagcttgcgtatgataacacagataattgtctattattatctttgcaaatttgttgctccatgttgaaacctttagcgttgaaaactggttaccagtggatttagtaccgattgtgtatgagtcataataattctccatacagtaactgtgatgccaactgttatgatctttatgaaaaacgcttcactcgtcaactagtagcagaagtgggaatacgctttatgaaaaacgcttgtttttactacgagtcttcagtatgtttgctaggaaaattttctgtatatgcagggaattcagctagcagggtgatgccgtctttctctgctcatcatgtagcaaacccgtgagacagacatgcatcagtatctacagcaaaagcttgattccaaaccaacgatggtagactgcagtaatacaatctgacaaatcttagaacgacgacgacgatgttcgttcggcacttctatttcttctaagctcagagtgcatccttaggccatagcttctcaatgattttatgcatcagggcctcttcactttgaagccattgtcaggtaaagttgccatcagcgatgccatgccgcttcattttccgccgaatgcccacgccgccgctgccattgacgtagcttcgtgtcacgcctcgagcaaagccaggaacaatttaacgacgtggggactagatgaaggtttgctttgacacgttgcccagtcctacggacgagtgaaggagccttgctattaattcctccccatagtttggagaaatttgataattttggaggaattttcgaatatctcaagactacccaaacccgtccaataatctcggcccatttggtccggaagttaagcccatccgtattttacgcccgatctcggcccatttagtaaggaagaaaagcccatccgtaatgaaaagcctcaccttcgaaacagcgttccatcaatcatcagcattgcattaattaaagtcgcaattacacaattgccttaatataagtcgttgctgtgatggcaactataacttaacgatcgattgaatatattggtcgattaattaaagacgcaattacataatattcgccttaatataagtcgttgtgatggcaactttggaagaggaatcttaactacattgtgggacccagcggggctgaagattcctcgcaattctaatctcggccatatatattgctgcttgggccaacaaaaactggaccgcgacgtgcaggttaccattcgcggtaggtttaccagttagttttacttctcaacaaaagaattattaggcaattctattcacaggtcaactacataagtacggcgtaatttccacagtaattgtttggattgcagtaggaaaaattgttcaaaggatggcgtaactttggcgtggaattaactgaaatgctaatcaaagtattccattccaatgggtttaaaatttgaactctaaagacttgacattaaagaggagtgcaagttattagtacatgttttacggagtagttggtatttggccgatgcctttaagcaaaaaaaacacacacacacacacacatgtatgtacttcctatacggttgtgcgagtacgggtatatatatttataaacatatgtgtatgtgtgtataatttttaagttatttgtttaattaggacgttccacgtgtttgactatcaggcaagtgttgctatctgtttgaatcagctgctaactgaccggaattattatttttatataattttgactttgctagaggtgattcttcagctgtgttaggattatttacctttcacataatatcgagtatttctcagttctcacaatttggatttcagtcccatccttcaaagcaacctggttcactcacatctaagaatatccacacctggtaaaacgcttcagttgccagaggagagctgcacatcgcaaatgaaactctgcagtgccggaccgccagtgacaaaccgatagccatggccagtaagggtccatttgatttagaggaaaatcataggaattttggaggatttcaatcctatagtaaaatttcctatgaagcactttgaaacaaaggattgaatccaatccaatcctttgaaattcctatggaatagacaatcctataaagattttggaggaaatttagcaaaagcttcaatctcttggtaactttcctttgagtctatctctctcatctaattcctgtgtttttcctgcggtttaatcaaacgttcattcctgtgttttttctgtgttttgcaatcctctgttttacacttacattcctatcaaaatcctacgtttttcctattcctacgctttctcaatccgactattcaaaggggccctaaatgggagtgtgtaatgtaattaattaccttgcctgcatggcttctgacgagccgatcgatcatccagcaggaagagaagcttgactagttgagtgaaacaggagttggattgcaccgcgctgtagttctgtactgctgtgctatggtcacagcgtaggcaagaacaccttcctcgttttgcctgcacagtgtttccgaaaagtatagttttggatggtcaggcaaggaaccattgtcagttaaggttttgcagcaagtactgtttttgcttaagtcctcccacaagaacagaaacttcttcatctctgataaactgaactgaaatagtactagcacagaacgttgtagctaaaattcgtgcttaagttgttaggcatagcacacaggagacaggtaagacattacgagcagtgtaattggactaatttggtggtgatgcctttagtgtagtagttagctgtgctaccacaagttagggacttagggccatgtgggaagctcaatcatatggtcagtggctgtgactgtgaaataccaactgaaataagccagggtaatcatgtagtatcaacaatcgaggatattttttatatatcttttttgggggagggatcactagattgactacacaaaccactagacgcatgcatagtactagtaaataagatggtgaacttacttggctggctgctgattattgtgattggattaagaatttccatgccaccaataatggatcgcggtacaagtcaagagcgagtgacgcaggcctcacgttgcacttacccctccctgaccgcaagctttagctgactcagggtgatcaatcagtcgatcagatcttgatattctttttcagcaagtgatgacaaagcaggtgtaaaagaaattcccaggtctgatatcagcaaacgggagctccttttccatgtttttcaagaacctgcagtcatcggcagtggttagcgtttggcaacttgcacatggacatttgaactctcaagcaaccatcaacttcaggaatagaaggagaaaaggacgatttaagaactggtcatataaaagctacaactttattcggtcccaatgaattttaacttcattttccacaaaaaaacttgtccaatggaaatatatccaagattctcatgcctttccccctccctaccgtataggcataaagttattcactagtataagagattaggaccattatctaacagtaccgatatgtgtgtgggagatgcgaaggttgcaacaactatctccttaaaaaattttgattggtggaattaacagcgactggtgagaaagttgtagggaaaagaagcaattgaaaaggagagcaaatcacccagcttctgtgctaatgactttatggccttcatcaaatgacagttgagtctcacagcgagatattggtaccctcctccatacctcctctctcttcctcttctctgcaacatttatttgcactgcatacctatttgttttgagctgcaggacagcaagtacaagagggggtccttcccatacttcattctcctgcagaaaaaaaagagctcatgatatctagcttccaaccttccaggttcaagggctatctctgcaagaactgtgctgctatggaggacaccttggacgccggcacgcatcaacatcgaggataagtcctataagatggccatggatgatccatcttgcagttgcagattcctgttgtggttcctatgttttgtagcatgtgttctcctggagtctgctgcttctgttcattcatggtgccccttacatcctagcttgaggcaggaagcaaagtttaagcagaagacaaacaagttctgggagtaccaggaacagagtaatacctgggtggaaataagcatgcctttcaatttgatgtcctgcatcaacgatacctgcacgaaggtaggatcaatcgagcaaccggaaaggagacatggccgtgcttcaatttctagtcaggaggagaaggatgcagagatcgatgacaatgatcaagcagatagaaatgatccagtcctgcccataagaaaaaggatttccttgacgcgcatgtcagaatcatctgtgtgggtgacagggcaaagtggatcaatttatgagaggttctggaatgggctggcatgggtgattgctcctcatgaactaccaatttcagttggctatgctacagcaactttcattgtgaatacaactattcttgctctctcagaggctggaatcctctatcaggtaacttgcatctctatctgtatgacagaactatgctcatatcataactgttacaatacccttccttggtcatctttaccgttgtatgtttttcttcaactgttgaagttctgtaacagaacagtagttttatcccttcccctcccttcttttccccaacccaattccgttgttttgttgcagtaccttatattacatgtgcccaaaatttgaaattgttaagcaaagatcaatagacatgtagtcatgattaatgaagagccgataggaagtcttatgggaagagcagaggaataagaactgtatgtaaataactagggaagtagtttcctctcatgagacaataagcttctgatgaattcaattgccaaaaaaagaaagtttctattatgctagatctaatatttctacacactttcagctacagctaaatgaacatgcacaacctatctggacagaggtaatattcaactttgaacaacaattcatagtccttggagaaaaaacacaaagtcaagctatgcacataagaaatgggatagtgtcctatgatggaaggtgagactgctttctacacctgatgcttcctttctagtgcagtttgtgcatataaaaagataatttaggaaattattgttcctcccaaacaggaaacttttcctatctattacaaatggatccctagtggaggtcacagaacttcagcccctaaggtatgaagcagtattactgaagtttatattaatttgcacggctgccatatcttggtcaatattcaatgaaataactagcatatgaatacaatgttcttttactgaaaagaaaacagtaggggagagccctaccggaaaacatatgatgtcctattcaaatttgacatgataaatcagtaccgtaaagtcatgttttatgaaattttcattactattattgttgtgtgagtgcatctgatatataaagaaaacatatgaggttgaaaacaacgcatctttaataatatttagagctaagtacaaaaaagtacatgaatgtgccacatcatcataaacatcactatattagatggcaatccacatacttctcaaaaaaataatgatgccatgccacaataaagggttgaccattatatttctact

SEQ ID NO: 79263 - DNA, 52507 bp, Oryza sativa
gccccgccacatcgcccgcccgccgcgaggctgcccaggcctccgcccgccggcgcgctgccgcgaggcctccgccccgccgcgccgctgcaaggccgccggccgcccggcccatgggatgatgggggagggaaagaaggagaggagttataggagaggaggaggaggaggaggaggaagaggaagagatgggaggaggaagagataaggctagggaggaagagataaggctgcctgtctcgtactcttcaccgcacatgccgatctttagtcccggttggtattaccaaccgggaaccgggactagaaataaatttttagtcccggtttgtgttaccaaccggaactaaagataatagggatcttttttttcggttggtattaccaaccaagactaaaaatagatctttagtcccggttggtagctttaaacttttgaaccgggactaaagatatctttagttccggtttttattgcaaccgggactattgtgaattttggctgaccgaccaaagatggtttctccaccaatgaacgtaacgtctgagaaagaggagaaaaaacaaacaacccagccccatcaaacacatactagcacacaaagagaactgttaaattaagctgcataattagcgcttgatttttctagtactgtttttcttcgtacttctttcgtttcaaaatataataacataaaatcatatgagaaattttttattactatgattttggataaacaacctgtccagaactccagattcgtaggtaggaaatgtttcatttggttctaatttcttatatattttaggatgaagaaagtagtactgcgtactacgtccgttcaaaaaaacctaatcctaagtataagtctaagacattattatgttgagcttcaaattcagaattagtttttttctgagggactacgtccaaattaagcgagcactcaacatcacatcacatcaaccttggattaccctgtcctccaattcgcgcacgtgatcgatgcagattactgtcactggccgagtggcttcaataattaaatccgcttaggttatataattgtattatatgactgtatgagtcatgaacacgacaaattaaaggcttgccatcacagatgcacgtacagtaacagtgccttttcctttagtaggacacatgcacatttacttaattaatcccacgtcggacggtcggaacgggaagatcgtcaagaaggtgcacaagtttaacttgtctagcaggcaggaatgaaaacggtcgtaaacgatcggaattgatagcatctcttcgaaaatgatcctcaattaactagtaattaattatatttatcatttaaatttctcggtgtcgacattaatacgatgcagaaaaaattagaaaaaataaaatttaaaaatagctaaaaatggtacggtcaaaaagatacctcttatacggaaatgacgcttagttgatcgggaattttcgtacgcgaccatttttttttttaccgaccttcagtcatcctagtttcattgttcactatctttagctatccacttgaggataactaaagataatcctagctccatttcatattataaattattttgattttctatttaattttttaaaaaattgattaaggttataaagaatatagcaacaattttaatacaagacaaacatataaccaaaatatattcaatgttacatataacaaaactaatttagtgtcgtcgatgttgctaaatttttatatatttatcgaatctaaagtagttttaaaagaaaaaatcaaaacgatctgtaatataaaacgggggaagtatgcctctgctctagttaacacagtaggcttggtgaaatatagatggtaggtacttcctccgtcccagtaaacgtgacgttttaaggtttggaaccaaaattagctgaggtgtaaaatgaccaaattgtccccatgatttgattgagctatcatttctagcatttgttaatgcacccagattatcatttctggaagtttcctgattgctgatgaaaccacaacacagtgccacgtgttacaagaagtttacaaattggcgccttggccacactattgatacagggaaaaggcatcattaacatattcaaaaatttgaatcaaccattaagtaatctttgccgcccaggactgcctcttcatttgctagttctggcgcccaagagtgcctcttcatatgctacaaatcctgaaagggccatccatttcattccatttcatcaacctacatatccaactgaacaccactcacatccaattcaaatgatcagagatctaaatttactaccggaagaggaaggagatggaggggctttacctgatctcaatggagaagctgatatggaagaagatggaagagctgctgttatccttggagataaccttcttggagttgatggccaggaacatgaaggttttcttgatctcaacttgcatccttttgatctcaacatggaggctatagaagaagaacaaatgcaacaaggtaagatttcaatacttatcaatcatctgcgctggaccaagcacttactaacttgatggaatcaagggcttttatttgaaatggttttatggatgatttacactagcacacaccagtttcctattagttaaataaatcaatcaattccatttagtaactgtgttccattccagtttgatgatccagaatcataccataattcagatataagctggtgttgtaaggttcgaatgttacagataatgttccccggaaaagaatggtacagttagtgtacaatttgagcattttggtttctagtattatttttcctgatccttacttatataagtgatatgtaagtgcataactttaattctaagcaatgactagaaccttataagtgatccttatcagtatactagaaaattataaaatgatatgtatatgctgagtacaggcaatgacagccaaaggtatatcacaccaatgcatattccctggcctgtatgtattgctcacaatatgcatgaaacaaggccaaacagctaggatgcgacaatgcgtacgtggattataaatttacatcttcaaagactactggaaatttgctccaactgtatagattcagtttcttatgcagtgcattagagctaatactgcttttcacagatccatcatggatgatcttactttcccattgaatggaagtgctccataaatcttttgttgaatcaactttaatttttttacagtacattagttttttttttgaaatacattacattagtttttatttagcaactaacaatctttctttatacatatgcagattagttatctccaaaatgttctctcactccacactacatatttaaacaacaaaatttcaagcatgtatacatgaacaaaggtcgcattagttagtcgctgacctcttgcaatttgcattattagaccactaaccattcatgcataagcctgcatgtaaaatgcaacttgaaaacatttacaagtgtgcatgacaacatgagcagtgacatatttacaagtgtactaaccaagaagtatttgggcagacaacgtgatgcactgtgcggcgcatgtcgtgcatgggaatgcacatgtaaatgaggaacaagaagaaactgaactaggtaaaattaatgtttgaataaatgtatgcattcttattaacccagattaacttaccatgtcaaacattttttgtagatgatcatgacgcattgcaatttgagttggaagccttggaggatgatcttcgagagtacggagtgtacgccgaagttgtcaatgttgtctttgatgtagaggagttgcccgactcagatgacgatcaagaagaacatgcaaatgataatgtggcaagtaagtcaaaagatttgacaaacatacaaaggcgatgcatttatcaattgttgctttagaaaagtaaagatggaaaattagaaaaacacaccacacgtttagttgctcaagagttccatgttagcatccgtacagtccaacgtatttggaagagagcaaagatttgccatgaacagggaataacagtgaatgttgattcaaggaagcatggaaactctcgacgcaagaaggtcgaaatagacttatcagttattgcagctattccattgcatcaaaggagcactatccggtcactagcacaagcccttggtgtttccaaaagcacattacataggtggttcaaagaaggactgatacggcgtcactcaaactcgctaaagccttatttgaaggaagcaaataaaaaggaaaggctgcagtggtgtgtttctatgttggatccgcatacattgccaaacaacccaaagtttattgaaatggaaaatattatccacatagatgagaaatggttcaatgcatcaaagaaggagaagactttctacctgtatccgggtgaaaaggagccatatttcacagtgcacaacaagaacgccattgataaagtaatgttcttatcagcagttgcgaaaccaaggtatggtgatgagggtaattgcacttttgatggaaagataggcatttggccttttactaggaaggtaaaatattcttcttattacaagtgttgttgatgtacatttatttctgatattcatgggtaaacataacttatttcatatactaacaggaaccagcccaaaggagaagtcgtaatagagaaaggggaacactagtaaccaagctaataaaggttgatagagacaccataagatcattcatgatctctaaagtgctaccagctattagagcatgttggcctcgagaagatgcaagaaaaaccatatggattcagcaggataatgctagaactcatctcactatcgatgatgcacagtttggtgtggcagtagcccaaaccggacttgatattcgcctcgtgaatcaacctccaaattccccggatatgaattgtctagatcttggattctttgcttcactttagtccttaacacataataggatatctagaaacatggatgagctaatcgagaatgttcacaaggaataccgtgactacaatcctaatactcttaatagggtattccttacactacaaggctgctacattgaggtcatgagagctaacggagggaataagtacaagatccctcacatgaacaaggagaggctagaggcacttggtgttttgcctaaagcccttagttgtgatcgtgggctatatgagagagtcgtggagtctttggctaactagtggtggctattttgtgttatatatgtaaattgctaatgctatctatgtaattgtggtttggagaactaactggtgttattttgggctgtgtatgtaaacgtcatctatcactacgccatccgtaggttttggcaacaaccactatgtattttcgacagtcctcatataatatgtgttatatatgtattttcactgttcgtttcatccttaacagatacatcaatggctgactatcatataatattcctaaactataatgtcggttcaattgtgcaccaaatgcttagcatactcaactcgaaattttgcaatactgtatttacaatcaaaatctcgcagcatagactacaagaagttttttttaggtttgaggtgcaagtgacatattgagctaagtaaacaaattcaccaaagatgacacaaataaactttaaaaggtccttataattaattagttaattacacatattgatcaagcatatactgcttacagactacgcaaaagggaatgtgaaccaaacaggcttggtagtcatgctagttcttcatttttttacatatatgcagagatcaaagtggtttagccaaagcaggattccatttctctagccttgatctcatcattagtaatgcaatattactaatatgtcttactcctagaactaatactcctagatggcatatcttccatggcattatttgtgaggtatggtgaagtataggggaagtaaaatccgtaacatactttcgcgaatttcagcaaattcgtcgacgccctcatctccagcagctacaccatcgggaggcagctcagaatcgtggtcgctgccacatgcctcgtcctttgagtcagggatgacgcagccgtcgggaggcagctcggagtcgtggtcgccgccacacgcctcctcctcggaatcagggacgacgtagccgtcgggaggcagctcggagtcggggtcgccgccacacgcctcctcctcggaatcagggacgacgcagctgtcgggaggcagctgggagtcggggtcaccaccacacgcctcctcctcggaatcagggacgacacagccgtcgggaggcagctcggagtcagggtcgtcgccacacgcctcctcctcggaatcagggacgacgcagctgtcgggaggtagctcggagtcgaggccaccgccacatgcctcctcctcggagtcagggatgacgcagctgtcgggaggcagctaggagtcggggtcaccgccacacgtctcgtcctcaaagtcagggacaaagccgccgccgggaggcagctcgaagttggggacggcaccgtactcctcaccctcggagtcagggacaaaggtgccctcaggaggcagctccgactcaggatcgccgccacaaacctcatcctcggagtcaaggacaaacccgctgccaaggggcagatcggagttcggtacgccgccacttgcctcgtcatcggagtcaacgacgaagccaccgccgggatggcgctccgcatcggacatgtagccacatgcatgctgctcctcggtgaggtagtggacgccgccggcgccgagcaccctaccaccacgccgcctgcatcctcctcggcttcctccacttgcctgctgtgaatcggcatctatttccacagccctccgcttgcgtacagcccttctaccccgccgagcagttacctccacgaccgtgacggccagagaatcggcgcagccccgccgcgccattgctgacacggaccgccgaggggagaggagaggtgaggaggctagggaggtgggaggcgacggatgaggtggatcggggtgggggagattggggatcgttggggggcaggggggcgatggaggagccgaggagaggagaaattggggatcgccagattggggatcggcgcagggagggggttgcgggcgacagaggaatcgagtggtgcgtcatgcgagaggataaggtgcggaaaaaaaatcgagcggtacttagatcggagaaaaaaatcgagcagaaaaaaaaattcgccacatgcattttttttctaggtcccacctctgtagattagtcccacctctgtagattggttgaagtagtgcaggagcagcaaaacgacatgtttactgggacatggatagataggtagaacgacacgtttactgggacagaggaagtagataattttaggctagtattttatatttggaacaagagagtatagtaatttattgttggtcggtctcgcggttaatagttcgagagacctaatcatgagggtatggggtacactctgtatctactcgtgtatgttcataatgatatctcacacgctaaacctaaaacctccgaaaatactatgcgtacgatttacatgtacgatcattgtatgattgctaacatacgttaaatgttatgtgttgttttgttagaaacggccagaaaatgccatgggatttgactggtagacgttacatcgtacaagtatcgtacacaaataatcatacgtatagcagttatctaaaacctcctcccaaataaatcctgacacgaccaactaatcctcgtaagcacaacgttgcaagggatccgatcgatcgaatgacatttaatttccatggctcattgcaagagatccctgatgtctccgtcctcaggctggtcatttatcggcggttttaattggcttcaattcccaaaaactccgatcagtatctagttccacaacaattatcacgtaattatgcttaggataaggtgttttaattcatactttgagataacattaattgtatttcagtttgttaattgcacctcttggatcgacctaggaatctaagctgtcgaactctagagatcagtagaactaatttgacagattcgaagaaataaagtcatagtcgatgacatactactactgtataagaacgatgacaaagtgagaacaataataacgtactccgtaacaaaataaactaaactgtagattttaaaatttattataaaataaactacggaatactaactcctagtacttcttacatacaaccaacccgtaaaccaaaaaattttattccgtggatactttttacctacccatcaaccatttcaaattactaattaattaaattattactcattttaaattcgccatcagatggtagggtttaagtattttagacatagggatataaattgttaaccgtatgagtactaattaattagcaggctgctgcaacgattgcacgggtgtgatcgattcgagggcttcagatcatttcaccgcggcttcctgcttggagcgtgcatgcatgtgtacatgagctacatggtgactgtcatatgatggacggcatatttcgagaaacttttgacaaatgcagcttcttttcagtaccagaaacccttctaaataattctttcaaaaagaaactcttctaaagagtacagttttctcgttcagtttctttcagcatctgatttattgtacaattcggaaaataaatcagtagttagaaactgaaaacccagtttttttttctaattagagctgaaatccggttggcgacagggcatatgagtgttgtcgctttcatgttgttaattacacgcagctctgctaatcgcgattgattagatagccgaaagcgatatgtactcctcttccacgttctctagttcggcgctgtttatggaacagaatgtgaacgaatcccttggctgtattaggcggattaaactactagtactaatcaatctgattactctaatctaatctcgcctgatcgttcgtgttactgttcccctacaagttaattactagctactaatctagagttataactagtaaaacactcctaggagtggaggtggagcagtggcgcgtggagattcgtgcggtggccgacagggcgacggacagcggggcccacgggccgagggcgcccgtgcggcgtgccaggccaggctaggctttgggcgcacgtgtggggggttggacttttggcgaccccctccgtgggccgcctcgcacgccacgtggcccagccgcctctgctcctgctcctgctccgcacccgtgcgcgcgcgcaacccgacgcacccacgcgcgcgcgcgcgcacacacacacttgtggtttggtttggtttggccggcgtgggtcccactctgtctttttcctttttaaaagagaaaatgttgaaatggactcgctcctaaactggagatgaactcgaatttgcatccatttgaatataatccagattgtagattctagtatttgaatgcacatatatagcttcttcttcttcttcttcttcttcttcttcttcttcttcttcttcttcttcttcttgattgaggcgaaaacatgtattatcaaaatttggtaacttaagtagcaataaaattcgctcctaatttagattggagccaaacatgggagtgcccatgctctagttcgttacattttagaaatttattcactgtactagtattaaaaattggcttcatattaatagcaaatcaaatagtaggcgctagctaactttgttctaccaaattatttatcgtatcaaaatttgtctacatatttgcaccaaaaaaaattggtagggcaacagattttaggttgcattcgtttcgaaaaaaataaatccgtcgtttttcgcgtgctcgctttacgaactacttcctccatccaataaaaaataaatcatgactggatatgacatattctactgcaatgaacctggacaaatatctatccatattagttttactatgatgtgttacattttgtactaggttggtttttcatgggacgaagagagtactaaagagtcggggtatgtttttttcttaaagaagaattcatataggagagttgttttctcctactctctaacataaccttaatagtttcttcttcctttctactccctccgtcccataatataagatattttgagtttttgcttgcactgtttgaacactcgtcttatttaaaaaatttatgcaaatataaaaacacaaagttgtgcttaaagtactttggataataaaataagtcaaaaaaataaataataatttcaaaaaattttgaataagacgagtggtcaaacagtgcaaataaaaacttaaaatctcttatattatgggacggagggagtagttctactcctagtacgtacgtactacaatttgctggttggtcaccatagtcaagatccaggatcacctcaactaaatacgtatcgagtatatatttgtttgaatcgcccactaattaagcacgtatgcatgtaactaactaactaaccaaccagaaaacttgatattctagcatcgatcatcagtagctttcactcgagtcacaaaagggagagaaagttcagtaccatcgctcctccattccacgagcgaaagcgacggtggattcacagaatcctctccccagattacacaactcgatcgagtgcatgcatgtacacatgaactactactacacgagactgcgagtgagtgagtgatacacgaaccaaacatttcaacatcaaaggtcttcacgccacataaaacaaaatcaaagccagacgagaccttggaatatgaaccgtgaaaaatgggacgggaagagtagataacagtttaagttaggagtaacttggaatgttgcgacggggcgcgtggccactgtcattcgaatctgtccttgatagagtagtatgagtagtatattagttggacagggacggattataattaggcaggtgcatgcgatatggtacgagacaaaatctgcagttaatctgtctgcgatgttgatgcccttgttgttgttgttgttgataggagtagtatagtcagtagtgtgtaatgaatgatcgtccggtcaaaaaggttgctgtgttagtcggcgcatatgcaggcgcggacagtgagttgagttgagctggtttagctaaaaaggctatctccgctaattcagattaattagctagagctgcaccactagatctgtttagttatttagcggacgtgtctattgttttgtagttgctcactcacgtattagcttttggcagagtttatgttggacgcgcgatcatgtcgccggaacagaacaagatccggcaccggccagccgccgtgagcacactagagctaagttttatttttatactctatccgtccctaaatatttaatgtcgttgattttttaaagcatatttaactgttcgttttatttaaaaaacttttatgaatattattaaaaactagagtagtagtagtatatttaaccatgaattagatgatagaaaaataattaataattacttaattttttaataagacaaacggtcaaatatgtttacgggacggagggagtttttttagggggtctttttcgcgagcagatgtgaggtagcgtggccaccgccggtgccaatacggcaagaagagagagagaggatgacacgtggttctttttcattgtttttctttttcattttggtctgtcatttcactaagcatgtcatctcaaattttaattatgtgataacctattgcagtgtgtaagcattgagatttcacatgaatattttctccgtgtcctaatatgtacatatatcctccgaaaaaagggattgcttaattatcacatcatatttttcgcttgattttgtatgcgattgtgctctctcctatagtaagtatgcttttatctcttgtatatcctcctttaagaaataaattacttctaatcctaatcctcttatacattatgcattagaaaaattacaatgtgagtattgaaacttataatgtaattataacactgtaagttttgaaatttacaatgcaattatactataaatgtatgtaacttacagtgtaaaaacgatttgactatttttgtgaaaacattatggtaccacaataagctataaaaaaacaaatcatgtctttgaacatgaaaaaatactagtccaaatgcatgaattgtttttttaacggagagaggacagcctacctattcatgggtggaacagcattatgggaccaaggtgatacttatggctctctacttatctattggaggttgcaaagaatttgctacccagtgcttagagtaacacttatgttgctagtttgaggttatctttacagaattatagacagtatcatatgaacatatcattattttacaaattggatggatgcggaggagtagacacagtagaatgtacgccacttaaaacaaagccaaatagcagaactatcaaacatgggaaaaaacaggggaacaggccaggagagatcagggacgattcagatcacaaaatagttagtacctagtcaattacctagcctaactaacggaagaatgtgcacacaccacatgatctagctgaacaacaacaagaacaaaagaactgcagagagaatctctgcatgatggatccatggtcctgcagctcatgatctgttctcacataggtagatgcatgcactcattaatctattactcctaattcccatagtcgggttagtttaataatcaatgtagtatcactagctaatttttgttggttaatttatgggctccaaaggctttgcctctcgtgcacacagtcatcaggtcagatgtatggaaaaccctaacccaatccattttgttaattaagctagctcccagtactgtattatagtatgtacctgcctccactaagctccaatagttgcatttccaaggacctcccaaacttccataactaacagttttgtttagtgactaggcagtgttgatgtccaattaaggattattcatgtagaggaggcagtacaaccaaagctctgagcattggagaagtgattgtactactgctgccaaataggcaaatgttatggtacatgtaccaaacaaagtttactagtagcagaacaatgcaaagtgtgccgtggggctttggattctttgcctccgtcctctgttaattttacaatggcattctgttttgaatcaggctctttgttgtagattgtctgcatgctcctttttaacggtcacattgatagtatatcctccctgcgtttttttttaaatataggatgctgttatttttttttaacgtgatgtttgactatttatgttactcaaaaaatttatataaatatcacttattttgttatgactttttactatcaaacaaactcttactttaacttatatttacactaaacctttaaataagatggatgatcaaatgttataaaaaaacataacagtgtcaccatattaaaaaacacagaggtagtatctcgataatcttgaactaacattgtcctatggtctgtatatgtgtggaaaggcaaaatatgatattcttctgaccgtccccctaattttttgttcaacatacatcggacgctagcttttgtgtgcttattacataatttaaactttatttatttatggcaaataatggttatgtttgataggtagactatgaaatcttgaaactaatttgctactctcacttaactcgtttaatttgtggctccatatatatagctaggattatctttttaagtcactcgataatgaccatcatccctcactgtacaccttgcgtctgtggcgcttctcacatgtgtatagtgatcgttgtcgactcgtttaattatttactttcatgccttcttttatcatattaatctatttagctttataaactgctaaacgatatattttttaaaaaaattaaaaatcatattaatttatttttagtttttagctaatatttaattaatcccacactaatgacctaatctatcttgttttccatgcggagagaataattaagttcctgaatgcacccttaatgttgagttctttgttgaggttactaactcaacttgcatgttttttcggcatgcacgctttgcttttatttttgaaatccatataaaagttccttaaaaaattatactccgtattaatctattttttttaaaaaaatagttaataattaattaatcatgtactaataagtcactccgttttacatgggcgagacattggttaccaacaccaagcaacgaactgagcctaaaagtcgtctttgtaatccattccctttccatttataacgaggctaggcacatgaacacacaggataccttcagtcaaatccttcaccatatgcaactgaccgagtacgtaccaatgtaccacccgccgcgtttttacttagagaaagtataatagtgagttataaatctactataagcttatgtggagaagagaggtatacagaagagaaggatgttggctctcatgtaagagctagcttaacacaagctccaagacaaatacattaaatgtataagtgagagatagagataggagaagaaaattatagctaatcttatagctaatttattatatgtgttaactttaggataggctaatagtaagaagtgggctatattattaatgtaggagtagtagtacgtcaaaaatccaaagatcaatgaggcagcaatcgagggggagggagagagagagagcaatgcacagatgttgagacccctcgtgtgagaaattaaccggcggcttaattagctacgactcgtatagctgttggactgcacggtctttgagcgtgtgtggacaagcgcgcgctcggcgggcgagacaacatggccggccggtgtacagtactaacactaatagccccgtttgagttcactgtgttaagatgaatattttgtacggttacatgaaacgagaaagatattagcgtatgattaatcgagtttaagtaattttagtttttttttaaagaatatatttttttataatttaaaacagcttctctacgtagtaggtttctgtatggaacatactccctccattctaaattgatctatatattttataggtacaccaagaccaagaaaagctaataactatcccatactatatttactctagcaacaaactcgatgtatgcaccattcccacaatttcctagccaatagcaaatcaagatattgcatgtgagttataaatacttgtgtgcatggatgcatacatcaatgtccatttactccaatgcacagataacgaatagactgaatgaacacaaatatgtagatcatttaggaataacctcaaaaaaaactatatgtatatcaatttggaatggagggagtaccatttagtagtttgaaaaacttgctaataaaaatatagataaaatgtgtatcttagagatgatgatgtcgtagaggtgagccaactcatacaccatctcaaggcagccaccctattgcgacatgaacctgatcgctgtgcgcactagccagccagccaacgagagctcagcgacacctgaacagtacaattggagagtcgaaagctagagaggagggccgagaaggagccgatagcataagcgtgggcgaggtgacatgttgctatgtctggctcgttgagctactggaggaaaaatatgggcgagaaactcaagaaagcgcatttggatttaccacttcttccatcgtttgcttaatgggctgataagccgtgaaaaaaataaacaaatcaacaaaaagttatttatgggtaaagcttttacttgtgccattagtgatttaaaagtcaaaaatgaaataaataaataaattatgatgaaaaacctcgtaaggcacacatgaccatgcgttagtgcacatggtacaactgggccagctatctgaacctgggccggaccaagcccaacacgacaattagcatgtttgctcacgcagcaaagcattttaaacagtgcaagaatcagtaggaatcagttcgtttagcatgctgttatccattcaaagctgcaaaacaacagcccaaataaatgcacagatcaaactattcaagcccattgcagactaacagtgcagtctaataagatccaaatgaaaaacagatagaagaaggcacttatgtccattttgacattccctagatagatcatagactgataatctagcgtctgctgcgaacaaagacgcacaaagcctaacaatgtcgcattacagcttgtgattattgagtagcaacaaccagtttcagttttcagagatcaatcccaacgaacagcaaagctgcgccacagcaacagctacttcttgcattgctcacagactcagcagaagaacatggactgcctgacgtccgggtgcaggcgcgggagctccggcaccggccgcggcggcgcgccgccgtcaccgctgccctccgacgccgcgtcgtcgagtctcacgaactgcgacacctgcgccgccgccaggtgcgcgtagcagatcggagcgactgaaaagaacaaaaggaatgacatgtcaggtgaaactactgaacttttgatttttcagagtgacagaaaaatcgactggtctaatttgtctgtgtttagatcaaatttaccacctgagatggccgtcgtgctcctctggtacctgaggcagagttcacaagcatcacaaagttgattagaatttcagaacagacgaacgaaatgcagtcgaatgatcaccagagattactgaattttttttcttctttttctgtgcggtttcagagtttcagtgtggcttacacgtatgagaggttgtgcacaagctcctgcaagtcatcaggggtgaaattgttctcatcatgcagcacatggtaatgcgtcggccttgtagtcccctgtcaaatataaagacaatctgattagagcacaaattgcaattgtgtagcaagtgtgttcaaatttttatcccaaatatagcaaactaagacatgtataacttttatcactaaactactcatactctctacctccctccctctctctccttaccctctttttagtacctatgtcatctctaaaaattactaaattttgggacagagagtagtacatgtacatttgtttgagatgtagttgggaaaaaaatagagtgaattttgcaaactatatactttgatcaaattatcgtaaaactacaaatttaagccggtatatcacaaaactaatttagcaaaaaataccacggaactacaaatttaagatgaagtatcacaaaactatagattttgtatcaaaattatatgaaaaaaaaacactacatgtttagcacaatttaatcataaaactaccacattgatagcttcagcataacatcagtgctaaggatttaaactctaaaatagttttttacaatatatagttatgtgataactttaagattaaatctatagtttttacaacatatagttatgtgataactttagaaataaatctgtagtttttacgatgctcagtcttaagtctatagtttgtgataaattaggtctaaatctgtagatttgtggtataacgccttaaatctttagttttgtgatagtttgatcaaatatgcaagttttgtgaaatttactcaaaagaatatcacatttgtccgaatgacatgtggatctgagagttacacgtgtccagtggcgcgtatgtggtaattttctcgattatgtaatctttccaatggtactaagccaactggaattcatatttaagatagggcacttacaatcatcccagcatgagcacacatgtagaaatcacagttcctgggatgacagattcctttgtcaacaacagtacctacaaaacaacggcacatcttcaagagtgaggagaaaaatgttgatggtacctgaccagaataggattaagagaggatcctgaaaaaaaagtgagatgaaggatgtaattgttaccaggaggaacattgacaactttgttcgatcgatctgtctgaaaaaatttggtgtgatggttcttctgcgcaactatcaccgtgaactttggagaccattcactgtcatttttctcattggcaagaaactcgcatgcctaaatcgattcgaaatacatgagtatcaactaaaatatgcagaagatagatgttcattgtatcaaaagcacaggggctgagcagtaaatgcagactgtgcagatcgggcatgtttaccttgattatctgggctagctcaatgttcagcacctgattaaactggccttcactaaccccatctctaaaattaagatggcaaaactagttagaaaacaatagtaccgagataacaaagtagtaaaacttactgtcagacaattccaccaagactgaattagagtggttttgtgaaatttactcttgtttaacgtaagagacaggtccagaaaaatttcagtataaattagaagttgcaaacatatatttcagaagaacaaccaacctgaaaatgattttttttttctggcttgtgtccgcgagaactgttgtagaagtccattagtgactccctgtggtaaacaattccgattcttagcaagcaaaactattacggaacaatagtggcagtctgcaagatatacctcaaactattcgaaatgaaccgaattgaatgtcatagaagcatctcacctaatgataacatgatcctcattccccactagcttaaacaaggaatcgatcatttctagcctgggagactgggtgcatacggaggctttatattttgatatgagaggccactccagggaactaacaacctagataagaacagaaaacactgtagcacatcagctaattgtcagctgcaagaaccatccagatgtcactgagcttcatatgctgatactttcagaagtagagaaacataagtaagagaggttttacggtgtttgcattccaaaaagggtaaagatccaacgctcctcaatcacaggtaccatgttaaaagtatttaagtattgatataggtacttaggtactaagggtaaaaacataattttgctagtagagagaaaagggtagaattgtctcccaaattataaaaggtaccgcataggtataacggtacgtattaacaccgtaaaacctctttgcactgtttaatttcctgttttgcgtggtttattgtagatttacgttgtattggagttaagtcgtttactgcgtcactaaggtttaattttttgatttgcgtggtttcttgtagatttacgttggatttgagtctagatttacattgtgttcttacaacacattattgacccaattatgtgattttttttctacatttacattttattccaacaaatacgtaaaaactcctaccttaattatgttgaaaattacattttatttccagcaagagatttatatcgtcgaccagacaatctagtctcctattcaaccctcaaccatacctacacttttccctctgtctctttccggtgaaacgttcaaaccctagaacaagaacaaagcagggaaagaagacgatgcgatctggaaaagaagacaatgcgatctggtatagatcgattggatatccgtgattttcttttttttttgatggcataccgatcgatggatattagatttactcttttttctgatggcataccgatcgatggatgttagtattcaattaaagtataatggccatattttacaagttaattacaccactgccatcatgttacaataaatttgttctgtaccttacccctctcttgatcaacggtgcacgttgttccacctccaggtacgtaaaacatctccataagtaagcaagatcatagcatacgggggaaacttaccgcagcgacagacggtacatcatcccgtcccggtgagccatgggaaacatccatgcctaagataatggttggagtcttcgacaagagaggaatggcttggtttctttcaatttgcagcagcgaattcaaccctccaagctgattgaaaacacagaaaaacaacataaaattcacaacaggtggcaacaagaaactgtgtaattttgttttctgatcacgtctgcagtgcagattacctttgcatttatctttagaagcacattagtcaggtactgatcgttgatcttggtaggagccaagcattgtgttacaataccgtatttgacgagacacatacgcttccatggtcctgaaaataaacaagaaaataaatgatccttgatgatagaggcatggtaagctcatttacagggttaaaaagttaagtggagcaaaccatagatgtcacagttcttcctctcagggagaacacacaacacaaaagagggcttgtcgccagacaacaactgctgaaacatgtcattcacccttgtttccgcacgctcgcgtcccatgtgagatctctcttgaaacacatgatcttcaggatctactggctgcaagccaaactagttgagcgataccggaatctgcagaaaaggcacaagattgggtggaggatgaacttacaagtcccttcaagttcccacaatggatgagacgctgagcaagatgatgggcattgcactgcgcagaaaaattgacaactacccatctctgcactctcttgggctgaatgagcctctagaggaagagaattggcaacattatcgacaatgaacatgatgatgaatagtaggtacggtatacaaatggagtgcaactaagcgacgtactcacatttttattgaagttccacctcccattgcgcgcaaaaatatcttcgccatctccagatttcagcttaacaatgtaagatttgattagatcaacaatgcttcctacatcatcagttcatcaagaaaagtttctgaaaggcagcagtggatagttatgaccaacctttggtgccggaaggactctagcagcaacctgggtaaattcttgagctatagaaatgccacactccctcagcattggcacagagttataatcactgtccctcaacacctgccacagatggtgaatttttgacaatcatggatacgggataccatcagctgagctgaatttagggtattaagcattgcaacttacaccagacaagacaaacatcctctcttgaggattctgccttgatctctcaaccaacgtggaccgctgtaacgtcgacaaagcctttttgtacctttgcaatggcaccaaatggcaaagctggtagaacattttccacacagttaatgacatgaacaataaaaacagctatagagatttgtaccaaaaaaatgtttcagagaaagtaagacatacctccaatgggatatatgttggccgctttggcttcccaacatttagacagggaaagtgagcagatcccttcaaatctattttccaattcttcctgtagtattcaaagactgtcacttcttccactgtatccgagccaccgttgccattttttctctttatttggaacctggatcaggaaagaaaaactagaataaggtcgaggcgcgtttgcagctcagaaatggaattcaggaatatggcctcacgtctgcgaatagcaagtgtcttcagacaaaccgatgatcctaaattcagagccggtgtgagtcgtttttatcctcaggttcttcagtgcacacttggccttaaaaagaaaaaaaaaacaagcaaagaacatggaaactatgtgatctaatgaacgttcactggttatccctctttcaggactagtacattttgttagaatttcaatggttactctcattgagaagaggatggcactcgagatggggcgattttctggttttcttcattcactaaacacaaaagccatacctgtccaagggaggttggatacatatatatatagccatagctggctgctagcctattgctgcaccctcctagtctaaaattcaaaatttgaatgggatgctgtcctagagggcatccaaactgaataaagcataaaggaggcataaaggagatgctaactgctgctgtcctactaaccgcaactgtcctagcaactgaaaaatattctaaagggtagatgctgtcctgaaaaaggtgaaactacccaaaaagcaataagaagaatcacgaccaaggaccacaaagacttatccaacattctccccctaagtcttgtgcgtcgtcttgtgggaaagttgggccatcccgatcctggagcagagctcgaggaacttgatcctcccaagaggcttggtgagcaagtccgcaagctggtccttggtgttgatgtagctcgcattgatgctccattcctccaagtagcttcggatgaagtggtacctcacccggatgtgcttggtccgttcgtgaaaaacggggttctttgccagggctagagcggacttgctatccaccctgagctccacctttccagtgtctctgccgaggagatcactaagcagtcgagcaagccagagcgcctgggtcgaagcggcggaggccgccatgtactcggcctcgcagctggacagggccaccacctgctgcttgactgactgccagctaacgaggcacttgccgaggaagaagagaatcccgctcgtgctcttgctggtgtcgatgtcaccggcgtggtcgctgtcgctgtacccgacgaagtgtgccttgccaggacacttcgggtagtagagaccgtggtcgagagtccccgcaacgtagcggatgatcctcttcacagcctgctggtgctccgtcgttggtcgctgcatgaaccgactgacgtagccgacggagaaggccaagtccggccgtgtgtgggtgaggtagcgaaggctccccacaagacgtcggtactgtgtagcatccacctcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcaatccccaggtagaaggagagaggccccagatcactcatttggaaggtggccttcatctcctccttgaacgccgcgacctccgcatccttggtgccggtgatcaccaagtcgtcgacgtagacacccaccagcaaggcatttcctccattgccccgccggtagatggccgcctcgtgcgggctttgctcgaagcccatccccttgagcgtagaatccaacttggcattccacgccctcgatgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcatcgcacgcaaggtgcaactgcgcctctaggtcgcgaggcaccagtcccggcaccggctggtcgccgagaagatcctccatcgtacggtaccatagctgctcgccgtcgtggtacacgtcgatgcgctccccgtcgtgggagagcggagtagcgaactccaccgggctgcgctcaacacgagctggcgtcggagtagacgtgcttggaggagtggctgttggtgctggagcatgtggagtcgacgaagagctcgtcgtagtcgaagtcgtggcccgagggtgtgttggtgttggagtcggtggagatttgggggctggggtagacacgctaggtgaagaagagctgcctactcccccagctccctcgaagtggacgtactcgacggtgaagtcgtcgtacgtcggagtcgaaccatcgtccaccgccttgtcccatacccaccctcgcccttcatcaaacacaacgtcgcgcgcagtgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgtcgttctgttgcgggctgtaaggcgtggtgtagtgtcgctgaatgccctcatcagcgcagtacgacgcgaattcagccgctgtgaattcaccgccgttgtcggtgcgcagcacgtgcagcttgcggccgcactctgcctctgcagcagcctgcgcatgcctgatggcgtccgcagcctctcccttgctgccgaggaccatcacccacatgtagcaggagaggtcgtcgacgagcagtaggaagtaacgtcgtcctcctggtgtggccggtgtcactgggccacacaagtccccgtgcacgagctcgagccgctccttggctcggaagctcgtctgctggggaaaggggagccgccgctgcttcgtcaccacgcagacgtcacagagctgctccacgtggtcaaggcacggcatgcctcgcaccatctccttggcactgagctgcttcagggcctcgaagtggaggtgcctgaagcgctcgtgccactgccacgcctcgtcatcccgacgagcggcgaggcaaactggttgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccaagctgatgatagaattcctcaacgcggggatgtagtagactccggtgagcagcctgtgctcaccggacttggcggtgaaggtgacggagccaacacccttgatctccacgccagaggcgtccccgaacttgacggagcctcggacgctggagtcgaactcggtgaagaactcccgtcggctggtcatgtgatgggtggcgccggtgtcgaggtaccacccatcagccttgtcgttgctggagccgttgcagagggagacgagtaccttcggctcatcaaggtggaggaaagccgctgcggccggtgccgctggaggtagctcgatgcttgcgtgagccaggagcagagccggctcttcctccacccgtgcgacgtgggcctggccacgtcgtggctgtcgacagtctttggcccaatggccaagcttgccacagttgcggcaggcgtcgtctcgtgccggcttgtggttgccggtggcaacgccctgggcgcctctgcgggcgccaccctcggcacgtcttcgcgcccaccgtagctggacacctccctgtgccttgcgcggcttacggccgcctatcggggaagatgactcccccttcctcccgtcaccttgagaggcctcccactgttcccgagtgagatggagcttcccgccgatggtgatgggccccgagagaggctgtggctcatcaccatcgacgaccttgaggcgacttaacgcctcctcgatcgacatcgtggagaggtccagcagagattcgatcgagcgagcgatctgcctgtacttctcagggacgcaacggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcagcgatgagggcatccagtgctcgccgatcctcgtcgtagtcgacgtcaccgtaccggactgcctcccacatatgccgcacctagagcctcaccctcatcaccgcggcccactcgatgtagttggttttggtgagggtaggccacccaccgccgggaccaaagtccctgaccactgtctggacgccgtggtgaccatggtgccggtcaggggagagagagccgtgctgcctgcgagggccacgtgcgggctccgggctgccgccggcacgcccgagcccgtctgggttcccgtcggcgggcgcgcggtcccttgggccgccgccgccgccgtggaggtgggctgctgcccaccgctctgctcgctcccgtgcccttgctcttgccagctcctcaagctccctgtcggcggtgatgtcgccggcgatggagccgttgatgctgctgcgcaaggtctcaacctctacctccgccgcacgtgccgcatctttcgccgcctccgcctccgccctggctgctgccaactccgctgccgccagtctggccgccctcgctgctgctgcagcggtctgagccgttgctcacctgcgctcttctgctgcggcgagctctgcgtcctgctgacgccgagtgctcgaggcgaccgaacgccgagaccgagcgtcggacatggcgcacctccggggggctgctgcgtggagagggggaagggaaaggggaaggaggagcaaccggtgctgctgctgctgctggctgagagctcaaccgagcttgagaaggggtggaacaagagatgtttagcctacaggaaagtgtggctctaataccagatgttagaatttcaatggttactctcattgagaagaggatggcactcaagatggggcgattttctggttttcttcattcactaaacacaaaagccatacctgcccgagggaggttggatacatatatatatagccatagctggctgctagcctattgctgcaccctcctagtctaaaattcgaaatttgaatgggatgctgtcctagagggcatccaaactgaataaagcataaaggaggcataaaggagatgctaactgctgctgtcctactaaccgcagttgtcctagcaactgaaaaatatgctgaagggtagatgctgtcctggaaaaggtaaaactacccaaaaagcaaaaaagaagaatcacgaccaaggaccacaaagacttatccaacacatttgataattatgaaaaaaaaacatgatcaataacaacgcttttgatttacctttccccagtcaatttcatgagggttcttgatattctggttgaagagaagaaactctatgacaggtccaggtctgacgatcatcgtcgtggatacatctgcacaaaatcagataatgttctgcatttaatatcactttgtcacatgttgtttactttgctaaggatctgatgataggtgatctcatgcaaaaattaaacatgtagatgatgaacataccaacattcagtgacaggccactgtcagtgggtcgaaagctggagtgaaatccccgacaagagattttctcccgtcctcctttcggtaccccagttttcatccagccgtccattgctgaggggtacgatgggcatgaggctgtatcgcgtgcgctatccatagaccatctcaggttttgggcgacctcatcctgaagcgccatagccatcccacggccaagcaggcatcaagggttaccgacccgctcgaccggaagcgccgccgcggcaggtgcacgggctaccgccggtggacgttgccgccgccgcagtaggggcacgtcgccaacgccgccccccgcgcccgtcgcggccgccgctgcaggtgctcgtcgcccctgccgccgactcctgtgatttcatcgctctcgtagaggtagactgttgtgatttgactgtgccgatttttgtttgaccggatttgagtactgagaatgaattgtgaaattttctttataggcaaactctttatgggtgagaggagtatcgtacgattactgctatgagattcaagactgaggatgacggcttcaagttataggctattacattttgcaatcatgtctctaagttgttttgtcattcctacaatttcaggaaagtagaagaagatgtgtgagatggataagaagtagaagcagccctttgctatgcactttacatagttttgtcatgctcttggtcgtaatgaatacattggactgtaataaatcttgatgtgctttcctgtagtatgatggatgtactactattttgagttgtgctcgcatggttgaattttgatgtgttttactgtatgtgaacatggtgtatgcgaatctgaaaattatgtgttaaattatgtgttttggtgctggtgcgttctggaaatgaagatatgtttgatgtattgcaatttggtgcgctaaattgtttactgtatgtgagtatgaagttgtgctagcaaatttggtaattgagccaatattgcttgatatgcttgagactgacagccggatggttctaatttatttgagatttgagaaaaaaaattgcattcataacaatacagttcgtacataaattattcaacactggtacatatactccaagatattgtacataagaattgcaataacaactagggaacccatgaaccaacttttaacatggtctgcctctttttttagctttgtaatttttttcttatatgttgcttcacaagccaaaatcttggcagccatttcaaattcaagtttcattttgtcttcctcaacttttgctctatctggaccattcgtactgccgcctggttggatttgttgtgctagcatggtccagcgcaagccaaagcttctcgaatgccaagcaggggccgccgtcgccgccgccgcgcaggggccgccgtcgccgccgtgccttcatcgtggccgccgccgccgccgccgcgcaggggctgccgtcaccgccgtgccttcaacgaggccttcagcgtggccgccgccgcccccgccgcgcacgggccaccgccgcgccgtccagatcgggagaaagggtagggttttgctagtcaagaagtatatgccgcacttctccaaactatccaccgatccaaacttcatttcaaacgcgaaaatacgattatacccttccacccttgctcaatcgcacaggccacaccatgaccaagccggtaccccgaggtaccaactaatcttgaccgttcgatctatcatcatcaacgattgggatttcagtacctcgcggtactagtaccttgcggtaaaaaagaaggaccggagcaattctcatttaaaaaatccattgaatccggttcaaaaattcccacataagtaaaaaaaaataaatgtcgaattcattctggtattgaatatttgcatacttcgtaactttgagcactacattcagtttttttttcccgatggtgtggatgtaggactagaccggatgtaggactagaccacccaagtttaagacctcgttgaggagagttttttattttattttatttacaaaagcattgctgaatcactgaaacatggtgaattctaacaagcaaggccttgcaacgagaggatcaagaacttactgcttagcagagtgctgcctgagcgtgatgtcaagaaccctaagagcctccatcgagttctctgtctcctgccctcttagcacctcggcaatggcgctcatggggtccttcgccgcgaaggagatctccaccatgaacttcttcaccgccatcggccgcttcatcctcttcctgtcactccccccagggcttccatcgtctcctccggagctccgcctcgtcgtcgtcctgcacacagcaaaaaaaccaaagaaatggtgctcaccaccttgacaatttttttttagatacaggaaaatggttacatctccggcctctgccaacagacgtcaccacctggacatagcaacagttacatatccatagtttacttggcttatcagccgtgaacaaaatttaatttatgaaacttaatttcaaagttgattttgagggttcttttgtcgtagtttagttttggttgatttgttcatttttaaacggcttatcaagtatcaacccataattattattattatttatttttcaagcgctttgtgatcgatactaccttccagatgaggaggcgtcctccatgacgacgacgaactggtgcttcgtctgcagcagagctccggcggtgaagaggcccttctcgccgttgtaggcgaactccctgccggcgagctccgacgcataggtctcctgcagcttgtcgacgactcgccggcacacgcctttcgcctccacggggccgccgtcctcgtacttcacctccacctgcagccatggacacacaacaacacacatgaaatgcaaggattcagacatggaatttcagatgcagaaatgaccaagatagcaatgaagaagaaaaaaattgcggggattgtgttggtgtacgtggtaatggtagaagtggccgtccattcgccggacagagactctgaagtggttcgtcaaaagctgtatcgactgccctctcgtgccaaaccctttcctcgacattggaagcttcttgggtggcttggccatggccgaaggttcgccctcgtcaccatgagactccatccaagctcagctcaacttgtaactgcagaccaaaaaaaaaaagaagagaaaaaggaaagattgcacgatgatttgatggatgggattgggaaaataaccaaacaaactgaagtttcctaaagttaagaccaggtcaatgaatagattatggtgatcaggactagcatacataaagattaaaatcgatagatatagccgcgatcctggaaccaaaacggtgaactatgtatacagaaatgaagaatcaaaacagtacattttggaaaaagcaattcgagactatatatatttcgacagcctatatataagcaatgagggtccacgaggatgatagattaggaaacttgtatatagacaggcgactccagaaagctatccttttcacatttggaaaatagccttatttgcacaaaagtgtagtattggtaagttgtaaataaaaaagttatattttctcgatgacatcaaataaaagtcaagtttgacacacatcaataacgaaaagtaaatcattctttattattaaaaaaagaggaatataagtgagttggcccgcatataaagggctacctacttaaatggcttataaggatttaacggttaacccacttacacggttacaccttgtcctaccgtacgtacggctatactcctaacatcactcctccttgcacccgcatatgagtataggccctaaaagcctcctcctaaaacttttttaaaaaaagtcatgagcatcacgatgtcgttggcgcacaaaccttcatacacaacctaaactgtgaaagtaatcctctttagaaaaaaaaagttgatggatggttaccaaataaaaaaaactgcaatattcaaatgtgaaataaaacagtgattctacaatccttggtaaaatgagaatcatcatgagttgttaaaaaactatatccatcccaaaatatagtaatttctagctacgtatttggacatgtgtctagatacatatcatttggataatggtctgtccaaatacatagctaaaaaattactatattttgagataaagatagtttgctacaaaatgtggaattcccatacatctttgaggacttggaaaaaaaactctgaagtctaaagagaagaagcaaacagtggcgttttatcctaagtggagctgtggaggtgatgatgcaaaaccccaaccaaagttaatattgcagcacacggaagatgtggtttttgtctctgtgtttcatatagatgcacatctcttctttatttaaccgatatcaaagttgctaaatggtgcatggtgcccccattttcttgtttttaccaaccgatcgaaagaaagatcaaaatagcaaaattcaggaattaaaaagaacccaaccgtccttacagagcaaaaaaccgcagatcaaaccctggccaaaaaagaactctgcaacaacatcaaagatcagcaaaggtaactgcaccgaaacgaactaaagcagagagatcgacgaactctgacgatgaaactgtgaagagacagaaatgagatggacgagattgaagaggggaatcagagagcacaaaatcggtaggctagtgagatgccaatgcaactcaaccaagacaaggtagcagcaggagagagaggaagaagcagcttttcaactcaaaacatataacatatatagaagaaaaatgaggagaacgagaataagattggcaattcatatggtatatcttttgagatatattaggatacaaagaaccaatattcactgtacatctctcttttgtacacgcttcaaagaagaaagaagaagagaaggaggcatctcaccttggtgtggccggactccagagagaggactgttctggcagtgcaaaacccccttcgtcttcagcaggaagaagcgaagaaggaagcttaaaaggacacggcagagcagagcaaaaacccactttgtttgctttttaaatgatttgacctcaaatgtttagcgaatcaccaagagcctactactgttactgtattaataattaatcagtttaaagactatccaaataatccaacattcaatgcaccaaaacattttttttttactatctttctttcctttttctccatcctcttgtagcaaatgagttaacatatacggaagataataagctatagttgtattctatttaatcctaccaacaaatgaattaacgtatacaatagttttttctccatcctcctatagcaaatgagttaacatatacgatcgataataagctatagctgtatcctatttaatcctaccagcaaatgagtttacgtatacaatagataagatatggttatattctatttaatcctaccttagagcatgtcttgctcttttagcttctaatataaaaccaaccaaattgtacttgctctttagcatcttacatgaaaaccaacctagtaatcgtactctgctcttttagcttttatagatggactttgcgagacatttgattgggcccaccggcgcagaagccatggaatgaatccatggtactcgttgtctatctcagtttcaagctaaaaagtgtgcaccatgtgatctcctttgcaaagctctctccacttgttgatgcttgctgctggtttccattcacggtagatgcacagacgtagcaaaaaaaaaagctcaccaatgcacgctactgttcatacttcattctctacgttagaacctctaatgcagattatcctgattcatgagacagctgtcagagtagggagcaaaatttatgacttgcaacgttttaaaaccaatttgttaaagaggctagcaattcagcaaaaccatgtcacctactccctccgtcccaattcctaggtttccgtgccaacgtttgactatccatcttatataaaaaaatttttataattaatattttcattgttgttagataataaaacatgattaatactttatgcgtaattatttttttaaataagacgaactgtcaaaaatttgggacggagggagggagtacacggctacatgggttccaagaaaacatgagctgattccaacggatgcaagcaaaattcagcaaaaaatcgaaaagaaaaaaggcaacccaacccataagggcagcaaagcagagcatggaacaagctgcgattaagatggacaggttcagtagttatcctaacaggttcagaagtgcggcatccagcctaataacatccaccccccagctggtacttaaacaaacacgacataaacaagactaccaaaacatccacaagttcaggccataacatagcagccaagcggctgctcagcagaagaacatggagctcctgactttgttatgcaggcgaggcagctcgggcaccggagcgctgcccgccgaggtatggccaccatggctcgacgacgtctccgacatctcgtcgaacttgatgaactggctgacctgagcagcagcgagatgcgcgtagcaaatgggtgcaactgcaaggaaacaagataaagatgaataaataaacactggcatgcaagttcgaagcaaacatcaatcactaaaccaggtattgcccacttaccgactgatatggctgtagtgctcctctggtagctgaaagggtacaaacaagcatttggatgtcagaacaagtctgtttccaagaagtgaaaaaaggaatcatggcatatatcaaacttacacataggaaagggagtggaccaactcctgaagatcgtcagcagagaagcctatctcatcatgaaggatatgataatgtgtaggccttgtagttccctaatacagcacaggcacaaccaccatcaattcaagtaggaccaaaaaaaagggactggcaaaaggagtgaaacttcatacagagaacacacacaaaaaaaaactatagaaatttctgatattaggctataaagaaattcacataataatactacagctggccaagatggttttatagcataattaaaacaagttgcataaagcacccaagataaatgaattaattcatccaacataaatcagaagttgcacattagttaggttaccagctgtagcaatgcattcctgatcaaccgtcaatagttactgattcaattcatcaatgacacgtacaaacatttatgtacaaagagtacaaagcttggcctgatgggatcatggtaagtatcaatctagatcacttttgaaggataaaaaactcagggcaaggattgaacaaagcaacagcctacaagtgccatgtatcaataacttaattttaatatgaaagacttgcctaaacaatcgaccttgaaagtggaatattatacgtgacccaattaaagccaaccccgataaaatacaccaagacgatacttacaatcattccagcgtgcgcacacatgtagaagtcattgttccttggatgacagactgcgttgtccacaacagtacctaaaagttacatcattcaaatcattagatattagattaaggatgtacaattgcaagttttgacacaacatatcgaacaatgggattaccaggaggaacgttattttgagatccaggcacaaaaaatttggtatgatgattcttctgtgcaacaatcagtgtaaactttggagaccagttttcgtcaagaaacttgcatgcctgcaacaatttaaggatacaaaagtgattgtgcagctgatgatagtaatgatacttgcagtcttgcatacaaaataaaaaagaactaaaaacaatagaacagaaagttataatgaacaatacctcaattatttgatccagctcaatgttcagcacctgggtaaactggctctcactgaccccatccctatatttaaagcaccaaataagtgaaaaaaattaaacggttacacaaagaaccagttaagtcaaagcacaaagtaatcattgtccataatttaagttttgcttttacaatcctgcattcaggtatttcactgaagcttattaatggcatttacgagaagctttcaaagagtaactgacctgaagataatgacttgatcaggcttacgtttaccagtactggtatagaagtcaactaataactccctgaaataatttccagcacaaatggcagaagatatcattagcactgggagaatttaatgaacaatggaacatgccacaaagttataaggattgcatcacggtccaaataaaattgcttaccgaatgaggccatcatcttcctgagctccttgtggcttaaatagtccatcaatcatttctaacttaggtgactgagaacggactgaagccctgtattttgatacaagaggccattcacgagaactaacgacctaaaaaaaggttaacgattaagaattaaggaccggtaagagcaagaataatagtggactataagcccactataagcttatgtggagaaagacacagaaaaattatgtgttggctctaatgaaagagctagttctccacatgctccaagatagatgtattaaatatacaagtgagagagaggagaaaaaaggcaaccttatagctaatctattataaatattagccaagatgggtttatacttattaacttgtagttagctctctaagctctaaactatcaaacttgctctaatgattaagtatagtaaagcttttcgtttctggtacagtgcagaaaattagaaaagtttacttaccgcagcaattgaaggtatatcagactgtccaggtgatccatgggaaacatccattcccaatattattgtcgggaccttggatacaagaggaatggaaggggatgtttcaatttgaagcagggagttcaagccaccaagctgattaataaacaagcaaaaatgttagtgctgaccagaccagatataaaatggtacaatgcgagagaaggaaggatgtgaaaatccacaaacctttgcatttatctttaacagtacatttgtaatatactgatcattgaccctagtaggggccacacattgtgtaataatcccaaattcagcaagacatttccgcttccagggccctattagagaagaacatgtgaatgccatagaagggttgcatatttgaataggcatagcacaatcttagtgtaactgaccataaatatctgaattcttcctctcagcaagaacacagagcagaaactttggttgtccaggaagctttttttgcatcttgtcaatcatgccatctacccttcttgcagcaggagctcgtcgcattgaagggtcctcctcaatgacatcaaatggatcttctactttctgcaaagccagtcttttaagtgagggaatcgcatttgatgaaacatgcaacactaaagtgagggaattgcatttgatgaaatatgcaacattttgagtaaaacagaaaaacctacaattcctttcatgccaccacacttgatgatgtctcggacaagatccctaatattacaccgtgcagagaagttaacaactgcccatttctcgatactgctagccttaatgagcctctgtaaaaaaaagatataacagaagttacaatatgtatcacaacatggaagtctaaagagtaaagtgggagtagaactgagacactaaccttattattaaagttccaccgcccattacgtgcaaaaagatcttcaccatttccagcttttagctgccaaagaaaaacatacaattgatctaaaccatatacaaataagagaacacagcaaagggttaattaaaaaacgcagcatagacagttctgactgaccttgggggcctgcagcaccctgccagcaacttgtgtaaaacctcgagcaattgaaataccacaagaattcaacataggctctgaatcatagttgctgcgtttcagcacctgcaaattcaccattgatgatttgattattctgtcaggaaaggggtacatcagctcttaagctgacagaggagcaactcacatcagacaaaactgacatcctttcttcaggtttctgcctggacttctcaacaagcgaagacctctgtagtgtactcaaagccttggtatacctttgcaaaggcacaagagagcagagctagcaagcataggaacattcaccacaatcagcaaaggatgttaattggaaaatatttatgttggattaaggaaaacaattacctcaattggaaaataagttggccgttttggtttccccacattgatacagggaaaatcaccagagtatctcaactctatgccccgattcttcacaaagtactcgtaaacagatacttccacaccttcaggttcaccatcaccatttctttgcttcaaagtgaacctagataattatgtgtagctaagtaaataaagctatttctcaaagtacataaaaaaccaaagttgcaattgcaaaaacgtcaaatatccaggcacacaacaatataaaatataagaaaaacaacacatgaacaagctcacatttgttcatagcagtttctctcactcaaaccaacaatcttgtattcagtatttgctggacttgtttttatccttaaattcttcagagcacgcttggcctacaaatttgtgttaacaatacaattcagtcatctcaaagggttcacattgttcttgtcattcattcttaaattattgttttactcagtgaaatgacgacataatacctttgcccagtcaattttgtttgggtgatcaaccttctggttggcaagtagaaaatctaccacaggaccaggtttcacaatcatcgttgtggacacatctgcacaagttaaagcagcaacatgcaaacatgtattatcagctacagcgtgcatgtgaccacatacaaaatatgaaattggggccataatagcaatcgtttaccgatattgagtgaaagtccactctgtgtagctcggaagcttgaatggaatcccctacagcccatcacaccaccacccaagtcaacaaaatttgaaggattgttatggaaaaaggattggcgaaccaaaaggcaacccctgcataaaaaaaggaaaagttaagaacaaatgcaaatcagccatgatgttaaacattctaaacaatatagctagaatatttgcaaagtaggggcttccaaaagatatggaaacatactgttttgcggaatgctgtcttaatatgatatcaataacacgaattgcttcttgggtgttttcagattcctggcctctcaaggcctgagcaatggcgctcataggaatttttgctgcaaagttcagctcaactttaaaagtttttgtctgatatggccttctaacccttttcctgtcatttcctggactgtcattgccagggctgccaccatttgcagatgacctaatagcattggaagttatgtgagcaaaaaatgttgaagtaaaaaatgttggcatcattgaaagtagcagaaagaattgagatagataattactttccagtgttgaagtcttccagaactaccgtgaactcattgttcacttgaggaagagcaccaatggtgaacaggctcttctcaccatcgtatgcaaaatctttatttgccagctcagacgcataggtctgctggagtttgtccagcacctttctacctatgccctttccatccactggtctatcatcctcatacttcagattaacctgtgtaactcaagcagtagtggcaatcagacatgaacaaaaggaactcaaagaagaaaaataaagaactgttacaagggctagagacgaacatagtagtgatggaaaaattcgtctgctgccttcagtgaaaccttgaagtggttcgtcagcagctgtatcggctgcccttttttgccacaaccagagcgagccatcaaggccctcttaggttttgataacttttttgtatcatcagttttaattggctcagcatttggtggcaaaggtgggggaggtggcaactcctcgatttcaccactgttggactccatgtgcacacttctctgaaatagagcataaaagccaactaaataaacacttctctcagactagaatataacaagttaaatcaatcttcaaaactagaatcatacagaaaacccctaggtctcactaatatattttgcatgcaaatgaaatcgtaaaatacaagaaaattattatgacaccacaaggtttaaaacattcaactaaaagcataatatagtaatatgctaacacaaacgttatgtcagtcagtctgccatgttgcatatgcacacaaaagaacacacaacaaacgtttcaagtcaccgttcaagtccaaactcttatcacacctacatgagtttgccagtacactttaaatacactgtcatactgagaatgacctgaggttactactacttcgagggtcaaccggtgccaaaacaactaagcttcttgtttgccatctacattaaaatggtactccagtttttaacaatgtattcaaagacactaatcgtttgtcagacgattgcaacattaacaagaaagcctgagaaactagtagtacatgcaaaaaaaatatgtataactactgagagtgagaccacaactatagaaaattcctagtcaactcacaaagattaaaacattaattaatagccaaattaagagcgtagtacacttaccgactaactccccaaagctgtcaaagcgctgccctatcctgcacacaaaatacataactcattcaacaattaacaaggtaaatcaaaacagaaaaggaaaggaaactaaaacccatgctaacagataccagacaatgaaaatgctctgggtcaagagtttttcctccagaaaaagaaaagaaaagcaaaattagaaaactattttcttaatttttcttccaaaaagataggagaagagtctatccagcctacagactttcaaaactacaacaaacacaacctacccatttttaagtacaagaaacttagccattttcttaatcagcaaatcttcttttcccagtcaagatcagtatcataaaccttcccaaaaacccctaaaccctaacaaaactacacaggcagatatccaccaaaacaagcatcaaaaggaggtgctcccaaacaaaaaaaataaaggtttaaaacaacaaggaccagaaatatcaaacgaagaaagaacgcaaaaatgaaaaagaatcgcacaaacactgtttcggataaatcttcaaaaaaaacatctaaaacaaaccaccataaacggcaaaagacgaaaaagccccgagaacaacgcaacgaagaacgaacgaaatcaggggaaaaaaagaaagaaaaccccaaatcaaactccttaatagaatgcatcaaaatgcagcgatctttaaaccaagaacagaggaaaaccgcaaaagaacacaaaagaacagaaacttccacggtaaaaccccacggaatccgccctcctctcctccccgaaaaaccccaccaccaccaagaaccgcaccaaacaacacaagcccaaccgctcccgcatacacaacaatccaatctgcaaaaacccccccgccaagaaccctagatttccctccacccaaaatgaaaagcgggactcctcgccttaccaaagaaaacgatgcaagaacggaggcgacctctccgagagggtggtgcgctcctcctccttgtcccccctccctcctctcgaaactcgaacgcctcgcctctccacacacactctctctctctctcttgtaggaggagaagacgcagcggcaggggacgaagggtaaaaccggcacttcgcaggacctcgtcgaggccacccgcgccaccgtggcacgggggtggatcgggaacgtacacgtgtcccccgcgagcacacggggatgcgcggcgacacgtggacgggccagatggcccccgcgcgcacgacggcccagttggaatgacgcttttacccccggggctctcccccctctacccccgtgttctcctccactacccaaccgaaaccatccgctttactgctgggacatcgctgacgtatggaccacgagggtttctggccccacgtgtcatcgacctgtgtggctgtggatgccgaacagtcagccttctttccagcttgccgatggtatcccggcggcgacacgtactcgctcaccgtgggccccgggggaaggtctgggcccacctgtaagtgacagcagttcgtttcgcctagggtagttccgcgctcacggtagacgtgacaacgacactttcgccgtatggagcggtggagcccacccacccatcctccgctgcgtacggcgttaagtccgacggagggggagggggcgaggaatccgaagcttcgaacgatccgacggctgagtcgcctccacgcgggcaatcccagccgtcggatattcacgccgtcccccgagccgttaaactccccgggcatccacgccctctcggctctcttctcttcgcttcctccaccagaaaaggctgccccgcacgcgcgcgagcgagggaacccgcgcccatgggccatggcccatggaccgagcctaccaaacaccatcccaccgacacgtgggtcccaagcggccctcccatccgagccgtctccgcggttcacggtggacgcggcgcattcaacgcggggtgtggagggagtacgagcggtggctgcatctctgcgtgttgtctggcctggttttcgcaaaggattttttgatgaggggggagagagggcgaggcgaaagctgggccggtgcgtttccttcttcaatggtggccaaccctacacctgccaaccatgctactgtcctacaattgccacatttggggggttgggtgtcaggctcatggttttccacaccgccgggccggagttaccacgccccggcggtaagcacggttaccgcgtgataaccatgaaaaaccgtatgaaaccgtgtaaaaattatcaaaaatttaaattattttttaaatttatttgaatttaaggaggttaccgcggtatttatattaccatacccccgcggtaactgcgcagttaccggcggtaagtcaaaccctggtcaggctgtgattttggtacagattccatgtttgagttttgggggtgtttgtggaaagagaggtataatggggaaggattttaaatttgaataattggaggatgaagtggaagcgcagatggggtgggttctaaattttttttttttacttttgtatatgagtactcttttggaaggtaattgtgtgaatatttaattataactaatattagtctagtttttttaattagactaatggtattacatatttgacgtcagcaattcattgttcttaacttttgtggatagaactcatttagtaggaaaaaaagaagatattagatagggtgattaattatgtagacatttagataagatggcatagatttagtatgcatttgcccaatttcttttaggcccattttggatctaaaattttgataaatggatttcattttcatttctaatataatttagggaaaaaaaccatgaagttcagttcaaatgttaaattcttttttttcagtgccatctagaattgcaaaagcaaaataatcaacctaagcataattgaatagaggctagtgtaagcaacaatcataacgtaccacaacaatcataacgtaccacctccaccgcatttgtttatgtcatcgatcagtccccattgttgcacggtgcacatcagatctagcacgtcattcagtgatgtgatatgttggttgtttcacgaaggatgtcacaccacccatggatctaaacatctcttaaaaatggatctaaggatcaacgaccatggagtcatgccaaaatataggagaatacgatggcctaaccccgaggccttggagcaccatcggagcttgaggctagagccgtcgataaagaaatagagttccaatagacagtagagtgagggaaggatgcccggacatcgacaaagacgtaggcgtagtgcataggaagtagattgcggcggcggcggcgtgcatttggaagaggtgtggaggatagagtgatctcgatgcgcagtgcatggaaaaaggaggattagagtccttggacagatggatcacgaaaatgatgttttttaccctgatttataggatccaaatgggccttgaaggttgcattttaacccttccattctttgccccgagatttcggcgacaaatatgcaatatgataatatcgctaaactaaactaacacgtggaaatcccggtccgtcttatcgaaatctcacatagctaaatgctatcaatctttcttttatgtcaacgtggtgcacacgtgttcacttgcatgtcaaagtcaacacgatgattccaactagtcgttgactaacggtggtccaacgagctctagtgagtgcaccatagagtaaatatcaacctcgtgaacttatctattcatatgtgacaacatagagattgatgaagcggaataaattatgacggtattatggtctcgattgaaggttcggtggatatagagtagcaaccagagtagagcatgaggcggttaagccagatgcgatgacaccagctcatggtggtgttctagtcatcaaatagtagaggtcaaaggaactatctcaatggtggcgaagatggattgtgtgcaaaggcagcaggagaatgtaagaggttcaagcggcaattgggtgacattgagagctcctcaagcataggtcccatatgttagtgagagagagtacccgcctatccacctaacaatgggacgatgggagtagagagagagagagagcatgagaggaagaagggaagacacaatgttaagtggattccacattcccacgtgatttttttaatcctttttgctaggatgccatgtagatcaaaatcatctcgtattagttgagagccgtaaagtggaagagtttgaatagtagggatggtaaatgattttcgacttttgcaaaaagtttatatatgcaaaattatcccccctatttatttatgatagatagcaaaacaagatttttaagaatgacatgatccaagtaccgatcactgactactcaacgatgttttgcgatggaaagccttgtacttgtcatcttctagctcctccaacatttgaggtgattcaaaatacccagccaaacaaaacccatgcataaccaccatcataccattgatgattccaataaatcttggtagtcgaattatttgacaaccaatgcaaaccttaggtaaaaaaaaaggggttaattggaaccatgccattataaatatcatagttttgaaatatgccattaatattcatctatttggattcatgccattataattccacatctatccattatacaccactacttgcccctttaacatattttccaagatgttatgaccaaattacccatatcttcttcttcatcccctcccatctctatcttgttcgtcgaacctgacatcctagcaaacgaaaatgctcacaccggacgaccgacggggtggagaaaaatcggacgctgtctgccactgcagcatgcaaagaatcttttcttttcttatttattcaaaagattttttttatcgtaaactatttatctaatctacgatctgattgcaccactaaattcgttacaattaaatctttacaacaagaccacacatgattatatttcgacaaaaaaatattttaattttttattgatttttttaatgttgcatgtggtttcttttgatgtttcaactagtagttttacaatgtttcagctagtgtactcatgatgtttcactgtgtacggatcaaatattgcagtggaacgcgccgttgcaataaattatccacatattttggaaaccctctattaagagaatttagtttattttttgttccacaaaaaaatgtttcacctagtgcactcacaatgttccactatgtatagatctaatgttgcagtgaactgaaatatttcattgcaacaaaaaaaacccacatattttggaaacctcctattaaggaaatttgttttattttttgtttcaccgaaaaatgttccacctagtgtacttataatatttcattatgtatagatctaatgttgcagtgaactgaaatattcttctgctatttgctgaaacattgtttttatataagttgaaacaacaccagatttaaacgagtgaaacatttttcaatctacttagtgaaacaattccgatatacctggtggaacatcatgcaacatttaaaaataattcaataataagctattttttttcatcggaatatatccatgtgtggttttgttttaaagatttaattgcaacgaatttaatggtgtaatcggatcatgatttagataagtaatttaagagaaaaatcagtttaaaagtagttttgcacgtaaatcggactatgacgtcatgctgatgtgagcatccgatttttccctaaagcatcggacgtccgacgcatagccctctcccctagcaaacgaggcgaggttacgggcgcggggatgttcacacccggccggatgtgctcgcgctccgcctcacgcacttgctgctctcgccggcgcaaccctccgtgcccatggctgccgtgctcctgcgccgttttatttccgccggggtcacaggatgcgggcctccacgtcggggttccccatgtttatctggaagaagctctcctactccaagggagaaggagatggaagatgaacagggtagagattggaagagaatgaggaagaagatagggatgatttggtcctatacatttagaaaatgtgttgaatgggcaagtagtggcatataatagatatgtatgaaattataatgacgtggtttcaaatagacaaatatcaatggcatattttaaaaccataaaaattataatggcatggatctaattaacccaaaaagaaaaacggtcactaacttacaacgagttccattcaaactctgatccattcaaaacagtagctgatcgaccttgatctttttttcttttccaacagtaagtattcaaagagcaatttcatatgctctgataagttaaagtgtcaataacatgtcatgatacaatccccatcaagagccctaagtgttctatttacattgtaactctagttaaagagattaatcctagtactagtgtactggtacagtacaacggtacaagtaccagatctatgacacgtgtgtagtatacctttacagttccccgtttcccgctatgacgcggcacaccaaaaatttcagcgaccccgcttcgacggcggcggcggcggcgccgccgggcggcggactacgtggcgacggccgtccagtagctggtcatgcaggcgctggccggcgtgctgatgatccgcgcccactcccacccgccgccgcacccgtccgctcctcgccgcagctccgccagctgcaaccacgagtccacgaccaaaaaaaaaagctccggtaattagacaaagctcatcttcctggcattctttgagcgagggcgcgcggttcttgatttcgtgcgatgtgatgatgatgatgaggaggggaatcgaggccggtcgcttgcttaccctgccgtcccgtagctcgaagaccaccgcgtcctccgagaacggcaccggccgcgcggccgccacctgttcgacgaaatgcccccagcgccattagcagccttttagactccctagaccctagttactaccaagaaacagcgaaatggaaggggggtatcagaccttctcgtcgcagcttcccacgaagccgtccgcgtagtgcgcgtcggcggcggagcccagggtggcgcagctcttgtcgccgccggccgcgttcatcgccacggcggacggtgccgacgggtgcccgtggctcgtccacctccacgtccagttctcgaggtgtcgccggtagacgtcgccgtcggacccgatgatgaacagctgggagccgtcgaagcacggccccggggcgccgacgatggccacgtcccggtggggcgtcccgtgctccacccactcccacccgtcctgcgggctgaaatggtactcgactaggccgccgtgctccgacaccatgaagatggagccggcgagggagagatgggacggcctcatcgctgtccccggtgaccgtgagaggacgaggtggggtgattggtagtgcttgtgccatagctctgtgattctgttgtactggtacaggcggccgttgcggccaaccgcaaagatgacgtttcttctgaacacttcctgatccactatgaatgcaatcttggtatcaggagggctctggcagtccttccacttgaatttccttaatgcaacctgcaaaagttttagaagggcatcaacttggtgctgttctgcacagaggttggcatatctggagtgttaattattgtcatgtagggtttacttggtatgcttaccatttaattgtactttgtttatggtttgtattattaattaaaaaagtatgtcaaactctttagttactgtttatcttgtctcaactgcaagcaatatgagtaatgattgtttagaattacaagatgttcctaaacatgaattcctttttattttatactgctttgctcatactaaatgctaagaacgtaggaagatgtatggttatcctgaattactgaagtatatgatagcagagatatttgctacatttgccataatatggacctatttcaagcactctgtttctgttctctgcctgtaaactcctatcagtgaatctcatttctaactactctagattagtatgatgcatagacatgccattatcttgagtaatgcattcatcatttgttcattgagtcattatttagcaagaattaatcaattttgcctgctaaatatgcacatgtttaaatcttgggcaaaggaacagctcaactaaaagtgggcacattcgaaatcatttttatttctaataaggctaataatcgcatgaatgagattagagcatgtttaaacttttaccgtgaactgtagtagcctgcctctcttgttaacaaagaagagtgcgtcatctgttgtcactctgcgtggtaaacctggaatgccatcccatggagacccacttgcgacctgccttcccttcctcattgctgtgcagttgatccataataagtcatctccatttctttctctgatatgtaagttcccgtgaacatcgacaagatacaagctgccattatagcttcctactgtacctttcatggaagtagtgtgctcatgtcttagccataaccaaacaccattattgtttagatattcaaaagttaagccgttatctgttatgagaaaaagtgatctatctgcatgcatcacccgcatgtggaagttaatatcaatacttcttgatagaaagttatacgattcgatttcatccctctcatgggtattaacgtacaggtattgttgcttatcttctttacgccatctggaaggtgggatattgcccaagtcatttgatttggtatctgcagctacattctttgctccagtaatacaatttgttggaccatgctcttctgtgcaatattctgcattccaaccttctgtttctggtgcatctagaatggaccactcatacttgtttggcactttccttctcatgctatagtgttgacttggaccaaaatcatcaccacccataccaggcaaatgcagctccccaagcctaccatcatccagtgggaatattactcggccaacttgaacctgtacacctcggacatttcttgctacctttgtattctcaggagacatgtgatttacccagagtcctctgatcttattgctttgagctccaccttttccattgaaaatatagatcatgtcaactctgtttcagcttgatattaataataagttgttgctctagtataataattaaatgattgaatgaagacaatttgttcaaagaaaaaggttcacacaagaatgttccacaggcattaatctagttgttttgctttgaatgcatgattctattgtgttacctttattattgtttttttcatagaacattactttttgttgataaaacaagagcaagaactaagaactaagaaccaagaacaatattttttttaaaaaaagaataagtgcatacgacattgaatcaggagcatatggtttagatgaaaggtgttttgctggagatatcactttaagagcagttccttcgtttttttttcttgttttcatatttcaaactgaaaccacacattgaaataaatcaatatatggatctgctatgaaaattttcttcaattctcaaattcatctttgttgtttgtttgattttattgacctttttaaggggaacagtaggggagaactctacgagaatacttgattgaccttgagcaaatgaacataaagaaagcagtatctccaaaggagtctatacctgtatattttggaaactgatactcgaatacttttcctgtggttgttgtaaaatacattgaagttgcatcattagattcatcttgttgcacttctgtgatcgaactaagtctttgactcttaggagctccatgtttataccatttccacttccttctatgcaagcgccgctccactaataaaccatcctgccaatctataaaatatctttagcaaatagataaataccgttttacaatggaaatagaggtcctagccatggcataattttactttattggttaacaagaattcctattattacatatatattactctgaacttatctataatgagttcatgaagaggctgtcaatttctcttcaattgtattataacacatgatcggtcataatgttcttgttgacaccctattttggttgttttgcttctgctacaagatgtccaactaaggaaccatatacatgtttctttttcttttagtacatttcttgatatcatactttttgcaaaactatcataaaaaccacaactttaaacaggattttaaggaaccatatgaactttgcaaaaaatgtttcagaaaatgggctgctcagtcaagatggtttctgacgcattggaccacataaaagagagataaggcacatccttcctgtttacttgacatgggggcagattccgttgaggctaaaatatccacatcaggtaccttaaacagactgaatatgtcttaaaaagtattcttttgtagaaaaaggtttgtgcaaaagcatgatctcaacttctcaagaaatatactaatctttttgcaagtaccttcatcagctctgtcagtctatcaggagcagataatatatttttgagattattttcatattataacaatcagcatcgctagactgtatgcatttataatgttgctgcattagcttggatccagtaagtcatttctgaaaagaaaatccttgcatacctttgttatcaagaaaagtgatactgagttagatcctagcaggccatgtaaagcacacccaactgatgagcttaatgagacattctctgctgtttcttcactccatatgtgctttttccatgatggtcttgattctctgtcgaactcatacaagtctcctgtagaactgcaccacactttcccatcttagcactgaaatacagtaattatacaaggtattctacatcttgggataaaaacataaatgagtatagcctttttcttgtttgaaaaactgagcgtagcttagctagcgggaggtctgaatgaccttatttgaaatctaagagtggcttatttggtggaggtatacaccctgctacttgaaatccttatggctctagatattcttatgctgtatttgtctaataggtggatcatccatctgcataacatatcaatgattctaggaaggtactccattagagataccttcacttcaaagaaatatcaacagttgatcaattttaagtgaaggtacatctaatgctttctaatgccttccaagtacttgtaaaacatctcaaccatggtagttcttaaaataaaggtgcctctagtttctttcaggcaccaaaaatatctcaaatgtctaaattctaatgtacacagagcaggggcagaagataaggaaaatagtgcataaacattgtcatttttctcaccttcctctctccccatttgtacaagttgacttttgtttcagatattcaagattcacaaaaacaatagagaaccgactattgaaccagtttattttcccactaaagtagtttggattgacacaacccattacctcctaaagaacacatgaccataccttactgtgaacactgtccctggtcttgcatttccagcatcagatatatatgatacatctcctcctggtgggtggccatggtaagtccacctgtacatcagtagtattggaccattattttgtggagtaggtcatggtaatagtgtaaataagctgccaatttcttaattcctgaaaaaaatagcggcattcactcaagttaatcaagtggtagcctggtaggcatggaaccattcagaat

SEQ ID NO: 79264 - DNA, 15996 bp, Oryza sativa
tccccgtcgtcgtcctagtccaccggcggcggtgcacggcggaagcgccgccgcttctgttgcccggtccgccgcttcgtggcctttggatacttgggagggagttggaacggatatgatcgtacagcacacgatatacgaacccgtgtacgtacgaatccgaaatagtactacatatctacatcgttattaagagaacaacgtttgataccgcgaggtgcgcttattaagatcaagtcgttctccaagtggcagttgagtcatggatgttattcatccagtaacagattgtaatcagctaaaaaaaagtgacaatctgattacaattcttcctcgatcaatctaggaacgcggagtcgtatggaacaatagcccggcgaaattttgttttcgtagttggatcaattgacagtttgacacatattactctagaacattgcttttctctagtgatgcaaactttggttgaaaaaagccatgaaatcggggaaaaaattctttgcgacagtgccgcacgacgcttctagtgcaacaccgtataagctgccgatgcgtgtctcgtctgctgcagcccgactgcccgaggcctttcgttgagcccagcagacgtctcccacaacaccgcatagatcaaccgcagcataccttctacaatttctatttgtgctagatcacgaacagtaattccaaacccaactgctatcgatcgatcaacctcttgtcgtcccggtccattctggtccctgggagcacaccactatagatggctaaaaggcccgaggcccgacggcccggcctagggcacggcatttttgcccagcccaagcacggcatggcccgacggcccgtgctagcctggcccgaccactcggccgtgcttgggcccctccaccggcacgcccgatgggaaaatagacttatttaaaaaaaggcacgatgggccatccatacctttgggccggaccggcacggcctgactacttgtgggtcgtgcctaggtaggaggcgcagcccacgggccgtgccggcccgatggctggtgggccgtgcctagccgtgccggacgggccttttagccatctatacacaccaccatgtttgagtctatccccgacgagaacaccgacggcgggcgtagaggagggcggcggggccccataaattccgctgtatggatgtgtgggtagggcgccatttggatggtgaagggcggagccgcgtagcagccgccggattaaatcttgaaacggtggagagaatagttggagctaattaagcgcgtggggaggcggtggatctcatgatggagagcagcgatagaactcaccaacgatggtaggcacgcgacgggaagagggtgcctcgaacctcgattaattcctaggcagactagcttggccgatagctgtggcttggtctacgtggtgttacgggataggtcagctcggcttgggatgcagcagacgggactcgcgtagccggtctagactgtgccgcacgggatcgtgtggcactgccgcaaagaattttgattgtatttctctcgcacgggaggaattaagctttattcagctcacaagctgtggagatcaatagatcatctaccggtccaaagtttctgatccgaatgacaattgggagaatactggcatgtttttgagtcctcaacttccacagtttagttaggttaggtactgatgtctgatggcgccttaacaagagtgctgaattaataaaagcatattttcaaggtaatcaatgcctctgtcttgtactatgacgctatttgcgtacatataacgtttaatcattgtagacatgggtatttttcgtttgttcaggtatccaccacgtgagaatagcatgggacatgggtatttttcttttttttttttgagaatgacatgggtatttttcgtttgttcaggtgaatagcatgggtatttttcgtttgttcaggtatccaccatttgagaatagcatttactcataagatggtatttgaataataggatttactcataagatggtatttgaataataggatggcataatcattttggacttaaattcagcgaaaaagagttggcgagagggaattttatatttgtttgtcaaagcgcgcgaatcctcgaggaacaaacaccggacatgggctcaaccgaaggattcctccggccattggttgggaagcccgcccgcatgggcaggagggcagtaacggtaaacgagggcacgcgcgcatggcgacacacccccctcgccgctcactaccctacccaccaccaccacaggcgcggcccccctccctgttgggtcagtggtgatggccaaggcaaacctccggtgaaatcgagggtcacagcccgaatcgaccgagatagatcgacagggcttcgccacgataaccagaggcgcccgtggtgtttatctgtaccccgggggccaggagatctcaagcgacgctgagccaaacttatacatatcctccctcgccaactctaccctccaaagccggagctacaggcctgcgctactaggcccggcgatcgagccggggatggagtcggatttatcgcccgcgatctgcgcacgaaatggcgaggtgggacaaaaaatggtagtccgctgggtaattctattgagggcgtgactcgtgagcctggcggctccgttgaggcgttgatggaccgccgccgctgcttagttccgccggcagtgatgcactcggtttgaccggaggaagccctggttcgagctctgctctgctctgtgttaaccatttgaaaaattgttatctgtgagtaagtttcaccttgggtgctaatgtcgcataaagttgtgaactcgtgagtaagtttaagtttgaacatcaatttcactgcatttcaagaatagttttgcaagaggttggtcacaacacgtttcacctgtgtcaattttcacttcaccttcactgtctgtggaaagttacacctggtctcctaaaattttttagttctctgctgacagcaaattcattccttactgtacaaaaaagagttggcgagaggggttttgattgaaagcgcgcgagagagagcccaggggctccccgaaccccgagcccgctagggttgggggaaatccccggcgtgttagcgcattttagttagtgggcttcgccggaggcaggaaaactctctcagagatatcctcacaccggttcactggattcgattaacagtgattagtcgcgggggccagaagaagcaggcggtaaccaacaacacacagggccggctggcatggttctctgaccccggggggctctcaacaaggcgcgcgccaaacaacaaacccgatcgagctcggctccgccgccgatcaaagtggcgtcacgcgcgagccgagccttaccctcgccaactctaccctccgaagctggagtgacaggcccgcgctaccaggcccggcgaccgagccggggatggcgccggatttatcggccgcgcattccgcgtgaaatggcgaggtgggactaaagcgtcggtcgatccgctagctgtagctgatgacgaagaaattaaacacaggagggtcttcgtcgtcggcgtcgatcgggaccgctggccggcgagtggcctgggccggggcctgccctccgtcgatggacggagtccgcgccgccgccgccgcctgacgagctcaggctcagccagccgccggtggacggacggcgatcgaaacgccgctgcttctgttgccaggtccgccgttcgatctcgagctaaactttgctctgttcttgggcctagttcgggctacacatggggatggagagacgatcgtgcccgctcgcgtcgtatacgggccggaccgtgcacgtttcggaagcagtaatatacttaacatagtaggacgacgtttgccaagccatattggagttcgtttgtggtgcttcctaaacggagtgttttttttaaaaaaaaagaaattctacatgaaaattgttttaaaaaagtcatattaatcatttttaaaatattttaactaatacttaatttatcatacgactaatttgctgctcgtgcatgggattagttcctaacccacacaaaacaacacagccattgtctcgttccaaactcacaagtagacaaaaaaaaacctggcttaagctagtcgggtgagttgtgttcactgttcactgttcaggacttcagggttctacttgtttttaagccaaaagaaaaaaaaatcggggaacaccgatagacctggaatatcaggtatttcgagaaatctcagaaaaaaaaaagttgaaaacggaacacactttggttagatttgaatactttttgctaaattgggaaaaaaaattgggctggaaaatatgataaatgcaaagttaactgaaattgaataggctttgttcagattcaaaaaataaaaataaaaacggaattttcgggtgaaatagtatcattttggggtttaaaatttcgtgaatttcaaagctcgcaacatgtgaaggaagtcggcaaccttgaacttttcctgtagcagctgcatgcggcgccggcgctgaccatcaggaaacttggcaccaacgaaaccaactcctaccccaaaaacaacaacgcccccaaaggaacttggagaaaacgtaaccgagtccaacccaacaacacagctactactcgatccccaacgtggtataagacgagcactgcaccgtcgtcatctatagtcgacccaacacagcgacaccaccagcgcccacctccatcgccgccgctcccctcgcctcccgcggtttacgctcgcgcgcaggagttcttggttggctgactgcgagtaagcgaatcatccggcaatcatggcgtcccgtaagtctctctctcccggtgatctcgtatcctgcttctttttttttttttttgttcttgttgattttgccaattcgaatcgatcggtgtatgattttttttttcaaaaatcggttctgcattgcaggcgtcaggtttgagaattccagcgagattggagtgttcgcgaggctcaccaacgcctactgcgtgctccccgacggcggagcagagaacttcttcaggtttgcgtagctgcattgcattggcgccgtgtgaatcttggatttttagcattggtttgaatccgatatttgttatggtgtagcgtgttcgaatccgagctcgccgacgtcgtgccggtggtcaggacgtccatcggcggcacgaggatcatcgggaggatgtgcgtcggcaacaagaacggcctcctcctgccgcataccaccacagaccaaggtatcaacactactcagtactcaccatggatgcctctgctttactctgcttgtcgtcccggaatattttcttcagtcaaattcagtttcaagtactcagattttaatcaaactgagataaacaagagatctgatttcaccaccaggattcacttgtgaattactccaatttgtaaataatggggacaacgaactgtttttttaaaaaaaaaaattaaaaaacaagaagtcctcttggtggcatatcttctttctgataagaaattgacctgacatgttgttgatgtttccagagctccagcatctgaagaacagcctgcctgatcaggtggtcgtccagcgcatcgaggagcgcctctccgccctgggcaattgcgttgcctgcaacgaccatgtcgccctcacacacccagacctggaccaggcaagtcatctctttggaaaatctactccaaaatcacagagttgagcatataggagcaattagcaaacaatgccacagcttaagcccatctgaccaaactacattgcctgtaaacagggaaccgaggagatcatctcagatgttcttggtgtggaggtgttcaggcaaaccattgcaggaaacatcctggtggggagtttctgcgccttttccaataaagggggccttgtaagtttctatcacaattaaactaatcaacatcactaatcactggagtactagttattaggccatggcactggagcttgcagttctctgaaacctgtgaatgatgcaggttcacccgcagacgtcggtggaggaccaggcggagctgtcgacgctgctggaggtgccactggccgccgggtccatcaaccggggcagcgaggtggtggccgccggcatggcggtgaacgactgggcggcgttctgcggcgccgacacgacggcgacggagctgtccgtggtggagagcgtgttccggctgagggacggacggccgggggcgctcggcgccgacatgagcaggtcgctcgtcgtcagcagctacctatagagagaggaggagggaccggtttttgctttgggggattttcggtcagaattcaagaatgcttaaagccaaaaatatcccttgctgtatcttgagtagtgacagtaaatgttcgcgtggatcgatgcagttttgatcctgtgtcaaagatgaattttgtatctttgcaaatctggaacgatggaagtgcttttttgaagtcaaaatataatttagtattatgctcagctcaggaaagaatgttgtcttaaaccagaatattaaacaaagtgaaggtagccaacatatgtcagatcacagtgcagcaaagagtattttctctatcagtaaagacttgttggtagagtacaacacagtgcaacgcaaacaaacataagttcatagggcaaaatcgttaagaatgcctaaagaaaacataatgtatcattagctgaaggactagcaagcactggcaaaactgacatttgtttgctaacaagtcaagagacagttgacacgcataaaatgtgaccaaagtaactcttcattcgtagcacgtcaatgaagcagacaaaataaaactaagattaacattcataagattccaatcctactcgcctgctcggtaaggcaatagccgcaaaaggttatccaagtgcaagcaaacactactagttcattacatcgctaaggcattattatctcatcgtcatatatattttggcaggacataagcagcacatgtattggatggccacaaaataaacctaacagaagaacctaatcgagcaattcagacattgcgttcttcctgttgaacggatcggtagcagcaagcaaagatgccacagccctattggggaaaatgtcatcagccttcatcctctccttgaatccataaggtggggtctttgcattcagatatgcctcaagaagcagctgatactgtctaatcctcccagtataacccatctgccgcaccttgctgaacaatttctctgcattatggacgtctcctttcttggaataactatcaagcagcatcaagtatgtggtgtacaaaggcttaatcttgttcttatatgatagcttatgcaatatggaatcagctttctccacctctcctgcatccgaatagagcttcacaagtgaatccaatgttgagggccctagtctgcaaccatcatcacccatccgctttgctagctctttccccttgtcaaaaagctttttgttggcatacaccttcagcatagcattgtagtattcgaacgagagtgtcttccatgtcttgaacatattctcaaatatctcctcggccttttcaacatctccaagcttaccaaaagcctctatagcagacatgcactcatctagacgagcattgacctcacaaaccttccagatcctttccacatcagcttttttgccaagaaaagcatacaggggtaaaacaaatttgcaagcagaacggttttcattgatatcatccccctctatttgctccaaaattgcctcagctttctcacgataaccaccaaatatgtagtgccttgcaattgtggcttgaatcagaagatctggttcaattccatctgcttgcattgcctgaatgaccttctccatatcttcaatatctctagcagcacccttggtgtctacaaggagcttataagtgaagagggaaggcttcacattctccttttccatcattgtgagaacatcaccaagcttcttcttgtccactctcttgtagagtagcagaagctgattgcaagaaaatacggtaactggaaatccaaggtccttcatcttattgaagacttgttctgtttttttcacattggctatagccacacagttagccaaaagagtcctgtatacaacctcacccctatgagatgcaggaacattctcaatatacttttcagctttgtaaataccgtggactttagctaccaaatccacacgtgaagcataatcacgttctccaagatcaaatagtttggattcttcaacatactccagaagctgcagaaaatgaagtaaatatcttctgagttagaaaacacaaagaccgaggtaaataattacagtgaaagagcacctttcggtctcaggctaacctagattacaaagcttaagtgttttagatatgaggttgttcacatgaaaaaagtttatgtatcaagttccatcaaagtaaacaccgtgtacagctacaaataatcaaagaatagtgaaattttgaaaattggtaacatgcatcggtacaaatgcattcggaaggaaggtggctttgttattatctaagacagctatagctgcatgactaagatctattagatagctacattggtccactaagttaccaataagaatttgttttgtacataagagtatagacagttgacacaattttgctagtaatttacaaagaacggtagcattcatttcatcatgacacgatagattgcacataaaaagaaacaagtatggctatgctatttcaaacatcatgtataaccaaacatgagtattacaacgaaagatttaaaagcacagatggcacaatatgtatgttaaggggtaaacatgcttggaatgcataacagtaaaataaaatggtggtcaataaaagctgcagcataaagaagagagaatcaaagaaatggagtaatactcaaaacgtgcatggaatgaacagaaaaagacaacgccctttgacaaacaaaaccaacacaagcactctaacaaatttcagagtctgatactatagaaaagaagaagcagtttgcacaccattcacatgatctgcaaagtaacaataacattctcatactaaattaagtttaggatgtaacatagaagtacaggtggtgaactggtgatatctcaacaacattgtatttttcaacagtcaaggaaattatgtgtgcttcttatatccctctagctgtctagcatcattcccatagtaagagactaagagtacttcatcacttcttctttttttaatactctaggacttcaagaagaagcatatagacatatcattctaaagtgcccctacctcatctagtgcatgctacattttacaaggctatagctcttcatttatgtgcaaaaccaaaagctcattcaccattgacatcgcaaatatgtttcagaaagtaacattcttaacacatgccaagctaacgagcataacagccgctacatgcattatcgataattataaatgtgcagaaaggacataacgtttgctatcatggaaaaaactaaaacatgtaaaggccaagttaaacacctgcaaggctttggtgtagagcttccgcttccgaagactaagaaggacataaaagagttcacttctttccaatgtattgccatcattaagccattttttcgttgctccagcgacatcaacccttggagataccagcaaagccttaagaagagtggattgtgacttctttatcggctcctcaggttttgcatcagcctccacttgagacaagccaattgcatcaatggtgtcctcatcagaactctcatcggatgtcaaatctaaatcctttttatcagcttctggtggaacctccagatcagaaaacccttcctccaactcatcctgcttatcaccagaacttgcaccggcctgagaagagaaaaccctactccacatgaaacggcctgatgagaatgatgattggcagaccaatggttttggttgatgacagcaatccaatttctgacagtcccgctcatgatgctcttctacattctttgcatctgcatttagaattacttcaaggtttgcacaaccacgggcactcaaagcttggtaggcacggaccctaaagcagcagcaaacagttagccaagccaaatatcagtattaacaatgcatgaaacatgggatgataggtacaagttatgatcctggacatggattcacatgcaaacgaaatacaaaatatctgcttcatttcacaataacatgaccagatgattgaaacaagcagaggtgttgttccatcttccaacatatctactatcgttcgtacataatgttacacaaagtaataatcatgtctacatagacaaacatctaagatcggttacttcttcaagcacatctacacacagtagatacacagtcatgtctctcacatacatccaactgatatatttcagtcaaacccaagatgataagactgcaatttgcatagaaattcaatagattacaacaaaacagagtcccaacctcaggtggataatacaaacaactccctactccccaactgaaaaaataataaatcactagcaatgatcaactttctccccaagcaacgcctatggccattaattacaagaaaccgtgtcctgttaacgggggacgccacacattttggcaccgaggaaatcacacaaataaaccccccaagaactaactaaacaaggcatggatggatctacttgtcgccaccacgcccccaacagggacagaaaataagagtgggagaaaggcacggataaagaacaagataagccacagatttattatatcatcaatcatctgtcaacgaaatcccacatgaacagcggcagaggggggggggagagacaggggaggcgcgggcggcggtacctgagggggttgcccgcgcggcggagcgcccacatggcggcggcggaggagacggcggggtcgtggcgatggagggattccgcgatggagaggggaagagagagagagagaggggcagaggcggctaaaaccccagggggagggggaggcggctaaaaccccaggcggcgacgcgaatggaggggcgcggcgggtgaggtgaggtggtggtttcctgttccgggctttgtgggttgtggctggcctgggccttttagatatttcttttttttcttcttccgtgacggtggctgcggttacgcggggaagtgcacacaaggaattaatggtaatatattgcgcggcgactggcgtgttaaaaagttgggttttagggcattctctaaagggggaataatcatttttctgaagatttatctcttcaagttggtctctctctttttttttttgataaaggaagtagttttatcatttgcattgttttttttaaggatttgtacagcttagagaaattggacattctgccactgccaagagtgggcttcgccacaaatggcatcggtaaaatgccacttccaaccgatgacaaaccgttgctttgccatattcaccatttcaaaagattttcaccattttccacacttcaactgaccaaaataaccctctctccgatgaacatgtgggagttgtgggcgaggagaaggagaaggggcggcgctgttccggacgccgtcgccggcgagagaaggacgaggcggtgaccgtcgccggtgaccgtcccgggggcgcggcgggcgcgctgctttgtggcggaagaagcctgcggctcgcgtagctggcgacgaaccacgccgcgagcagcgggaacatggcgccagcggcgaaggacagcgtcgacgcagccgtagcctgggaggatggtgacaccgccgccgcttgcagtcgcaagccagccggagccgacgccggagccgggccgcgtgctcgatttcggccagctagacatcgagctgcgcgtggccggcgacgaggccggttagcccggacaggaggacggcttgccgatggccaggcgacggcgacgaggccggccagcccggacaggaggacggcatgctcgtcggcggggcacgccgcgccgatgccgagcatgagcgacgcagtggagacaagatcgtcgctagcgcctagcaccgcggcgcgcagccactggaagtgcatgccaccgccgtcgtgggtggcttcctcttcctccttggcctctgccacggttagctcggtgtcgccactggcaaccaccactcagatcgaagggcattttgggtgaaaaattaggtgaaaatggagtgaaatggtccaaatagcaaaacaaatgtaagcccagttttggcagtggcattttaacgacgccattccgcggaatggcattgtggcgaatcccactcttggcagtggcgtaatatccaatttctcgctagggagtaaagaaaacagataaaagtactactccctccgtaaaaaaaaaaactcaacataggcaaagaatgtgacacatcctagtacaataaatctatttacatcggacgatggagagagaggaggcttcctgaagcgaccagcgagtcggaaaaaaaaaactttctcccccaacctctcttccccgggtttccggcggctcgtcgccagcgacgatgggaggaggggtcagatcgcatcccttaaggtgtctagtgtaggtttctggttgggttttcccgtagtttaggtcgagtcattctcgttctattccttcttcctctccagcgctagatctatggtgatgtgaccatggctactatagatacaaccgtcgttcacatcaagatcaagccgtccaagttctgcaatccagttcggctacctgctacagtgtggacttcaaacggccgccaaatatgcatgcaagctccattttggatccatgattacttgatggaaagctctcagagtcatctttccaatgatctagcttcatcgccaaattccaacccagtcggccaaaatcacaaaaaaaaggtgttgcgtcacctataatgggcctatgggcctgtaacttctctgggaccccggcccaagtggggcccatgtggggtgcgccccaaccaggtggagcacgaccctagggtccccttaggtcgtcctcccacctccttaaatagttaggtacccctttagagtttcttgggttttgatagattaaagtttagccagtgctacttgcttgcagcgcacgtgtcggctagatcgtccgtctgcttgctcttcggaaccccaacttatcttgtgtattcattcctatttgctattcagattgctttttcttgttctgggcttgtttcttcgatttgcttgcaggaataaggttatttcgcaccggcaagatcaacaacccaggagagttgtattgaacgctaaggcgcaacagaacgtcttgtacggttgtagtcggatcgttaacgtttctcccaaatcatagttatcacaactcaccgaaagatcgggccaacaacagccttgagtgtcgagaggaactcagggttcatcaggtggtatcagagctttcattactcggtgagtttttatcttcctataaccagaaaatagccatacaaaaaaaatccgtatcatttacctagccatattgtgccattgcattgtttttttcagtttttgctttgttgaattttgtgttgcatcgtctcgtcgtgttgctggtcttagcgtctagttcgtttagagtttcgagttctggtcatgttttataccagagtcgtcgtcgcctctgtgtctctgttatcgtcgggacctacgaaaacggaatcggcttgctgccacgattctatttttgtagttttcaaaagtttctatcggttggatttggagttgttgagttgcatcttgggtttgctgattgccgtgcttctgttttggccgtgcctgtgtcgtgcacgagaggaggaaagtgaattaccaatctgattttggaagtagtcaagtttgttttggaaagatatagtagattggattggttaaaaatcagtttcatttttatcccatacaccaaatcctaattatcggctaccatccactccacctcctggccgactcccactcgtccctttggccgagtccgactccctccctccctttcacggttccaagttgtgtcaaacaccttggtgaatttttgtttggtatcggttttgagatctgtttggaaaaacggaaccggcataaattcagcattccatttttgtataatttgaattttgggtttagacttttacatttgagtccctgtaaattttatatttacgtttgagtccttgtaaccttacattaaggtccttgagtcagtttttgttaaaaaaaatcaagaaaaaagtgagaaaaaaaggcagaaaggtgcataaaaaaataaaagaaaaaaaaactgcaccaaaaaaaacagaaaaggaaaggaaagaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcggtctctagtacgttctagcctaggaccagcacggtacttgactttgaaccattattcaactttacattctctgatttgagcatttgctatccctttgctacatatttaagcctacccagagctccacagatatgattgcagccgtacagcaagtgtttcccaaggcatcgatacatccaatctccattggggtgcttggttaagtcggtgtacatcaccattccgcttgctttggtaagaacttgtaagagcttcgttaaaagcttgagtgtgtgtgatatttgagctgccactacctagtagttgataggagcgtgcatatttttgtgtgtttcttgtttgcttctaaccatggcaggattgcgtaagggaatacgagaacatcgacttctacaccttcgacgagatatgacgacttctccacgtgatgcatatgaggtacatgactataattttgaacaagttgcatctaagttaccattctatgatggaaagtattgattctgttgcatacattgattgggagctagcagtagacaatgaatttgatatatatgatttttctgatgctcaaatgattaaggctgctagtaataagtttacctcttctgcattattttggtggacttatgttagtaataaacctgaaacttaggatgaattgaaaaccatgatgagaaaacgctttgtgacttcttattacaaatgtactctttgggagaaattagaacatctgaaacaaggtgatagaactgttagggagtacattcatgaatttaaggtctgtatcatctacagtggtctcaaagagtgcaatgaaaatacaatgcgtagatttttcaatgggcttaattctgaaattcaggttttgcttgataatgtgacatataattatattgggcacctattcatgcttgctcgtagcattgagagttagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagatcagcacatccaagaaaaggagaatggtatacttgagaagaaagaggatgaagcacctacgatgtctgaagaaagttcgcaaggtaaattaaatggtgctgagagaaatgaaggtgagtattctcaaggtgagctatacttgtccacttttcatgctatagtagagcaaccattagtggaatcaattgctgagttgcctttgtcacaaattgatttacttgctgttccttgtgataaagaagagttgtgcgataatgcttcacttatatccatgccacaactagtgaatgaacatgctgttcctgttgttaatactaact

SEQ ID NO: 79265 - DNA, 5630 bp, Oryza sativa
ttcatttctgttaatcatttaactccttactgatttgtgatatttgagttgaattgtagcctcataggccctggcagatgataaatatttcaattgcataagatttgcagtagttgagaatgggtttatgatgattttggctaaactgaaatttaactgcaactatggttaaattctgttgcaaatatggcagactttctataccttttcagtttcatgtgtggtatgatctatggatctccttattcaagaggatactgatttacttgaatttggtatgagatgttacttggagttttcggttagggtgacagctgagttccaccatctctgattcaaactttttgttgtgcttttaatgttataagaataaaattggctgagttccactcaactccgagcccaattatttgttcttaaactgtatcttctgggaaccttatctcccattgcagactaaagatttgtattttttttcttttgctgttattctgactggaaccattgcagctttatgtggaaactatgtcaattttggtgtatttgagctgtatggtgacagagcacttgctgatgcccttgatatatctttaaagatgagcctctcagttccattgtctgacatattggcattcaaaaaggtattccttgcaactttagtgatttactattgttttgctgtgtagtgctattgcttttattaatatggttattaagatctcaaatatattcattctaagttttatagcattgaagatgtaaagttctcattatatcgcaatgaaagtgaattgaatgttatgtatatcaattaagcagaggtaattacttgtgcctcaggaactggactgagtgattttagtgccaatcttctaatctaactgagaaccctgcatttacgcacttggtccagttagacaacgctgttatgacagaatatacaaattgatcagatcctagtatcttagcctgtctagaaagatttgtatattctgtcataacagcgctgtcatttttttatttgaaaatatacacagtaaaattaccaggagaaaacatgaaatgagtaccgccaacagtgggctccagagttctatcaggaaactttttctttggaacatgggatgctgctgttattttttatttttatgccagacattttcaaacatttttttaagagcattctccaacccctagaactgtactccagttgtgtttgaactttgcatattttttttcaacattttgtttgtagtctccttggcattttaccagcaggtaccctgcatgcgagcttagtttatttatttaggtgatctcctggcaatttttgcccactggtaacatgcgtacaggtttagtgctatgttttccaacaattgtgcttttactggcttgatcatagacaaataaacagcctagacaccattccaggtcttgcattgtcccacattgatttatggttaaccagatgattgagatattcttgtttcatccgtggaagcattcatactaggctctttctttatttcagctgtcaaaagcattctatggatatattgaagttctgttcagcagccatatcacttttgttctcaatttggatacaaacaccttcgtgcatattgtcagcactcttgaatctggcttaaaaggtctagatacagggatatcaacacaggtatacgacatgatgctttttactgcttgtaaaatgttccccgcttcttgttacaacagcatcggtgaatcactgcttaaactgtgtcctatcggggaagacatacttccaatctgtggttgctggtagataataattgatgccatcataatactctattctcttttatgtggtttcccttttagtttcttctcttggatctggatgtcatgtgcaacctggttagggcccacatagaagcagcagtcaacctctctaggcctgcagtactgtgcacatgaatagtaatgggaacaacatctgcctatggttactgtttaatcatttccatgttcttcgatacggggtatatcgtaaaggtttgggttgtagaggtttattaaggaagcaatacacacaagcttttagtctcttttttatctccttcccttatgcagctacctcagcactgcttggttcattaagcctaagggcccttaactatgttcatcacattggaatccatcattgttctttagtgctttctgtttggactaatctgtaaattgttgcttccttttggcagtgtgcctctgccattgatagcttggcggccttttatttcaacaatatcacagctgctgatggccctccttcaccagctgcactaaatcttgctcggcatattggagagttccccactttatttcctcaggtttgtgttaataatcttctctaccatatgcagaaaggtctggatgtaattacattttgttttttttctgtgacagatactgaagacgctttttgagatcatcatctttgaggatgcgggtaatcaatggagtcttagtaggccaatactgagtctgataatgatcagtgaacaggtgcttgtctttttaaaacttttaaatcatgttccttagcatttcttttgcactcttttttccagtttgtattgtctttgttttttttctttttttttttgcgagggtctttagatcttttctaatcagttgtttttctttgtgcagatgtttagtaatttgagagcacagatattagcatcacaggtcagtgaactctctggtctgatattccactatgcagtcctgtctttctagttttatttttgggttaattggatccatgccactgcaaatatgccaatttgaaaaaatgtcactactattcagcattcggctatgtgccactgaaaattggagaaactggaaccgttcacattttccgtcaaaaatccctgttagcccccaactgcacgtgggccccatctccctcccctctcttctctttccccttctctctccaccaccgtagatgcggtaggtgttgtcgccatcgtctcggagccggaagatttgcgattcaccctcaccgatctcgcgacgatgggtgatgtggccgcaccagctgcggcggcgcgggcggcgaggccgacgagcccgttgcgcccgcccaaggcgatccgcagcaccaagccaaggggctcgacgaggagaccgtcatggcaccattcgtcaagcaccttgtctcggagccggcctgctgggatgcgcctgcgtcgtcgtcgtcgttgtcgagcgcctcgtctcggagccggcgagccagactgcgcctgcatcgtcgtcgtctgctcccccggcaaggtccccggccaccgcccccgtgccggtcgtcaccccgcccaccgccgcatcgctgtggccaaccctcgctgccaccgccaccgacctcctcccggagcgctcgctttcatctccttcccccgtgccgctcgtccctccgcacttcaccatcggctccccggctgccgattcccctcagccgtcgccctcctgggctcgccggcgtccatggcggagaagctccccggctgctaattccctcgacgacggcggtgagggtgctgcgtccgccggcaaggacgacgaggaacggacgggtcgcggcggctgctggtggagcagcgagagatggagggggggggggatcactggctagctgcagtggcaaggaccagcgagttcgaggtggagtgctcgccggtgtccatggtggagaagtgaagaaaggaagagggagagagatgacggaggttgacagaaaactggatggaagtggcatggttccaatttccccaaattctagtggcacgtagccgatatgctcaatagtagtggcattttttcgaattggcatatttgcagtggcatggatccaattaacccttttttttcctctgcttgaagctttctagtgtcaagttatcaacaatgtttccagtcatcagcgtgcaggtgttaggagacaagtttcttttcagtaaaaatattaaattctactagtacatcttttgattagaactgtatgtccagcttgtgatgtacctaagttttgttaacatatgtctgccaataacagcattagtaatcattattgaagaactaatgtacgtcttgtttgcagcctgtagaccagcaacaacgcctttcgcaatgcttcgagaagctgatgtctgatgttgctaggaacttggaaccaaagaacagagataaattcactaaaaatcttacaacattcaggcatgatttccgtgtgaagaacattcaggcatgacagctgttcaggaccagctaccagctttaaggtggtgcactcatgtgctgtaaatactttagcttagcttcgttttaggaaccaccattcccgtggggggaaagttatggtttaactcagtttggtttggattggctgaaagatgaagggttctcctgctgcacgtggtggcaaaatgcagttgttgatctcttaccttgtcgtgtactagactggcgagtgcaggagattcttcttcttcttcttcttcttcttcttcttcttcttcttcttcttcttcttcttcttcttcttctttttataccttagtgttaattccatctctttttgcttgtacagcaatattcatgtgtaagcctgtgatcgctgtttccctaagttgttagggcgaaagcagccatcgctcaaaatataattcatttgttaacaggttagaagaatagaaaaaaagttgtaaatggttgtgcttcctgttgctgtcaatgctcaaattggaagtgaggagacggtaaatttgctccttgagcttcaatacaggtttttattcagctaacgtctttttttgcggctctccatatttcggttcattatagccccggactaatgttgtgtacagcatttttcttttggaggtgctgtccagagttttggagctcgacggcgccttttgcctatggacctatggaaggcagttcttcagtcttgcccacggtatttgttgattaatcttgttctttagtcttcttcagagttcagattgtttagattgtctgattttccacttgctcttaagatgtattataggttaatatagctagttgggtttctgttctggtttccttggtttgacactattcaggttactattcttgattggtttcaaacttcccatatttcctgtaaaattcggtaccttacaacaagtatgaaagtacaaactattcatataaagtacgtcttaataattaattaaaataaaagcacagaatttttccagcactattgcttagctcactctttacatataattccatttaagaaaataccttctcaatactgcacttgtacaggaagaaccagtaaaaatctaaaacaagtaaacatctgaacaatggataaattggggattttaacgtctttgtgagtgtcactgtattggcacatcactccccagtttacgctctcactacaggccctatttagttcccacacaaaaattttatactctgtcacatcgaaccacatcgaacgtttgaatacccgtataaagtattaaatataggctaaaaaataactaatttgcatagattgcgactaatttgcgagatga

SEQ ID NO: 79266 - DNA, 20889 bp, Oryza sativa
  unsure (1)..(20889): unsure at all n locations
cacacatgtgaggatttgtgcgggaaacgcacatgtgaggatttaggtcctcaaagtctacatttgcgtgtgttgaacgcgcacgtgtgtgtgtgtgcatgtagtgttgcgttgtgtgagtgtggagtgagttcgtgtgtgcatcctcgttgtactctctcaaaaaaaaatagttcatagatttgtagatgcgcttagggctgtaagtgggtcagccgcgaatccacttatagttcaaaataagcgggttcgcggtttattttagcctataagtgggtttcgcgggttagccacttacacccctagacgcgctctccactcgtcttgttacccgaccgcctcgcaatgctagcttaatgattttgccccgctttggcaagatattatgaccacatgttcttctttgttattcgtgagtgagttgctgcaatctattgtgatatgttttttccttttagctaggaaagcaacgctttcccatttctatatatcagaaatgacaactgtagcagatcctgacaaaaaaacaaactactactgaaaggctacttcctttacaccgagcttcacacgggggtaggaagtccttcaaggacatactacaacacgatagtcaaatcataataatacactcgacagatacaattctcaaaatagaagtagggtattacttttcatcgagaaggtttgaatctgtctaaactctaaaatcttgttcccatcaatccatctactctacgtgctcatgtgttgctcctttattattgctgatataaaacatcgacatctacaatctccaacttgtccttgatactagagctatcgtcacagtatatccaataggtgacagctctacgttgagaatggccggccgtgcagccgcgccggagcatctcgatccatgtctgtcttgcgatgatgccactgtgatttgcgttgccggtgtagtcacgctcatgcagctgtgtgttgctccccaccgtcatctgcctcactccaccgtagaagcctctaagcacacaccactggctattagtgcagatacaatagtagactataaaccagctattaacacatttttaagaagataaaataggagagagaaaagcagtgggctatggatttatagccagctatagcaccgattataagatgcatgtgtgtatgacaggtgggaccaactatgaattatatagtatacgttcatagataactattgtatgaaccggctattaaattgactatagatgatttagagctgatagttggctatactattaaacttgctcttagtgccagccgccacaccaactcaatcgtctcgttcgtcggaagtcgatttgtctattcccttatagttaacgacattaagtgtactactgaaagatgaattctctcgatattgcggttggacaggtgtaatacgagggacaaagtccttcctataagcctaggacggaagacgtcctagtacaaaattttcgttcgttccaactgttggaaatcgcctaatggttatgacctattgtcggaaactgtcggagcaagttagtgatgccccactagttgggcccatggttttgagaagataaatagttggggaatgcctgtttaagagaataatatccttgtctctataacattgttaggcataaacatgcaactatttcagaaattttccaaatcagtcctctaagcttttcttggcgcagggaccttactggctctaagttagtggcgtggaatcaccttctctcacgcatcgctaatattatattatctcacgaccaagatgagtttaaatggaatctaaccactgatgacagattctcggttaaatctctttatcttgcgttggtgcagaccgatgttcccaatataaacaaaagaatctggaagattaaagccccccctaaagattaagatcttcttatgatacttacgttgtggagtagtcttaacaaaagataatcttattaaaagaaattggagaggaaacaagtcttgttatttctgccacaaagatgaaactattaatcatttgttctttgattgtcgttttgcccgcgcagtttggtctttaatccagtttgcttcgaatattagtttacctaataatacaactcatatgtttgggcattggataagaagacaaccacacaatttgagatctttggtcttattaggggcaactaccactatttggtctatttggttttgcagaaatgatgtggtttttgaaaggaaaaacatatcttctcctttgcaggttatctttttgattacacattggctccggtcatgggctatctttcagaaggtcaatttgtggggtactatcattgcggcttgttaacaattggagctagtggccatggagttttctaccccggcggatgggtggtgttctaggctacggttagagggcgcctgaagttctttttgtccctgctattgggatgatgagtttatcttttgtttctttcttgttggctgtgtgcattctttgggtgcagaagccggaggtgctctcagaataattgtatcacttgatagagttttactgagattaataaaacttccattatctaaaaaaaggttgggcccatggtgtttcgaacttggttccggtctatgtggaggttagtgtacaattttactcatctatatatcctactccctccatcccataatataagacagtcaaactcgacacgatttctaaaactaatcttttttcttataatttctcatattctataaggtttgtagcaataccatatgaaaaataaaattcaatgtcaatccaatgatattattttcaacaaataaaattcaatgcatattatactaattgttggtcaagtgttgcaagagctggatctaaaaaaacgtgcacatcttatactccctccatcccgattttgagtttttgcttgcactgtttgaccactcgtcttattcaaaaaaatttgaaattattatttattttttttgacttactttattatccaaagtactttaggcataactttttgtttttatatttgcacaaattttttgaataagacgagtggtcaaacagtgtaagtaaaaactcaaaatcccttatattatgggacgaagagagtattattggatggatggagtatatagttgctatatagttacaaccaataacttcataagtattgagccacatcatttagaaagaagagccattacatcatttccattcttaatcacaaccattcattttgtagctactattccacattaattagttagtatataaattagcattgagtgattcacttagtgtaaaatgttattgccataaagaagttacaccatcaccatctttgacaccattggataacacctttatagttcatatcagcatatatataatctttctcatatctatattttgaaattttgcagttgtattgcacacgccaatatctcgttgcaccatctgcatttcatttcaatgttgcgccatctaaatgcattgacgaatcatttctcagtctccaacatcgtctatcactttttgtttgctgaagtgtgttcctttgttgtgctttcatcgttggatgcatcagattcctttcttttacgtgttgccacttgccagctgaacgtgcaaatcagaaggtgatggcttgtcgcagggcctagcttcttgtttatggttgtgctcgtataagtatgttaccaaccatgtgttgggatcatcgttgttaggctcaacaatcttccttgccacgcaccccgtggactgcttctggttgcatctgtaccatgatctgaaatgttgccgtaaaatccagcttaactattgagtcttataacgtgaccatagaattctttgctagatgacatgcttataagatacaactctttgtttatctaataattattttattataaattaatttaataattttatttgatgaaaacactatcattagattaacatttgggtttacttttatatgatgatttgttgctataaacattatagaatataagaaatttaaagtcaaagattagttttagagggattgtgccaagtttgaccacgtcttattcagtgggctggagggagtataacatcaaccttatcaaaattttgtaacacattttggagataccaaattttggtaatattgtaggtgtttagtttgacgccattccataatttggtactacctctgtttcatattaagttgttttgacttttttctaaataaaatttcttcaggtttgagcaagtttttttttaaaaaatatagtaatatttttaacacaaaacaaagaaactataaaaaaaatatgttcaatgctagatgtaatgaaactaatttgatgctataaatgtttctatttttgtttataaacttggttaaactttcaataagtttgactttaaaaaatcaaaacgacttataatatgaaacgaagggagtagtgtttttttaagagtaaacttatgaaaatactaaagtttggtatgattgtattggtgagatcatgtttagtttgtatcataccagattttggtgagttgaaaatggcaataaagtgaacaagtatctgatcacaaaagcatgtttgttaggatgtgggcagttaacccaagttaacttttatcataatcctgttcagaacatagaataagaaaatgatgtaccatagctttattttacgcaaaataattaagttgttaagttatgtcttgctaaattttgaaagtccaaaaaaaactctcctttctgactgggcagtacatatacatttagagatatatgcatgttctcaccttttgtacttggagccaagtaaatccttttcactatactttctccaattccagccatcatctgtcgtagtcttcttaaggagatattttactgtgtatttgtccctgtatattaggaaaattaaaacaaagaacaataagaatccatatgcatcttttataggcacaattacaaataacaataagaatccatatgcatcttttatgccccaaacatggatggtacttgtagattcgccccagggttgattgcaattgtaaaaatgatgtgtcatgtatatctttctactccctccatcccaaaatataagaatctagtactgaatgtgacgtttcctagtataacgtatccaaacagactctctgtctagatacattatactagaaaatgtcctatttagttctagattcttatattttggaacagatatatagtattttgcaccaagaccaagggacacttttacggtacccttctattgcctctggcagtaggatagtaggaagtaaatgtaaccattgattgattaaggtagtaagggggtgtttggcagagaggggctaaacggagggacttatgttttcgacagagtgccttaacatcagtcccttgggagagacttatgtttttgagagtggggctaaaatttagccccactttagtccctccaaccaaacaccacataacaagggtattttcgataactatttcatttgaaaattagaaactctcgtcattatttttgccttgccctttgaccgatgttcgcgcgctgtggcttctcggattgggtgatgcgacgtcgggatgtcatcccgcacggcagtgatatgccaccggcgttcgccccgatggctcgtcctctcatgtgcaggcagataattacaaacatggaatgcaagcaaacaccagaaccaaacctgctattgttaattggaagccctaacatgtagtattgttcaatcctttatatgttgaatcgaaatcatcaactatgtagaagtatcaattatcaaatcacggattaaaaatagtcaacagaaaaactacgacaatgcttccttctgagcaaccgattccaactagaaaaatcggacgcccgcagcacatacagatttttgtccccccaccctctccttttagttgcacatgtcatcacatcaatagtcaacatgcatacaacacatccccccacctctctcgtcaatctcactcttcgtaatttaacttaatagcaaagctttaaatattttttttatctaaactatgtatctgatatatgatccgattataccgttgtattcattgcaattaaatcttcgtaataagatctcatgattatattttgataaaaaaatatttttaaggtttttttgttctaatgctttttctaaatattgcaataagtagtttactatgtttcactaggtcatttagaatgttgcgtgtagtgctatttgattgtttcagcagttattttgtgatgatttaaatgatgtttcattaggtcatttggagtgttgcatgcagtgctctttgaatatttcagtaggtatatgtgtgatgttacaacaaatattttgttatgtttcagttgttattgtgtgatgtttcaacagttataactgttaaatttatttgcaataaaaatataatcatgtgatatttgtttaaagatttaatcacgacgaatttaacggtgcaatcaattcgcaaattggataactaatttgtgataaaaaatgatttacatattgaccgtcagtcatcagatgaaaacaaatgaatggttaatattcattatagggcactgtaaaattcccaatttacaagtaccatccaactttatggcacgtgagcaagtgtccataatgttcaggcttgtatgttcatattttgcatggagcgaataaaaattactgacaatttttttctggtctcatcattttgttactaggctacccttgataagtcgaccaaatatttatactgaatttaaaatatgcaaaattatatttctttacctttgaagcttttcccacatgagacagctttccagtgaactgcttccaaaacgaagtttggggcacctgacaacttttaaatttgaaatagacaacaaaggatcatctactgataataactcttttcaatcactgatttccagtttctgtaacattggcatttcaggacagaatctgacagacttgagcttctggaagctttcaatcttcagtgactttagtgatggcaattctgagtaagctggaagttgatcaccacagtgaaatgacaaatataatagcgaaatcagtggcggcaaattagttagttttgggcatctgctaatacagagatgggaaagtcgtgggaaatccccattgtttgttccattccagaattgcagagagtacatctcccacagattcagtatctccagtgatgggaatataggggcatgttttccttcagtagtcaaagggttacttctttgtccaaagctttctacagcatacattttatgtatgaggagatatttaagaaaaggcaggtcaccaagatgtgggatctcattacagtcttggcagtcatcgatagtaatcgagacaagcatggaaagtgaagaatcctgaatccagttggggaataaattcccagaataatttcgaatggagagctcctgcaggttagtgtttggctgaagattatgaaggacctgattagcaatttctttgtcactgtcatcttccatgtcctgactgctccaacaccattccagtgtcaaagctcctaggaattgcttacctactagatttgcttctttggcatcatcacttgcagtaatattctgaagacctgttatatgaacatgtccccttagtccactgagattcttcaggtccccaattgaacaatgtgataaatcatcccccgtattaaatactgttaatgtttgcagatcagttagttgcccgatcccatgaggcatgctaacatgaacatttcctggttccttttggacatcaaggtgccgcagctttgtcaaattcattgtgctttccggtaactcaatgagacagcaacaatacttgagttctaatgtctgaagggtttgtaactgacctatttcagctgggagactttggatctttgtattgttcagagccaagaattgcaagtgtttcatcttcataatagaactggggagctctcgtattgttgtacagctcaaattcaacgctcttaaaaatctacatttcatgagaagatcattcagacccagtattttcaaaagtggcacaaatgaacctgggtactctgatgcagatctcttgacaaccatcagggactgcagatgtctttgtactttagtcagcacaactgacttggaatctggaagaacaactgaaaggtggcaaatattttctggaaggctgcaaaatgcttcccctgaactgaagcattcatcctttgagacggagcacgccaaatcatgaaataactcatgcataacaaacttatccttatgatcatcatcgcgagagggaccgttttgaaaaaatgatctgcagaacaactcattaaaatactgcagaccagtgtcttctggttgactgtcttcttcagggttgataaaaccttgagaaatccataactggacgaggtgatgcttgacaaaaacatagtttcttggaaataaggaacaaaatttgatgcactgtttcagacgtgatggcaaaagatcataacaaagtcttagtgctggtaagataccaccaccaacaccaagggaattgatttcaaacaaaagggaactgatttcaaacaaaccagtttctgaatgacataataacctagagctaattccctaattgataaatgcaattaataattggaattggcattgtgggatttttcttgggttccacatgtcacaattgattaataggatttttagtggaattttcagagccctataaataattttaacccatcaaaattcataaaccgcaatatttaaatcctagggaaattcctttttccttttctttttctttcccttctttttctttgttgggccgtcggcccaacctccctcccgcgcgccctctttgttgggccggcccgctcctcccttccccttcccgaagtcctccctccctccctctctccttcgggcgccgacaggtggggcccacctgtcggtcgtctcccacctccagccgttggagctggggctccaaccgccgccgccgaaaccgccgctcccacgtcgccgtccgcgtcgaccgcgcccactccacgtacacgcgccgcgcccacgtcgtcgcccgccgctcctccgcctttcccgctcgcgcgcgcgcccgcaaatcggcgggattcgatttgaatctcgtcccctctctctctctccactctcccacgtctccggccaaataggggccatcaccggccgtttccgcccctcccgtgtcctataaatcactcccccgagtcccctctccctttttccgcgctcgccgctctctcccgtgcctcatatcgtcgtcgcgctgctctcccgagctccgccgctcgccgccgtatttcagccgcgcaccgccgccgctagagccgttgctgcgcctagccgccgccgccgctagcttcgtcgtcacgtgggtcatctcgaccaccgcctcgcgttgccggaatcccaccggaaccctatctccctcgcgagcaggtgagatatccatccccctccgtctccggtcaacaatggtggccgccgtggtcacttaccccacccctaacccatctctgctccctcctagggtgccaccgccgcccgtccgcgcctccgcatcgccggttgtcgccgccgccttcttccttcgcgccggccgccgttctcgccagtgaggaatcccgctctcctccttcctttcctctttctctcccatgagcaccgctgcgatccgcgcgtgcgtcgtcgtcttcggccgtgcgccgccgctttcgcgccggttgccgccgcctcccgcggcgccgcttgccgtcgccggcggccgctcgccgccgccgctccccaaggccggccggtcggttttgtgccgagcagagccatgccaagccaccgcccgcgccgtccgatcggcctcccggccgatctggacagtcggtcccgtggaccggcggtggaccacccgcgtggtcccggtccatggtggaccagccgcctcgtgccgctgacaggcggggcccgcttgccggcgccgcgccccctcccttgatgacgtcagccctggggttttattgcgcaataattaattaaggccttttctttagtagtaaaaacacagattatcttctaaaattcatatctaattcatcggagctccgtgtaagtccattcaagtctcagtaaattcataaaaatccctagaatccattaaaaatggttttgtttcctgtttcagtagtcttatagcatgttttgcttgtgtgctttgtttgtcacatagatctcggccgtttcgtcgatccgcggtttctcgaagacgttgctgaggtctcatcagtgcgagagcaaggcaagttatgcattacaattgatcatattgtacccaatttacaaatatcccgcatttctattaaatgttgcattcttttacaatgtcatgtgggatgggtcctatcactcagccatttattgtttgccttatgccattgataacttgggtatcaaaatgattagatgttggttttggaaatgcttagccatgcttagttcaactagtacacaaatggggatcacattattacatagactttgactattagcatagctttggactagtgccaccgcaatggtgttagttaattaaaatacactgaatggtgggctatgggtgcatggttttgctggtcgcacccatggcaattaaggaccggttcacgggaaaccctgggagacttaccgtgcttaccacaagtgggagtgggtaactgcttgatctgaagtatagctcgaccctttcctaggcaccggtggcgagggtgggcatgatggagttgggtcggccggggtgtccggttgtccagttgccggattcaccacggcacaagaggggaccgcccactgcctttttaggggtgggggtgaaaccttagcatggtgtggatggttaggggagggttatgcggagggtcttgtcacgatttccccctttgcagtattatggtgatacttcggggcatgtcgacatgtgtggaatcgtatcttgtgggtacagttgtacacctctggccagagtaaaactattcgaatagccgtgcccgcggttatgggcgatcacccagattcaccgtgattagtcttacccctagtttagcttaatgaactggtgtagttcaggtggttggttgggcctgttgcaacgtggtgtagcgttggacagtgattggttaatattgattaattactacaactgttttactgctttcaacttctgcttttaaatgctagctttgtgcaaatgaacccctagcctcctttggttatatcctacatcatacctcctcttccggtaagtcttgctgagtacagtgggtagtactcagccttgctctcttttcccccacaccagagttgaagttctttccagttggagctgtatcgaagaagttgatctcatcgctgccgtcaagggatgcctgtggagtggagtcgccccgctgcagaagtcaagcgtccaagtctagctcgttttatctttccgctgcatttgtaatcttttctatttttgtaagacgtggatctatatgtcaacaactgtcgtttgtgtaccctggctggtcctggacagggatttgatgcacattcagcttagaaattctggttcgtgaatttctgggcgtgacaagttggtatcagagccgaccttgaccgtagaacaagccaactggaaacctaagagccctctgaaccccttttcatctgcatatgctctttgtacttggatttgtttcgggaaaatttggggttttgcctctttggtttgcgggaaaaatcttggtcgttcattcggatcggatctttaaaattagctcagtctagggttttagaaaaaaatatttggagtttattcgacaatcagtcgggaatctattgggtgatatgcattaggtcgtgtctatgtttgatggggcatttttatgcgcatcattttccatgcatctgttttatgcattaagttattgtttagtcagttgcattagtgtcgttatctgggttcatgaaaaatgttctatgcataaaaatcagtcatgctcggttatttatttgagtcatttgttgctttgtttaatttggatttgagcatgaattggttcctatcccttgtccatctttagatgtcagacctgttcctcgatcgcaagcgccgctccaagcttcagagtcgccgcccttagctttatcgtcttcttagtgtgtttgcttgctagtttccgtgtttaggtttgttgcttgtgggttagtcggcggtcgatatcatgtgtcagtggtatgtctgccttaattaggagttgtttgcctctttttcagtgttttaatcaagattaagataattgcacgtaaatttataagaaagattagtttctaagccccctgttttcttccttttctcatatttctacctatccccctccagatggtgaagacaaggaatggttcccgtgaatccaacaacgccagtggcagcgaagagcatatcagtggagcatgtgccagcgatgcatctgacaacagtccatctccaccgcccgagaacccaacgatcgcttaggtgttggacaatcagactcagatgatgacgatgatgatgtaacagatgcaacaacagtaccatcaggtgttgcagcaggtgcagcagcaagcacaacagcagcagcagcagaacctgcagttttgtcttccaccactccagtctaagatgttagagtttctccgtgtcaagacaccgactttctcaagcaccaccaacccaatcgaggccaacgactagcttcatgctattgagaagaagctgaaccttttgcaatgcaacgaccaagagaatgttgcttttgctacacaccagctggaaggtcccgcttctgtttggcgggacaactatatggtgacccgtccagctgggacagaggttacctggtcagagttttgtcagagtttcaataaagcacaagttcctgagggaatcgtggcacaaaagaagagagagttccgttctccgcaacaaggaaccagagcagttatagagtatttgcatgagttcaaccgtctcgcgcgttatgcccctgaggacgtgcgcactgatgccgagaggcaggagaagtttttgtctggtcttgatgacgaattgaccaaccagttgatctgcagagattatgaggactttgagaagctggtggacaaagctatccgtcaggaagagcagtgcaacaaaatgaaccgtaagaggaaggcagctcagctcagaacttcccaggggatcagtcagaagccttgcttcacgatgggacatcagggtggaccttccacaatgattatccggcagcaccgtccctaccacccgggtagcttcaacaagaactacaacagtgagcagcacagcctcaaccctactccaagtcttctaatgattccagctcagtcatttcagccagctctgcctgctcagccagaacagcccaagaagtttggagaaaagcccgaactctgcttcaattgtaacgagtcaggatacatggtacgtacgtgcccgaagccaagacgtgccggactcaagttcgtttaggcctgtgtcaatcatgcatctgcagaggaggcgcagtcagcaccagagattatattgggtacattccccgtcaactcgacaccggcagtaatattgtttgattctggtgcaactcattccttcatttccaagcgttttgctggtgcacatgggttatctttagtgaagcttaagatacctatgcgagttcatactcctggaggtggcatgaccacaactcactattgcccatctgtgacagttgaaatccaagggttgatttttccagccaacctcattcttctcgagtccaaggaccttgatgttattcttggaatggattggttgacaaggcacagaggagtgattcattgcgttagccgcaccatcaagttgaccaatgcgaaaggagaagtggtaaccttccagtctccagtaccgcagaagccaggaatcagtctgaaccaggccactggtgaggtagcagtggagaaaacctctaagaagttggaggatattcccatagttagagagtatccagaggtttttccggatgatctgacaacaatgccaccaaaaagggatatcgagttctggattgacttggcacttggaactgcaccgatccacaagaggccttacagaatgggagccaacgagttggcggaagtcaagaagcaagttgatgagcagttacagaagggatacatccgcccgagcacgtcgccttggggtgctccggtaatctttgtggaaaagaaagacaaaactaagaggatgtgtgttgactaccgcgcactcaatgaggtcactattaagaacaagtatccgttgccaagaattgatgatctgtttgatcagttgaaaggagctactatgttctctaagatagacctacgatcaggctatcaccagttgagaatccgagaggaggacattccaaagacagcattcatcattcattatgggttgttcgaatgcacggttatgtctttcggactcactaacgcacctgccttcttcatgaatttgatgaacaaggtgtttatggaatttctggacaagtttgttatggttttcatcgatgacatactgatctactccaagtccaaggaagaacatgagcagcatcttcggctggtacttgaaaagttaaaggagcaccagctatatgccaagttcagcaagtgtgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgtcggttcattgagaacttctctaaaattgccaagccaatgacccagctattgaagaaggaagaaaagtttatctggtctgctgaatgtaataggagttttgaagaactcaaacgacggttggtgtctgcacccgttttaattttgccagatcagacgaaagacttccaggtctattgtgatgcatctcgccaagggttagggtgtgtggtgatgcaagatggcaaagtggttgcttatgcttcacgtcagttgcgtcctcatgaaggcaactacccgacccacgatctgaaattggccgcagttgttcatgctttaaagatctggcggcactatctcatcggtaaccgttgtgaggtatatacagatcacaaaagtctaaagtacatcttcacccaagctgatctgaatctccgacagcgaagatggttggagctaattaaagattatgatatgggaatacactattatcccggcaaggctaatgtggtagcagatgccttgagcaggaagagctactgcaacgtcgcatgggtagaggaactatgctgtgaggttcaacgtgatttggaacatctgaaccttggtatagttgagcacggatttgtggctgccctagtggcacagcccacactggtggagtaggttcgcatagctcaggcaagcgatcctgagatagcagaactcaaaaagaacatgagggttggaaaagcccgaggttttgttgaggatgaacaaggaacaatctgaatgggagaaagattgtgtgtacctgaaaacaaggagttaaaagacctgatagtgacagaagctcatcaaacccaatattcaatccatccctgcagtaccaaaatgtaccaagacctcaaagaaaaattctggtgggtcagcatgagaagggaaatagctgaattcgtcgcactctgtgatgtctgtcagcgagtaaaggcagaacaccaaaggccagcaggtttgctatagccccttcagattccataatggaagtgggaagaaattggaatggactttatcaccggtttgcctaggacgtcatcggggcacgattctatttgggtagtcgttgatcgagtcaccaaagtggctcacttcattccggtgcatactacctactcagggaagaagttagcagagctttatctggcaagaatcatgtgcttacatggtgtatctaagaagatcgtgtctgatcgaggaagccaattcacttcaaagttctggcagaaattgcaataagaattgggaacctgtctgaacttctgcacagcctaccatccgcaaactgatggccagactgagcgagttaatcaaatattggaggatatgttgagagcctgtgcgcttgactttggtggagcatgggacaaaagcttgccgtatgctgagttctcctacaacaacagttaccaggctagtctgcaaatggcactgtttgaagcattgtatggacggaggtgtcgtactctgctcttctgggatcagaccggggaacaccagttgtttggtacagaagttttaaatgaggcagaagagaaagtcagagctgtcagggaaagattgagaatcgcacaatctcgacagaatagctatgcagacaaccgccgaagggagctcgctttcgaagcaggggattatgtgtatctccgtgtcactccgctcaggggagtacaccactttcaaaccaaaggaaagttggcaccacgctttgtgggaccatatcggattttggaacgcaggggtgaagtttcttaccagcttgagccttccctccaacatgcttggcattcataatgtgtttcacgtctctcagttgaagaaatgtttgagagttcctgaggaacagacaagtccggatcacatcgaaattcaggaagatctgacctatgtggagaagccagtccgcatccttgagaccagcgagagaaggaccagaaacaaggtaatcagattctacaaagttcaatggagccaccactcagaagaagaggccacttgggaaagagaagatgagttgaaggccgcctatccgcacctcttcgccagctcttccgaatctcggggtcgagattccgtttaaggggggtaggttcgtcacgccctgaagtttccccctttttcttactttaaaaatttgttaaataaatcgtccggagaaattgttctaattaacctagagctaattccctaattgataaatgcaattaataattggaattggcattgtgggatttttcttgggttccacatgtcgcaattgattaataggatttttagtggaattttcagagccctataaataattttaacccattaaaattcataaaccgcaatatttaaatcccagggaaattcctttttccttttctttttctttaccttcttnttctttgttgggccgtcagcccaacctccctcccgcgcgccctctttgctgggccggcccgctcctcccttccccttcccgaagtcctccctccctccctctctcattcgggggctgataggtggggcccacctgtcggtcgtctcccacctccagccgttgtgtcctataaatcactccccgagtcccctctccctttttccgcgctcgccgctctctcccatgcctactattgtcgccgcgccgctctcccgagctccgccgctcgccgccgcatttcagccacgcaccaccgccgctagagccgccgccgccgctagcttcgtcgtcacgtgggtcatctcggccaccgcctcacgttgccggaaccccaccggaaccctatctccctcatgagccggtgagatatccatcctcctccgtctccggtcaacaatagtggccgctgtggtcacttaccccacccctaacccatctctgctccctcctagggtgccgccgccgcccgtccgcacctccgcatcgccggtcgtcaccgccgccttcttccttcgcgccgtccgccgtgctcgccggtgaggaatccccctctcctccttcctttcctctctctctcccatgagcgccgccgccctccgcgcgtgcgtcgtcgtcttcggccgtgcgccgccgctttcgcgccggtcgccgccgcctcccgcgccgccgcttgccgtcgctggcgaccgctcgctgccgccgctccccatggccggctggccggttttgtgccgagcagagccgtgccaagccgccgcccgcgccgtccgatcggcctcccggccgatctggacagtcggtctagtggaccggcggtggaccacccgcgtggtcccggtccacggtggaccagccgcctcgtgccgctgacaggcgaggcccgcttgccggcgccgcgccccctcccttgatgacgtcagccctggggatttattgcgcaataattaattaaggccttttctttattagtaaaaacacagattatcttctaaaattcatatctaattcatcggaactccgtgtaagtccattcaagtctcagtaaattcataaaaatccctaaaatccattaaaaatggttttgtttcctgtttcagtagtcttatagcatgttttgcttgtgtgctttgtttgtcacatagatctcggccgtttcgtcgatccgcggtttctcgaagacgttgctgaggtctcatcagtgcgagagcaaggcaagttatgcattacaattgatcatattgtacccaatttacaaatatcccgcatttctattaaatgttgcattcttttacaatgtcatgtgggatgggtcctatcactcagccatttattgtttgccttatgccattgataacttgggtatcaaaatgattagatgttggttttggaaatgcttagccatgcttagttcaactagtacacaaatggggatcacattattacatagactttgactattagcatagctttggactagtgccaccgcaatggtgttagttaattaaaatacactgaatggtgggctatgggtgcatggttttgctggtcgcacccatggcaattaaggaccggttcacgggaaaccctgggagacttaccgtgcttaccacaagtgggagtgggtaactgcttgatctgaagtatagctcgaccctttcctaggcaccggtggcgagggtgggcatgatggagttgggtcggccggggtgtccggttgtccagttgccggattcaccacggcacaagaggggaccgcccactgcctttttaggggtgggggtgaaaccttagcatggtgtggatggttaggggagggttatgcggagggtcttgtcacgatttccccctttgcagtattatggtgatacttcggggcatgtcgacatgtgtggaatcgtatcttgtgggtacagttgtacacctctggccagagtaaaactatttgaatagccgtgcccgcggttatgggcgatcacccagattcaccgtgattagtcttacccctagtttagcttaatgaactggtgtagttcaagtggttggttgggcctgttgcaacgtggtgtagcgttggacagtgattggttaatattgattaattactacaactgttttactgctttcaacttctgcttttaaatgctagctttgtgcaaatgaacccctagcctcctttggttatatcctacatcatacctcctcttccggtaagtcttgctgagtacagtgggtagtactcagccttgctctcttttcccccacaccagagttgaagttctttccagttggagctgtatcgaagaagttgatctcatcgctgccgtcaagggatgcctgtggagtggagtcgccccgctgcagaagtcaagcgtccaagtctagctcgttttatctttccgctgcatttgtaatcttttctatttttgtaagacgtggatctatatgtcaacaactgtcgtttgtgtaccctggctggtcctggacagggatttgatgcacattcagcttagaaattctggttcgtgaatttctgggcgtgacaagttggtatcagagccgaccttgaccgtagaacaagccaactggaaacctaagagccctctgaaccccttttcatctgcatatgctctttgtacttggatttgtttcgggaaaatttggggttttgcctctttggtttgcgggaaaaatcttggtcgttcattcggatcggatctttaaaattagctcagtctagggttttagaaaaaaatatttggagtttattcgacaatcagtcgggaatctattgggtgatatgcattaggtcgtgtctatgtttgatggggcatttttatgcgcatcattttccatgcatctgttttatgcattaagttattgtttagtcagttgcattagtgtcgttatctgggttcatgaaaaatgttctatgcataaaaatcagtcatgctcggttatttatttgagtcatttgttgctttgtttaatttggatttgagcatgaattggttcctatcccttgtccatctttagatgtcagacctgttcctcgatcgcaagcgccgctccaagcttcagagtcgccgcccttagctttatcgtcttcttagtgtgtttgcttgctagtttccgtgtttaggtttgttgcttgtgggttagtcggcggtcgatatcatgtgtcagtggtatgtctgccttaattaggagttgtttgcctctttttcagtgttttaatcaagattaagataattgcacgtaaatttataagaaagattagtttctaagccccctgttttcttccttttctcatatttctacctatccccctccagatggtgaagacaaggaatggttcccgtgaatccaacaacgccagtggcagcgaagagcatatcagtggagcatgtgccagcgatgcatctgacaacagtccatctccaccgcccgagaa

SEQ ID NO: 79267 - DNA, 25684 bp, Oryza sativa
ctccccacattctccccccggcctctccctcggccccacagacacaaccaggtgaaaaatgtcacccgcccaacccccgtaggggacctggcgggccccactcacccggatgcgtgaacagtgagtggcggtggcggggattcgtaaaaatgtcatttcaaaaaatatgtttatatataatctctcatattttttaaaataggagtaaaaatgtcatttcaaatttctcagtaaaaaatatctctctcagtctcatacggtgtttgtgtaaaaaattttagaaaagtgacatctcaatagtgccactccgtaagataggcaaatagttaaaaacccaatgtgagggagaacatcaggaagttatactaatggaaagtactagtacttgatatttcccaaatgaagatagcaaggggtgtattactccctccgcctctgaataaatttatttaattgtcttctgttgtttatcacaaaataaatttacttttacaaaattatattgaagatcgattatgaaagtaaaagataaatgtgttgaatgtagataaagtagaaaaataattatatcgatatttgataaaattaaagtattttaatttatttcttacttatgttgaaatggagataatatcagcttaggccatgtttagttcccaaaaacttttcccaaaaacatcacatcgaatctttggacatatatatgaagcattaaatatggataaaaagaaaaactaattgcacagtttggatgtaaatcgcgagacgaatcttttgagtctaattaggccataattagtcataattaagtgctacagtaacccacatgtgctaatgacgaattaattaggctcaaaagattcgtctcgcggtttccaggcgagctgtgaaatcagttttttttaatcgtgtccaaaaatccctttcgacatccggtcaaacgtccgatatgacacccaaagattttcatttcaccaactaaagatgcccttagctatgggaaacctcgggagaaggcgcgtgcacctataaggtaccactttgaacgtacgtgctctccaagaactaataatagagaaaaaaaataagaaaacgcaagagtagactaaaaaggttattgaaatataacaacagaagattaaggagtaaataattaagagcgtatctgatcgtacgcatggcaaaatggatgaaaaacaaatttaataaaaggaaaacaaaaaggaaagaagaggtagcttaattaattagctatagctgtagctcttacaggcgcatatgcagacgatccagatgtagaagaagttgaggtaagggatgccggggtgggcctcgcacctctccttcgtccggcacccggggcaccgccgccgcctccccgccgccgccggtaccagcaatggcgccgccgccgcagcgtcgtcgccgccggccttgtctccggcggccattattactagctcaatcggtcaatccctcctcgatctcctactagctagcttagctagtctgtctccggcgagcagagaggaggaaagaggtgtactgtacaggagcagctacacggagtacaggagcttggctatatatggcgcgcgcgcgttttattggcgatggcgcccacggggactgtcgctagggctgtcaacgagcggagctcacctgtgcaggttcgagctcgatataagcttcagccgagctggctcataactcatgaagaagtcacctctgttgtaaagtatccctgagagagtaagatgttgttgtattttgttcaaaatatgataatttcttcataacattcttttctcagccaaaatcacaacacttcaccattcaattttctcgcctaactctatttctcgaccaatcatcattttcttccatttaattctaaatattttcttagtactcacattcaaccctaaaaatctttatattctggaatggagggagtaccactatacatatattttaaggatcgaatctctcaataaataaaagcaactaatttctatttaatcatatacatacataaataaggagaaaacaaaacaatataaatatgtggcaccgatacaaactacttcgttgtgttgaatacttatatataaataatataatatatactttgatctactaatttgtaaagtaaaaaataaaatacatatattgtcaggctcgataatagcttgagctcagctcgacaaagctcacgagattttggtataggctcggacttgacttgtcagaagctcgagccaagctagaactattaagcctacgatgagtcggttaaaggtgtaattgattaactagtgaaacttatttataaacttgttttattttaatatataagtgagtttatggattagccacttactactgcacctctcgtggcgattgagcagcttgtgagtggctactgagtgcccagctttttttttcttttacagccctagacgtcgtcaaacacaaacgtacggagcggtgaggtccgtgaggaaattggtaggtcgcacgtgctgggaggatggacctgctggggccgcgtgcttattaggtgtgtggcacgttcgattagtttgcacgttccgatgatcccgtgagatgtacagtacgtataacgtactcacacagtctccgagctttgcaaatgccagggctagctatcattactgtctttttactatataagaccaagtttaatataatgtatagataactattagcttcaaatcatttatagtcaatttaataactaattcatacaatagttacctataaacatatagtatactattaatatctagtcccatctgtcaacacattgtgtcttgaagtccatgctgaagctgctcttttttctctttttttatcttctcaacatatgtttatagctgatttatagtcatctattgtacctgctcttaaggttataagtataaactccaaagtgttatgtgtatgtttaaataatgatgtggaggagagaagagaagagaagagagaggaagatccacctcttatgcaacgggtaacctccacacaaactttaaaaatcaagagaaaataaaagaggttgattggtggcaagtgcattagtactagtgtattaaatgcaattcatttatataagttagttttaattttatagatggatgatgtggataaaattgaaggtgaccaccatctctattataaaacttacctttaaacaactgagtctgagtgattatatctgaccacgcctagccccattcgaatctgctaaggatgaagattaaaagcagacatgtcaaacaaaaaagtcattaatacttgattaattaagggcctgtttggtacagctccaactcttaaatttagctccaggagttgagtctggagtggagttgtggagctgcctaaacctagctccacaactctagttcattttgtgagagagctccatccagctccactcccattttttgtggagctgaaactgtttggctgagttccagctccaggaggggtggagctggagctgtgctaaataggccctaaattttaattattacaaacttgaaaaatagattaatatgatgttttaaagcaactaccgcatagaaagttttcgtataaaatacattgtttagtagtttaaaaaacgtgatattgaaaacgagggaaaatcttatcttgatgaatgtaatgcgcccggtgatacatcgagaacctcatggctcatgccttcctaatcgtgctaactacgccattatattggattcggacgtacgtaatcgcagtgttttaatccaattgaccattagtggcgcgtgtcacgcactctcaacgatctcgtacaggggagagagagagagagagatccgcggacagaggcaaaatggtcaattgcaatataatagagggtttcaacaactgcaaaacagtctataaaggtgatgaatcatcgaggtgacaaagaaatagtcaaatagatggtaatcaattgcaatatagagggtttcagtgaatcaattggcaaatcgttgattttctcgcaaacatgagatatataaaatgtataataagctagcttgtgatatatagctctgagatcagtcaagacaacgcggcgccgtgccgccgtgcaacacaaaaagcccccttcaccggccggtgttgcatacctctcgtgctatgtgcatcgcgtccccaacaccacctacggaccgtggttagttttattttccctaattaaccaactgaatcaaccaaaaatccaaaactcaacaacgtacttgcacagttgcacttgaaaaatacgtatttgaagagaagcaaacgtgtgcaacttacgaccccaatattttagcccctttgattagaaaaaaattaaatgatcgtattgctatagaaaaaactcataagggcattgaaatttgggattggatcatatcttttttgaaattcatatgaaattgaaaaaaatggtaagccccgtgcagacggtagatagtcggaagttgtctatcatatggtaaaagacgttggtcgaaatcgtcatatatctgtgacgttgtcacgtcgcagaagggatcagaatgagcggggcatctagatctatactccctccgtccctaataaaatcaaaccttagcatccaagaagctattaaggaaagaaacaaaagatcaaataacccttaactaatgcaaaaattgtaggcaaaatttgcttcaggacatcgaaaaaaagtgtaattagttaggggacaccgtaagaacgcgtatttgctgtagggcattgcaaaaaactagtaattagctgttgaatacccgcgggattattttattatatccggacgaattggagagagaaacagatgtgtaagtatgattctaccctttaattttttcctttttctttattcttccttattcttttctccctctttcattctttctctctttcttttcttctctttcttcaaccaagcccgaggaagagggagagcgccggcaacggcgtgcgggtcggtgcggtgctacgcggcggaggtagcgccagagcaggaggactctgcaaggtatgctctccttctgctccgtctccgtggtgcgcgcatcgttcggtgcgcgatccgaccactaggacaaagtccctgcacgagctcaacgaggcagtgctgcatcgcaggtgagaaggtggcggcggctgccagggcagtgtagccgccgcttcgttcgcccatcgcttgttgctcctcccagactcgcccgctgccaccgctcctcctaagctcgcccgccgcatccgcgaccacgatggcgtgccactgctagagcgagatgaggacctgctcagtgtggggcccacgttggactaatttaagccaaggaaaaactggttttaaatgattatttctctctcctattccttcgaaaataataaagtaatatcacggggccagcagctaattatctttttttcgatgccttacaacaaatacgcattcttacggtgtctcctagctaattacactttttttatgtcatgtagcaaagtttgccaaaattgtattggttgatgtgtattgaagtaataaactttctggatttgcggattggtggaaggagttggtttattttgggacaaattttaaactctaggagttgatttattttgggacggagggagtgttaaaaaaaaagtaatgttagattgtcattgggcaccgggccgtagcacattgataaagggcctcctaccaccatacggttaggcccgggaacttccaattcccgccgtttcgatcgagagagctttgggccgatgacttccggccattccatggcacgccgagctgccacgctcgcgtcgcgtccagatgcgcgcgcgcgcatatatcttctccccgctcaccacagccattcgtccccgggcctcgccgcgccgcgccacgccacgcctccgcccgcgttcgcactgactgacctgtcacgcgcgcgcgcgggggggagagcgcgaggaggaggagaaaagatcttcgcgcccccccgtcttgtcctctgtggagccgaggccgaggccgagctgagctgagctcgcttccgtgctcggccagcgcacccgcgcacgcaagcaagcaagcaaccgagcaagaagacctgcgctgcgcgcgcgcgcgctgacgggcggaggcgaggcgaggcgatgctctacctgctgccgctctccgtctcctgccgggtccccggctcgccgccggcgccgcgctcgcggcgcttcctcgaccccggcggcggccggggagttggggatgggttaggcggcgtcagggtgttccggaggcgggcgctgcgagggaccgacgtccggtcgaacacctcgtcgtcgtcgtcgcggaagggccgccacgacgacgcgcgacacgacgggggatacggcgacgacggcgacgctggggcgctgctggcgtcggtgaggaggctgctgctctccgggtcggcgcaggacgacgcggcggagggggaggcggaggaggacgagcagggtcagttccccaagcgatgggccatcgtcttcctctgcttctccgcattcctcctctgcaacatggaccgcgtaaaaattcctcctcccttctctaacgccctgatgaaccctagattcccccccccccccctcctcaataattccatttcgttgatattgtaaaatgcactaatgcccaaatgaaccaaagatgcagtttcttgatcggatccaaaaacataaacttgtcaaatgccgattcctaatgatgattggtagtagtatatgttaaaagcttcaattctttcttgggagattcatgctttcaacattttgcaggtaaacatgagcattgccattctgccaatgtctgcagaattcggatggaacccacaaactgttggcctcattcagtcatctttcttctggggctacctgctaactcaggtctgtgtgcagtactaatccagggaaatctgtaactaggattcatgcaagagcagtttgagttcatttggtaccccatgattctgatgtattgccattgcagatagcaggaggaatctgggcagatacagttggagggaagactgtccttggcttcggcgtcatttggtggtcgatagccacagctcttacgccttttgcggcgaagctggggttaccattcctccttgtgacccgtgctttcatgggagttggtgaggtgagcatttctaattcatattatattcatttgttatgtcatacaagttttgtgcaaatgctaatgtagagcccttatcagatgatgtctagcttctattgaactatagtcaagtgacagaacattttaagagaaaaaaaatgaatttatgttgaagttgaaaaatctggggtgccctaaaattccctttgatcgtttccacagtattgcacctttcatcatttctgttgttcagacttcttcagtgtttcaaagagtggatttcatttgtaatacaaggggtagcagaacatgcctgactaaatcacttcgcttgtaattcacaaaaagaatattaacttttttttatgcattcttagtcatggttgttttggtggtatttgatattttctatgcacctcttattgatacggtaaacatataaaatctttccccagggagttgccatgcctgcgatgaataatattctttcgaaatgggttcctgtatcagagaggagcagatcattggctctcgtgtatagtggaatgtaccttgggtcagtgacagggcttgcattttccccattgctgatacataactttggctggccatcggtcttctactcctttgggtctctgggtgtattttggttttcgacatgggcgagcaaggtatttctcggtgttctgttcaccatttcactcggaattggtgaattactgtattacttttctaatttttttttagttatctcttaaatttgtgatctgcttctataaaggcgtatagtagtccacttgaggatccaggaattagtgctgaagagaagaagcttataaccagtcaaaccacaggaggagagcctgttaaagaaattccatggggactaatattatcgaaaccccctgtttgggctcttatagtgtctcatttctgccataactggggaactttcatcttgctcacatggatgccaacatactacaaccaggtatgatcagcatcatagttttctacctgaggatcttgaaccgcaatcccttgtgtataataatatttaaaaacaggttctgaaattcaacctcacagaatccggccttttctgtgttctcccctggttaacaatggcagtttctgcaaattttggtggttggatagcagatacgcttgtcagtagaggattatcagtgacaacagttcggaaggtaaattaatcccttcagtcgtgaaatttacccatgcaatgaggtgctatcaaactccaacggaatattcaatatgaatcattgttctaccattggcaaaccatgcttgaatatgtgaatttgtgtgcggcataattaatcaacataatgcttagaagtgagaatgaagagctaaacctaattcattgtgcatgactttctatctacttcgtgcagatcatgcagtcaattggattcttagggcccgcattttttctgactcaactgagccatatcgattcaccagcaatggcagtgttgtgcatggcttgtagccaggtaaatggcagtttggcttcttgtcattttcctttattctgtcatagaacagccatatattatgtacctctttttagaacaactgtgatttgtatctgaatggccattttgagatctatctcagtatttccagcataacatgttgcatttcttattctcagggaactgatgcattctcacagtccggtctatactcaaatcaccaagatatcggtcctcgatacgctgtaatcaactctctttagcacaaaacatttcttcaaatgacgcattttcggagttctgtctgaaacattatagcttcaggtgaactcacatgttgtcttgcagggtgtactgcttggtctttctaacacggctggggttttagctggtgtgtttggcacagcggcaacaggatacatcttgcagcatggtttggcctgaaatccccatctccctagtgacataatgcacatcaattttacaatcttttacatgattttttgttgctctgtttaataaacgcaggttcttgggatgatgtcttcaaagtatctgttgtgctgtatctggttgggactttggtctggaacctattctcgaccggtgaaaaaattatcgattgatgcttgtatatagcctgcttacagttcaaaatggaaagtacatacggttcagtaactggtgagatgagaattgcattcgatcaacatccattccatgtgaagctcaactctttgcagaaacagaactacagactgcaaacttttccgcgcagcgttagacatgcaattcttggcagaagaagtttcaagtgttcgaatttttcacatgattcaggatcttcgcacaattttgcaaatgaagcatgtgcaagaggtttgagttgagcaattaccaacagccagttttttaggactctgtaagtataggtatttctgtacagcttagatgaagaatccaccatccaccgtacacccctattatttttgacttgttacacaattttcttgaacatcgtatttctgtaaagtttgtagttaacaagtttaggaattcggcaatcttacctgattcttgtgaatttaactgtttgagatatggcccttggcatttgatgggcatggtttcatctacactttgtgtgacatgtgttcctaagtatagttttccaactatggtcaatatttgtataattatattaggcaacgcatgtcagaagaaagaaaagcgccaaagaggaattgaggcatggctacaagtgaacaatttaagcataaacgaatagaataatcagtagtaccagcgctgcttattatttattttaaaaacatatttcggcatatcattttggaccataacaacatggcatctcaacagtcaacaatgcaaaagtaaagagaacttttgaaccagtcccttataatagggcaactaaatcaaaactggcaataaatatcaagacttagttcatcaaagcaaccatacattaccaggtattatcagtcaagagggcctcaggcttgcgataaatattatctacactacaagggttgagctgcagcctagtctttacttgcagtatctcgtacaagcaaagcaaccaagcttgcacatttaccaggtactccgataaagctaatttgctattgatctatatcacacgagcgacagggactgattggcacgttcagcagtttgtgtcatatgttgcaagcccttgcaactcgggcccctccaaccttggatttttgtcaaagctgcagagagaaaaacaatggcttagaaacaatgcaaactggggcgatgagttctgcatatgccaagtgacgacaattaatggaagtccacaatacatagaaaacaaaatatggcacttagtgagtcatttgttgtgtcgattaattctgattcagcaattagcgtatatggaaaagaaataaaaaaataaactctggatctatggcataccacagaaaaatgagtagctcttagaagataaagaattcaagaaaatgagtagagcactctttttatctggtacatagatatgtgctacataacaaccaaattagtattatggcaaaagatgagctgcactgtcaaatcagaaaaacttagccgaggttcactagtaatcaattttatgacttcgggtgttttggtttttggctgatggaatagtgtggctaatgtctcaagtcctctcatttatacagaagcacaacattggatgtgcaaaagcaaaaaacaagtcaacataattgtaaaataaattggtaacaaggcttttagatcttacttgttcaggggtatatgctcaaaaggcccgctagtaggaatcgtgccgcaaagatcattgttcgagacatctctggaagcaagaatagatagacaaataaaagatcatcattaatatgtacagaacataaaaattatgtgaaacagcattgttaactgagcacttacatcactttgagactagatatttttgccagatccctcgggattggaccgtttaaactgttgtcattaagccgcctaaagaaacaaaaataaaaggattaacatagcgtaaaagtaccagtgtaccatagcataaaaagaattaaaaagaaagtgatgcttgcatatgtggcaaaatggtgcaaaagtggatatatgttaactaaagtatagttgcttaaaagaataagtacagctaatcacaagaataagtatagttactcacaagaatactaaggaactcagcttgccaagttctttcggtatggttccagtaatgttgttgttatacagatccaagctaataaggttcttcagactcccgagctcagctgggatagtgccctgaatattgtttttgtacagctctctgtaacaatttttcaaaaactagttagagcactaacatgaatgtcaagctcaattgcagtaaaatagcatcggaaattaaggatgaccaaagcatattttataaatcaaatggatacaagacttaatgatgcagtcttggcacaaatcacgagactgaaaacaaacagttcgttggaaaaactgtacaatatattgtcttatagtggaccatgttcaatgctggtgtttattttgcatatgaacagctcatatcagattcatatgttctgatatagctgagattcccagcatttagatttagttcatcattttacttaaaaagaatcatctctcttgctcattaaaataacactccgaaaatgctctagtttcactccactaggaaacggaagctgcaatcacataacaggaagtgagaagatcaaaacagtaagtcaataattacgtgccacaaggaactgttgaaaaccacaaattgtgttctagatttctggtaatgtgagagtttccatttttcccccagttttttcaccatttgccatgatatttgcagtttaattcatgaagcctagctgtttaaatgactttacaaatccagcgctgaagctttatgagttcaaaaaagaagtgatgaaagaaaggaagctaggtctaacatagtattccagctgtaacttctacatgacaagcagttggcagtgttgctgaatgctgaccatatgtaatgcaaacttaacaggacatgtgagtttttagcttatcagtgtcggtgatcattgccatcagagaacctttgctgaatgaactctacattttaacacttcagaaaataaagtgcatcaatatgtagaaagacttacagatattggagatgctcaaggtgtcccagttcaggagcaagatggcctgacaaatttgagttacccaagtctctacaagatacaaaattgttagaaagtatcagaaaaatgttaagatggacaaagacaatgaattgaaccaagaacataggtaaccataacaaaatatatctcttgtatggtaatggcatcatggtgaacgctgcatcgaaagaaaccacttcgatgaatcaatttctttccttcagcaagcaaacatatataataggtaccctaagtccaaaccaatggaaggatgcaagtggaccggtccgcaagcccccatataggccatttttgcaggccaacctatgggtcagcccacgaaaatgtcccatacgcaggctcgtgagtcagcctgcttgcatccctacaatggagtacataaaagactacaaaaatctagtcgtacagtgaaagcagtaagactctatctagggtggttgattgctaagtactccctcgttcacatttgaccagcgcattccatcttgacacttccatttaatccccatgataatatctgtattaattggctacatacacatcctcgctacatgcggattggatacacaactttttttttctttttttaagctgaccattagcaggcgatgcattgttcccgagatgcatggcgtgctagcggagtaactcacgtgcgaactgtgcagccaatgggtaacgcgacaatcatcattggataattgctttttggttttacgtggatcaattgcgcacatagagaatatagcttgcatcagcgatatttccatgcaggatcaaggagtactccccggttccatttatagctatcatcagcataattatgcaaatacatgatgacatagctaacgtgcaaagtattgatatcaaactactacatgcaagtaattagtagatattatatagtgagtagctttactgttgctacaaactaactagtaacatttactattacagacaaactgtattgcaacgatgattccacatgggcagaacaaaatcttttaaaaaaaattaaatgacaatctacaaatcacgttctttgccagtagatcacggtctcaccagaaccgaatgaacaactaaatcaccatatccctttcaccaactggtgtcaattaactcacagatccatttgaaactgtatttaagcattagcggcctagcacaaagccctcgcatttccaatactacggcagaggtcagtacaccgaagcaaacaaaagcagtacacaacggagggagcaaaaccggccggtagtagccagctcagtcggcgaggcggcggcggcggtgggggggggggaggtggactcacaggcgggtgacgcggccggcgcggtcgcaggtgacgtggaaccaggtgcaggggttgacgagggtcgggtcccagctctggagcacgccccgggggtccgccagcgcgcgccgcagcgcgtacagcgcgtccccctccgagttggacgccgacgccacggccgccgccagcaaaaccgccgcgagcgccggggaccaggccgccgccatcgccatcgaagcttagctagggttccggatgcgggcgaggaggagtggggaaatgggcggagtgagtgaaggtagtggaagcggaggtggtgaggggagtttaacctcgggagtcgggggagggatcgctcggatcttctgcggcgtaaatacgcgcgagtgagcttgttgtgtgacggtgtgagggtgagatgggacacgcaacgcctcgctgtcgaggggtacgtcgcctatcactgaaagcacaacgccgttaaatcctggaaaattcgcctatcactgaaagcacaacgccgttaaatcctggaaaattcgctctcatggggagtcgaacccaggacctcaggtgctactgaggctcttgtaaccaccaggctacaggcccgtggttataaatgaattactctatctgttttatattttaagttatttgaattttttcctagtcaaactttgttaagtttaatcaagtttatagaaaaatttagtaacatttaaaatattaaattagttcatatattctgataatatgtttgttttgtgctgaaaatactactgtatttttatataaacttgatcaaacttaaagaagtttagctagaaaaaaagtcaaatgacttataatataaaatggagggagtagctgttactccataaagttataaataagagtaaattttataaaattacatgtattttgacatcacaaaactacaaatttaatatggtatatcacaaacctacatatatggaagatcaccactgcatatttaataataatattatcggttttgcaccaacctaagtacaagactacaacatttataactctcaccataatagtagtggtagggatttaaattgtaaaatttgtagttttatgataactccagtattaaagttttatttttgtgatacttgataaatcttatgttcaatctgtagttttatgatacaacatctcgtagttttatgataatttggttcaagtgtttgtagtgttgtaaaatttagtctaaaaataaattttaaataactttctaagaaatatatttatacatatgtttttaaagaaaacacaagttcagaaagcatgtgcattcatccatcattccattaatgagaaaaggatagcccaaggtaaaaggattaaagtgaaggcattgtattcgatagggaattttatgtttggaatggaggattagcttttgcttttcctttggaatgagataatgagaatgcttttacagcaccatactaaattatttgttgatcggtggcataaaatttgtttatttaggtctgaaaagaatatagcataattaacacccatataatttccagaatcataagggccacaatacaattttgtgtggcttactaagaatgccctagcttcattcagatttccatctatttctctctcacatgtatgcaacggtttaaaacatacaaaaaaaactgaaggaaacatagaggattaaaaatcctatggaaaattgtcagggccatggataccacatacctaatagtagttgactaaactcggcagggcccaccacataccatgtcttatacggatacaaacctcgtatataaaaggagttccggataaggaaggacaaaaagagttttatatggaaacgacagggattactcggatcgtatccatatttatctccctagttctacttggacaaggggtcatctatgggtataaatacaagccccccaggaggagagaggggacacccaccacaatctacgacgccacaaaaccacaagccaatacacatcgccagatctcgacatcagagattagcctagccataccccatccggtgtctacggaaatcggcaagagggatctagcgccatctctgatctcgacgagttcatgttcgaggaggaagactacctgttgtcgactacgagttggttatctagccgctaagtcgacaacagatagataggttatcccaaatattgtatttgtgtgatacagatgaataaagagcaacaccggcttcggccaacaggatgtagggctattacctgtaagataaggggcccgaacctgtataaaaatccctgtctccatctcttttacctcaatctcgcatatactctggtaccaataatccccataccatccaaataccctagtcgtaactatcaaacgtcgacaaaaataatcctactccgtccttagaaaccgtcctttggaattcctatggaatataccatttcatgggaatttttgaggaaaactaaggttcctataattttcctttggtgttgctaaactacatttgttccctatcgaatacaatgccttcacttgttttttgggacatttatcagatcacaaatcaaatatatagtttaggtagaaacattttactttaaccatgctaaaaaaaggtgaagccacccaacctacaagagcatgccacatcatcacatacaatatatgaatggcttcatctagttgttttgatcggattttgccatccaatatatagatggaatatgctatgggtgacaaccatatcctcaatcgcccatgaactaaacaccactaaaaatgtaactgctatatcatgattgttaaaatggtacgacgtcctaaggttgtgttctttacccccatcttccaatttctatcctctcatcttttatacgcacgcttcccaaactgctaaacggtgtgtttttttaaaaaaaaaatctataggaaagttactttagaaaatcatattgatccatttttcaatctttttttgtctaatacttaattaattatgcactaatttaccactctgctttatgtgcttgaagggttagtttccaactctctataacgaacacaacttaaagcgatcccgaattggcactcccaaactaattaggtgccaagccaaaaaaaatcttatatggcagcaaatcaaggctacattttaagagcagtataacaaacatatatatctcttattcttggcaactgagtccatatagcatccaccaccttcatggaccatggtagcatctgtccccttaggaccatcaacattataaattgggcttttagattttcgggcctttcccgtgtgcaaccaatttgccttgcacatcagccattcaaatcaaatcgaacaactgtcattttgttgctgacgtggcttaaccacaaggcaaaggattcctattaactacaccaggcgtggatgaactatataggtatataagattcacatagaaaagttatttgactacaataatgaaaagactggaaaccaaaacaatgaagaggttcctcgactagcaatcataaaagcattttgattggtatcctattagattgactcagatcatgaagctgttgaaggtggatcaccctcggagccaccacaccgtcttcctttatgcttcattaacatccatagctttatatacgtcactaacaatcatagtagaaaaaaccggactagcggttcaaccggaaaaaaccggaaccagctccctgaccggctcggttccctcaaaggatcgttcacgcaatcgacccggtgtgaaccttgccgaccactaggctaagtaagttgctgtgactggaagacaacacaaaatatacttaggaaataaaccgcggttcaaccagtgacccaacggttgaaccgatagaccggtgaacccaacactccaccgggtcaagcaccggtccggttttttctactatgctaacaatctgtgttgttgtgtacaacctgcaaggaaccaagcaacacatgtcctatattatgtatcttttactatgcttactcaaactaagttgaagtatctttagcaatcattagacaatatgatttgtactataattatgtttccctcatgttatttgatttgctttgaatactactcaatcttaccctacaatcatccataagtaacatgttgaaagttcatgtgccattaatttggttttggtgattaatgataaatccaaatatgtgagactaatgtttttataagcatttctttgcctagtctcatgtggatatgaaagtagagtgtgtgagaggtgattcccggacttcatatgagttgagatagaaacattcattgatggtggacctaaatcacaaggatgaaatgcatggagatcaagatatatgtatcactctttctctccatgtacatattgatatgttcatatataatatttccatgtgattgacatatgcatgtgagactaatgttttgtttgagtcttatttcttatttagtctatttacattgagaacatggagatgatgaatgtatgtttttattttaatgtctatatttgagaaatgccttctattcttgtataggataagctctccatgtttcatatcttgttatgcatgctcttgcttcacacaaacattttgtatgcatacatttagggggagcaaatcctataccttagttatgcatgtatctgatccaagttattcacttttatttaattgggatctttacatttgagcatatatttgagtatatgacacttatggtgttgattaatactcatcatttattcatatccttttatacatgcgatcggttagtcaacatgtggaggttgacaaccggatcattgagactaataatttcactaagttgaatgagaaaaataggttccaagtattgaaaaggtgttgacgctcaagtgatatgattacacctaaaatacaaagaataacaaagcaaagatattgaagatgattacacctaaaatacaaagaataacaaagcgaagatattgaagatgtgggatacgaagtggctactatggcaagacggtgaagggcaaacgatgctcggtcgcgatggaccatgcggtggtgaagggcaagcaaggggcttggcgctgaagaaccaaatcctgtggtgaagggtgagtgatggctttgtcatgatggaccgtgcgagaccatttgaagctacaagtaaccgcatcaatcatttgaagaatatacggtgaaacggttttggcgttggcgtcccttaagacaaaggaaggaaatagaaagaaggcattcctattggtataattctcttcctatttatatttgattataggaatgccgtactattaagagggatgcaacgtcgatgcgtttgtatatgtcccctctcggtgctcaaagtgacctatcatagtgctaccttgagagaaacccaagctttaacctatcatttgagtggttttagatcttgttcttggttgagttgggtagtcctctaagtgagctttccatagagtccaagattataaaaaacggactcccgagcaaaaagttatggtcgttttactctgtgcttttcggaagttccgaaaattatcgaaagttccgaaaatggctgcgaaactgagttttgcttctgtaaattttcggaagttccgaaaattcctgtctttgcctccaacggctagtttttgagaggctcaggtatataaactcctccaccccttccttgagtggctgttgttcttgggcaacattagacacatccaaacccaaatagccatctctatttcccatcctttgtggtgcctctttgtgaaggggatttgagaagggaagaaagttggattgagagagtgaggagttgagacctagttagcttcactccatcctttgtggtgcccctttgtgagagggatttgagaaggggagatagttggattgagagattgagaagttgagagctagtgagcttcactccatactttgagcactcgggttcatagcaagcaaatcttcgattgtgtttgttactcttggggactaaggtctcctagacggctaggcgtcgccggtgagcaccgaaggttgtggtgtgccacggaaagtttgtgaaggcttcaatttcgcctccgcaagggaagaaatcaagagtgaaaccgaggagtgcatttgtgcaacctcgtgaggaaatggttgaaataggcccggcccttgtggctcctcaacggagatgtaggatccgtggatccgaacttcgggaaacaaatcaacgtgtctcctattttggtttgctcgtttttgccatcttttatattgtgctcgagcttatttttacccgatctacttgcatgcttaattgatttagttggtgaccttatatcttgcttagatactttatttgtcaccctttgattcatatacattttatttgttcgagctacaagttcatagctagtgttttgaggagtttggttggggcaatgagccagttgaagatgctcatggatgtgacattacatgggatgatgtggatgaagctgttggtacgacacactatcttcgaggtcacaatgttccaaggagagctcacaatcgtgttggtctaataacctttcaaaggcgtcaaaggaatacaacaacaactgaagaagatgagtaaaatatgcaatctgaccaagaagaatatgaggaggatacacatgatgatacaaatgtgagtgattgtaatgaacctcccactagagtgaagagaatttggatgctaatgacaattttaatgagtttgatgatgaatactaagaggcaatgagttggacttacaatacttttgtttagagtgtggaattgtggaccactattatctatatatgccattaggcgtatgataactcccactattttgctatgtcttttgttttatttgcctgctaggctggactgcttgttagttggttatgtatttgttgttgctcaaatgtttattttgttgtctctattttttttgtttatctaattatcttgcccattatccgcgtgcctggctgcttggaagaatgaatggcagggcatcaacaaggtatgctactcaagtaaatataaacaattcattaaccatcaatcttcaattctgaatctattatcttcgtaaaaaaatatcgatgcttctaaggaggatggatactgccatggaggtggtggatgctacatgggctcatgagttaccaataacaaggtatactaggactttaggcgcacttcgtggcgcgctaccgttcgttaaagagacatgtgaaaggaccttgatgtcgcctagaggggggggtgaataggcgttcctaaaaattatcacatcacaacttcatagcatattagagtgatgaaaactttcgattcaagttggaacttccggtatggggttggaagttttggtctcaaccaaaaagttcggcggataacggaataaaaagtttatgaaaaactgaactgtttatagattttctagccgctagcttatacaagaatctgcacttggaagaagctcccgaaacataccctcgtttctcacccccaaattcacctcactccgctagcgccgctctccctcctcacgtcacgcgtgccaagtgcgatcccccctcctcgccccaacacaaacccctctctcatctctcctctctctctctctcgcaaaccctcctcctctcctcccctctccgcccccgccgccggccgtgcccctcctcctcctcctcctccggccgaagcgcgccgcccacgagcatcagctccccctcctcgtccctccctccctccccactgtccgccggactgacggtggggggcgcctctcccgcccacgaggatagaaagccctagcttcgtctctgctctgtgcctccgccgctcttcccccgctggccggacggcggctgcccctcccctcccctcccctcccctcccctcccattcgtcgctcgtcgacccctctccgccgccgaggctcgctgtcccaaggtattcctcttgtccccttcctcggctcctcctccccctgcgccgcaactctgccgtggcccgcccggccgcccggagatccgtccgggctcggctccgcctcatttctttcgctggcgatgaggtggtctaacttgccgatgcgtccagagtaggctctgttcttttgtgttcttttggttgagttgggaacccatccctccggtacggaaaacgaagcagtccattagcacgtgattaattaattatttgctatttttttttcaaaaatagatcaatataatttttttaagcaactttcatatataaactttttgcaaaaaacacaccgtttagcagtttgaaaagcgtgcacgcggaaaatgagatgggggagttgggaactccaggaaacgaacagagccttaaatccagatggatgtttctcttttacctccagctaatccgtccgcttcgttgaggattccattgaatgcttggctgtggtggagtgctacacgactgctagtagcagcttgcttctcagcaatttgggtgaaccccccacattcttgaggtatcgctgcattttatttggcagcgcatttataattgctgtcttactaaaaaaacacatgtttttattttctccttttaacattacattttatatgcatagccatgcaaagttcatggtacagtagggtctactttcaccttatttgcttgtatacctgaaaagcctgactgttggacatagccacgcaataattgtaaagaagaggttagaataatctatatgctaatattgatccttttatgttactgattctgcgtgtatttcaattgtacctcctgttggacataggcatgatgaagcaaactgtttacatttagagtgtattagagcataggaattctatcatcgcaaatggacagatggacatgctatatgaaaatgtaaaatgcattagtctggagtagctattatgtgtgctccatttcaaactgtatatgtggtacttattctggttgactcatcatgtgcagtgttatctattttcaccaaattttaattttttaatagccaacctgtctctttgacatgttgtatccgtcaatacaggcagtaacaattggatctacatcttgccactacaaaaggatcaacgatctgtactagccttcatttgtgggttcctcattgggaattgggattctttacaatggcagatatgagccctaggacagatacatcaacagatgataccgatgataaccacatggcaagtctttctttctttcttttttctagactaattcttgttaaccttgatatgattgggcacaaagcatcaattgtccagtttcatgtttggaggaaactactaaactattatactaattatcattcaaaagtgagaaagagcatcaattctagcaatagaaaattaaaacagcaaggttgtctgacgaagtaaggatgtatactgtagaggatgttttatatgaaaattaggctatcgttgtcagctgttcagtaataatctccaaaattcatggaatatgtatatattgaaacgttcagtatatgttggcattctctacatagaaagttagtttcatacgaaaatcttgttatcagagaatgccctttgctgcagagtttgatatgttggcatttaataatccaattgagctactgagcaatgcatatgtgctgtgcatgggacctacacataggtctatcaaattagggactaccagaaaacaatataaacagttgggtttccccattaagaaagctggcaaagtttgcctatggcacgtttttgtgagatttgtggaattcgttcatgcgatttggatccttatgcaccttgaattcgcttgagttccttgaatacattttgtttgatattttatcccttccaatagcttgtgtaatttaacttttggtatatagcatgatcaaaagatatagacacgtttattgaaaaatatgaaatgcaaatcgtaacaggcctatttataagttgcgtaatatgataaagatgtgggcttttttgcattgagaaatttgttatggcagaaagtaatttaatagatactaaggctgtgttctttcccttaggtgttacggagattttcagtgcatgcaaaacgagaaaccattataaacttgaaaaataacaatttatatatagattttttttttgcaaaaaaaggcaccatttaacagtttgaaaagtgttctaatggaaaatgaggaagctaaagtttggagttgtgcaaaagaacgtggcctaagtaataggatgcataaacaaaaattacatgctaatgcctgttggtttacaaaattaaagctaagtgatcaaattcatttttttgaatatgttttagtccacagacatttcaaaacaaactgatctttctttttcataaaagttggagtcttattcatttttttatgtaaaacatcaggaatcaagaaggtaaaattcattattatataaaataggaatatcgggagcttgatagttatgttgtcacctgcagcttgaaccaggtcagcttgctcttgctgctgcttctgactctgacagatccaaggacaaacatgaagatcaaaaggtaaaattttgcaagtagctctctcctttttgtttcatattatcgttgttgcaacaaatattttccttatcactttgtagacattgcgtcggctcgcccaaaatcgcgaggctgcaaggaagagtcgtttgaggaaaaaggtacttgtgttctgctgtagcttttatactaaagaagtttattccttttcaagttttgaaaattgatggtttataccatgttctatttttttcattctgttactaggcattattaaactgtattcttgtattaggattccactatcatttctactagaagatagcatgcgttgcattgggaacttctatatcacttgcagattcatggaaaatggaaaagttttgccaaaattctatggggaatcacttgcaaaaatcggctgggtatgggggtaaatagttcagacagacatgtgcacacctcaaaaatcagaaaatttgtttgttgggcaacatgagaaacgatattcccatcataatatataaggctgcactagatgtgtacatgtctaggataatgaaataatcaagttagtaatagtaatgaattttattgaaaggtagaagatacctggttttaacttatcatccatgcaatggagtctagtggctactcattatttaaacacttgcacaatttgagggatgattattaaaacaagtagtacatttacagtcttacacactatatcagggtaaaccgtcagttgagttggtcagctggcttcatcaatttttggaaaagtatgcttgttgctccagcggctgagctagcaaaataatttattacctgcaattagaaacacaaacgagaataaggatgccacagatgttctcttacctgttctgtaagctgattcagattgattgagctgacaccggccatgattcttatactcaaatctgtggaacaatccacacaacacaaatatacacggttcaatttaattaaggcatgtagcttggcagtgaaaggccacgatggtgatgggtgatcataggcatctaccatcaggttggaccaccagagatgatctctctgctgatgacgtgtactaatctacaatctatgagaactaaacatgtttaagaggatgaagtaacatatttaaggcattatatgcgtgattgcctgtccttgctggagagattggatgctggtcgggacatggcagagagctccaaggtatataggcatgcaagactgcagtct

SEQ ID NO: 79268 - DNA, 7891 bp, Oryza sativa
tgttgcgcaatttcatatgttaagtgaggtattattttgtaccttattcgacgtattagtactcggataatttatataggcctatcgcagtctaggtcgtagaaacattatatggacttaaacaaggagaattatgtaacatgaagaaatagtagtacaatttaaacatgatacaactatttgcattgcggttacatagatgatattagattcgaactaggagggaggtagtgcaatagttgaacacaacgacgatgtaataatgggacaaggaagcatgacagtagaaatttcaatatgccaagttgtccgataatagctaacccctacgtgaggatccctctcctctctcaaaccgcgctttagtaacgctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggaatcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatacgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgccacgccagtttggatcctcaacacaccggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacatggtggggtatggtgggtacgcttgattggcaccgaaagatacatgcatgatcggcgccgaaagttacattggtcgtatgcgccaaatggcgggcaaatactcgtatcacacgcgaataaaggaggctgcatcggtgcagcagaaagtagtcgtgcatgcgccgaaaggtatcgtgcatgcgccaaaaggtatcgtgcacatataacaacaacatagtcattacataagcatacagtactggaaagtgaagcaagtaaacaaaaagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacgtcctctgtcgagcctgaagcgaagtcgaagtcagtgatgtcaaagagcacggtggaagacaggaaggggtccgacgaggtcccagcatggtccagtggtggaccctgactcgacgtgccggctgcctgtgacgctgaccctgcagcctgggagaagtgggcggcctgcgtcatagcgaactgggcgaaacctacacatcgacaacgggacccttgtaagctaagacataaaatgtatgtaaattgattgtggaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacagaagtagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatcagcgtgtacgtcgtcaggtgctcctctacgggtaccggaatccccgcgtctaaacgttggatagtcgttgaaccgccaacgacgacccggttgatgtcgtcgacctgcatggttaatttgttcgtaaatattcgtaaaatttgacgaagagaaagacatgaaaacataaaggaatggtgcgatgcagggtactcacaacacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgactgctgaccctcgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgcggcactgtagggctcccacacgacgtcagtcgtcagaaggcggtcgaactccataacaaactcaggatacgaccgcctaacctggacgtgagcccatcggcgctgcaatacgagacgatcgatgtgatacaatgaacttagcaattaacttaacaatacgataagatcgatgcaacgtacctgacgacggaaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcactgtacagagcagccaacaacgcggaaccccagctccactgaggcacctcgcctaccgcggcgtcggcgatgctcgtggcgtagtgcacgagtcccttgtcgaccgcgtgcccgtgaccgccacagaacatcacccagccaaaaagccagagcaagtacgcctccaaacatcggctgtacgagtactcatcggcctccgcctgtagctgctcaacctgcaagcagtcaataaaatgttaggcaccttaactgcggactaaatatgtaatacgattgtcatttcggtacaaaaacactcacggtgaactgaagcagccacctcttcgtaggtccggtattgcggtggtgtgccaacggctcgagcgggaggtgcggtgcgcgctgtactagtgcgaaacgtgccgtcagatcgtcctgccagtccacagccgtggtcactggcccaacagcgtctcccgcgagcggtagccccaacaagtacgatacgtcctatagggtaggggctacctcaccgcacggcaagtaaaaagtgtgcgtctctggcctccatcgatcgaccaaagctgctacgagggacctgtccacagtccatcgtctggccgggtccgcgtcgcaggccgcagcctccaccagccgacacatcggtaggaggccggcctcacgtagcctgcaataacaaattaatatgtcattataaaaaatattacagtgcaactaacttatagtaaaacattgttcgtacctctcgacaaaggagtcgtgaaccgtgagtagctcaccgcacgtccgtgcccggaacgtcccaagctgagccccctgcaccgcagtaaggtaagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatgagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtaaccagacgtggcacgacgacgcctaggacgtggtcgagtggaggtagtgccttcacccgtagggcgagctccatctgctgctgatcctgataatcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccaaccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgtatctggtatgccacactccgctgcggcagcaatgacatgggtgcatggcctgtggagcagcttcggctttgcacaagagcaatgacatgtgccgtcgtctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctagaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggttgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcaaaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcattctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgtgaccggttcgacttggcaaccctaaactctctatgaagtgacactgcaaaatgttttaccgcctccttcatatcttctgctctactataaatcgctccctgaataaccttattttctttgtactcccatctcacactatcctcttcagagacgatcagtccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgtccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagtttaacattgattgttatgtcacttgtctgtggatcaactctcaagcccctcattaaccatccttttatagaaggtacactcctctcagccggtctctcaattcccctttctgttacaataaaatctaacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctataatacgcacttctagattagtacaactaaaaccctaaaaatataatgcatttattcaaacaaatttttaaaaaatacacactatttaactcaatagtcacatataggatctatgaatattacctgaaatcggcgtctgaatccggcagggcttcgccccttcttctcttctcctcccctctcttcttttttttttcactggaattgaggagagaagaatgagggctgggggctgggcaacaggccttttataggcagtgaggcctgccgcccggccagagggcggcaagggg

SEQ ID NO: 79269 - DNA, 12377 bp, Oryza sativa
gagcgaacgaacgtgaacaagaacgagcgaacgaacgtgaacgagaacatgaatgagcgaacgaatgtgaacgagaattgaacgtgaaagaatgaacgaacgtgaatgaacgagcatgaacgaacgtcaacgaacgtgaacgtgaactaacgaacatgaacgaacgttaacgaatgtgaacgtgaatgaacgtgaacgtgaaatgcaatataggcaggtgaatgaatgtgaacgaacgaacgtacgtgaatgaaacgtgaccttaacgagaacgcgaacgtgaacgatcgtgaacgaaacgtgaacgtaaaatgcaatatatgttacttcgcgtttatcctaatacatctttttgtatcttgcagaaaagacgttgttggagtcgtccctcaagccggagtggtagctagccctcgaaggaattcgcgcagacaagtgacgtaattatatatatgattgttatatttgtaatgcaattaagactattagatttaatatacgacacttagacttagttttaatataagattattatagtttgtaattagactttagtatataatttattgactagctagggtcctataatatacgtcacctagacttagcatatatcactatttgagttttaatataagattattagatttgtaattagacttagcatataagattgtgtagggttctaatatacgacagttacacttagcatacatgactatttgagttttagtataagattatttacgttttaatataagattattatagtttgtaattatacttagtatataactattgactagctagggtcctataatatacgtcacctagacttagcatttatcactatttgagttttagtataagattatttaagttttaatataagattattagatttgtaattagacttactatataatttattgactagctagggtcctgtaatatacgtcacctagacttagcatatgattgttagcatataagattgttaaaacataaatgtctcatgacttagcagctgtttcatgtatgaacagatggctgatcgcgatgaggaacagatattgtatgatacaatcgcggagggaagcagccagtactggaacgaagaagaggggaacgaggatccaaaccagtatttgaacgaggaagtgcagagggatgcagaggggaaccaagaggggcacgttgaaagggatgtggaggggaaccaggaggaggaggatagtgcaagtcaaccctccgctggacagaagagggcacgcgggcaacgaggtgccgcgaagaagcttgagggtcggcacaacataacggaagtggacgaagacggccgacctagtgccccggcagaagccgccaagaactatgtacgtcatagcggttgggttgtgcgggataacgtgcctgtcagtacggtatactggcgcagaacaagggcacgcggagatcatgagagctttgtcccagattcgaagaaagagatgctgtggaccacaatgctcgagacattcacccttcccgcgggtacagaggacaaagtgaaaaggtggattctgaagaaaatggcagaacagtttcagagcttcaagggagatctgtaccagaaatatatcctgaaggggcagacaccgaacttcgacacattcccaaagctaagggatcactgggacgagttcgttgcatataagacatgtgaacaagggcaggcgatgatggaaagaaacaaagaaaatgccaccaagaagaagtaccatcaccacttggggtcaggcggctatagcgtcgcgatgccgaagtgggaggagatggaggctagcttgcttgagtggggtatcgaaccggccaccgctaattggccggaccgatcgaagttctggtactatgctcatggtggaacgctcaacctagctgatggctccctggtcttcggcgatcagatacgcgaggctgcgcatcgactaacagaagcagtggaagcctcttctcagggcacgttccgaccggacagagagaaggacgagctgtcactcgccctgcaaactctagagcatccaggacgaacacgagggaaatgggtgattccttggaagattgggttcaaggaggacatccacacgtacaggagtcggatgaggagcaagagagataccgaggcgaagattgcagatctagagttcagggtatcgagctacgagctcagcatgcaacaggaggtggcaaggaaggttgatgaacgcatggccgcacatcggtcccatgatccctagccgaccattcctcctgcaatggtgagcccgtcaggaaaccgtagcagctgcgcctcaacgaggcaggtaggatcacagagcatggacgccatgcaaacccagcacgaaaccacctgccccgttgatgacatcactcagcggacaccatgtgagctgcatattcccttcaagaacttatcaataaaggtaagctcgtagtttatagattttagatttggccattccgctagttgctgcttatatatgttgtttactaataaataacctctcaccacatgaaggtggcgtcgggcatggccatcccaacggacccttcaggtacttaccactgcaggccgattccagcaggatactccaaggtcgaagttgagttggtcgaaggcgcgtacgaggacctcgaggtggattaccctggaggagatggtgagacgcatctacgcgacacaagccacgccattatactatggcgcaagcgctacatcatcctccctgggcaacaagcggcgtctcatgcaccatcccctccggctcctgcaccgtctcctcctcaggctcctgcaccgtctcctcctcatcagtctcctgtaccgtctcctcctcaggctcctacaccgtctcctccttatcagtctcctgtaccgactcctcctcaggatcctgcacagactcctcctcctgcacagactcctcctcaggctcctgcgtcgtgtcctccagcaccttccaagtcaagaactcaccaagcaccaccgcctgcccgcacaagggcaacgaagaaggcgaaagttgacgccgccgagaacaaggagccaccgtacgattgcacgcaacaggagcttgacgcttacgtggaagcagaagtgaagagacaattgaagcctcggggtccagaaaagaagattcctatagacccgagtgccaagaagttcttcaggagtatgtcggcaccagccaaggaggccataaagctaacggattatgagcgaacacttaagaaagcatcttctggaaagtccaaaccagtccctcagcttggagagcaaccaaaccaggagatcgagccgttggtgaccggcgaatattttggaatacaagaatttattaatgacaccgggctaactacggatcaattgctaggagacgcaccaatcaaaaaggcggaagtgaaatacatgtacgaactcggtaaatcgcttgtcaagcctgagctgctgcagtccctacccacacaaatgtacaagttccatcagctgtacatggagatgagcgcaaccggtagagagatgatcggagtgaggattagggacacggacttcttgcaaggagatgacattctctggatcaatttcaggggaatctacgaactataccagctggacgcccttgatgtctctattatgagttgctggattttgtaagtatatcgttcagttagatttcttactacgtctcctttaattaattaggtccttgtatataagtagactatatataatatataatcccttttatcgttgtagaatggagattcaaaggggcccgacggcggggggttttcgatactggattcatcgaccctcggaaagtaaacgtcgcaatgctcgaccaatacccgcaagccacagaggacaatctcgtccatctcttgaaggcgcagcattacaagacgttcatactgttgttgtacaacacagagttagttaattttactgtcttcctataccaaatttcattctcgtacgaacattctaagtgtttcatatgtaatgcatcccacgcatattgcagattccactgggtgcttttactcttcgacctggaggcctacaccgtcaacatatatgactcaatggataaaaaagagtctacgttcgacaaggttttcgaacttatagacaggtactgtcataagttcctatgtgttaattaagaatcttgttatagttaattgctactacgaatcatagctttaaactccatgtagggcttggtatcggttccgtcatttggtccgcggcaaatggatagaaagacttaggcggaagttcaattttcctgtgagtacacatgctctacatttatatttctccgattcaaatacatacaagtgtatattaattagatctctcgtcgtttgtcatttatttatagtgcgcaaagcaaaagaagggaactaacttgtgcggctactacgtgtgcgagtattgccactgccttgcaaaccaaatcatcaccacaagagagctcgacgtacgtacaaataaattcaaattttcattacgtatcgatttgttgtttaattactaatcaatttcatacattcatatagtttattcgcatgagggataacctgatcacacacaaggaattcatcgcggcggttcaagaacaactcatgggattcatcaacgaacaaatccttgatcccaagggtgaattctactacgacggaaacacaattcataggtccttagcttctgagctagcgactactactacgtcgaaatcgtagctagctaggacatataatggattgtaattaatacatgactacatatgtttctatatgcatgtgtacacattttctataatgtaaatatatatatatatacacacacacacacatattatatatattatatatatatatatattatgcatgtacatatgtattgaaacatatatatgcatggtttatatatatatatatatatatatatatatatatatatatatatacagggccatgaaaaaaaaggtcagctcgatctttagtcccggttggtaacaccaaccgggagtaaagatgactcagttgatgttaccaaccgggactaaagatcgatctttagcctcgggtatttcacccgggattaaagatagcgatctttagtcccgaattggtcgtcccggtttggaaaccgggactaaaggggggttacgaaccgggactacaaatgctttctccaccagtgggtgaatttactctcacgttagtaattttaaaattttgtatataagctgttagaattagtaaaattaaaacaaaatattttttatttgttgctaccgattgctttaccttttgttaaaagattgtttaacattttctataatataggatattaacatggttaagttacatgtttccagttttaaccaatcacactagcactaagggcgtgaataatggtacgatcaccatgtaggagagaatgccacacaatatatttttttgttgtggaagtgagtgagaggagagagaatacgtatgtctattaattggtagacatatatgctagacacagtattttagatagatagcttatactatatatgcactccatatacaaaatatagaaccaaattactaattataatgtaggtaatatgctatatgaattcttttgtatatcgtgtaaatatgatatgtgactattatagggcaaccactctctgaactatttttcatgtttttattgggacatttcacaccaacattcctataatagtatgtaaatattgatattagtagaactactatatttgtcagtttttaatatttgtttatacttatcttttttatacacaaattttattatttgttgttttatttttaagtaatatatgaatattataacccaatcaaagtgtgtgcatttttttctttattctgttgcagactataccatactttctcttttttgagaaatatatgatgtgtttgtttttaaaatggcattgacactaaaatttgatcatcaatattcatacaaattatattattattaactataaaactaatactaatttgatgccacaaataattgtatattagaccaatatggtttgatttatatattttttttattccaagcttgtcatatgctacaatactcacatgcatgggttcagctcacaggttagccataactgactcggccagcacaggcgcacgggccaatgtggctagtccagctgggatgattgattttttttatagaactgggatgagagattaatgaatgtggttggcccagatggcagggacacgaggtgagacgacatccagaagctgctgttatttttgttttctaccgcaggaagacagcaatacatgcgcgagacactcgatcttttgccgaatgcttcatggacacgtggcgtaaaactgaatggggtaaaacgaaccaatcagcttgcagcggaaaccgccagctttagataatactagtaatcttgtacgtgcaaggcacgttttgacactatatattagtaaacgaagaagaatctatgcaatcatttctatgcaatgcactccgtataaattcttctagtaattaagacaattttacatagactatactaacatgataatttggatggttctctataaaaaccactattttgaatcactacttgcttaccaatgaatgtaaaagtatttagcgggacaaacacaatttatactgtgatgctgctaccttttgaaagcaaacaattaatgatcaaactcttaacaattttcagctagaagtgaaactgcaagtaaaagagaataactatcaaggcattattttcttacagaattatagttcaagtgctaaagggaaaccaggatgatatgttgtaaatgcaagaagtagctagaatataagaaaactacacagaacaaaaggtacgcaaaacttctgttagaaaaaaaccatatatatacttgatacatgtgaccgagactattgtgagtttttctcaagagaaaatgaaagaatacatacatattaacaatcctgaaaacaaattaagatgactaaattatatattcatgtataaaccttcatctcacttttactttcatgcatcaaaacgctaatcaaattcctaagaccagtataccacaaaaaagtatgcacactagacttctgatcaagacattttcaaggaggaattgcgagtacacatgcaaaccacagatgttctcggcaacaatggagatgtcagtcgatggtcaacaaacaatgaaatgcaataagaaaattatgtattttctaccagggagaaaaccaatgcaccagctttgagcttggctagcaggtgaggagtttgattccatggagagttggaggaagagagacatatgttcatagatggcatcaaaaccaacataataattaaattgctatttctttatcactgtggttggaagagaaaatttagcttgcaacagcaaaggcaacatacatctcaaagaacaaaagaaccatcgctcaaactccagcaccaatgagctctgcatagggaagctcttcaatacaatttcctgacaaatttataggcatgacatatgaagaataggtaaaatccttatataatactaacttggatttgaagaatgtcacgatagcaactccacactcccctatgtgcgcacaaaagtacaacagaaatattgttactgcacgaaaagaaatccccaatccgcgtatgccctattcaagaacattttaacttcagtataataaagacaatagtacacaaaaaccattttggagtacgcctatacagtatcacaaaacaatggatatcattagacctatatataacatgacacttaatgtatttactaaatattaaccaaattgcatcgatttgtgtagtgatctaaataaaccagttcatgggtatagcagtaatttcagaaaactgaaggcaatatcatctagctgcagcaacattctaactttaacaccaatctttttacgtttttggaatatgacaagtactgtatcaagaagcaatggatatcattaaacctacatataacatgagacttaatgcatacacctgaatagtgaatactaaccaaataattaaattccaaatcgcattgatttgttgtgtgggctaaatcatccatatgttcagaccggtcgatttcatgaggttggtacaggatcaataaagaacatgctgcactgttaaaattattttgaaataacttaagaattgagtcaccaacattggcattggcagtcatcaactgttgttgttgctagctgagaaaattgccacccattgaacacttgctggatgaaaacaaagtgagttttggacgaactcatcagaaacacattacaaattttcaatgattttggatcctgtgagttgattaccaacatgcgaggaccgtactgctaaggaatagagagcttgagatcctcattccagatagggtcaagttggctttgatcactgtcgccactaagattcctggcattccaatggtccagttcagaggaagaagcctgaaaccagatgtagctaggtttgtcatttcatctgagcaatgcatatttgtatcaagtatggctagcgattattgttggagaacaaaaacatacatatatgtggatcattcttggacaacctctcggctgtcagctttaagcttaccacaccgcactgcgtggccggtatgcgaacatatcctaattaaaacacacaagtattaattcagaactgcaaaaattaccatgtggcccttttttaatgcagcactccatataaattcttcacgtaaaaaattgagtttcatagacttgttgaacacaacaaaccttcaattagcaaccagttgatcattagagcatgattaagaatcaagatatgtgtgcagcgtttcagggtaaatatttccaatccacgtaacattgcatttgcaactgatggttacataatgaatttggtagaactgaaaaaaacaggtcataatctaatacaatcaccttaagaaggtgcagactgcagcctcatcattcctttattttttatgagcactatgctcaataagttttaggacctaggataggaaaaactccccttgctgattcatttgcatccattgccaacaatggcatatcacagtccaagcatttatttgccaataatttaagaactcggcaaagaaagtaagaatcaaatcaagcaagaaaggaaatatcgttgactacttggctcatagcacaacaaagtttcagttaataattagtgcatgaagaaagataaaagaacaatcaatgtgcctgtgcttaccaccatggtgagtgagaccaacaaatcgaagggcgcggccacgacggtaatcacgaaagccaatagagcaactcagtcatcagaagcagtcggcagaccaccaatcacatgaaggatggaagaagcaaattccatatgtttgtagtcagatttctgaaattttccattaagttcagtgcagtaaacattttagatactcaaaccttatatatactgatacatatttagttgtttatatattgcttaatatcttaattttacaattcatctgcacctgtggtcagtacgtgtacaaatccagctggtttgcacatgcatctgtagattactatataactcatatagaaaagaaatggattagggaacaacatgcctgtcattggctcgagcagtctaaatttcaacagcttttcggacttttcctagcacaggaattgcttcaacctcagtccttttgattgctctactgatgtttgtatacaagaagaaggacaggataagaaacatcataagtcgtgaccagactcataatataacagatatagaccagagcacatatatgaacaaaatgaagaaggtgtaatatattccaacctggtccagaacctgcaattgttagtaccagatgattcagatgaatatacctatcaagtatcaacaggagtagcaaatatccatagaactaaccccagcttgagtgatccaaacaagtcgatctggccatatgggcgagggcatgcactggaatgtgacaaggtgtggcagcagcgggggatcgacgacgttacttgagggtgagaagggaggagatcaccggcgaggaggcccatgcgatggggaaggagcagggagcccggcgagcttcttggggcgccatgagtgacggcgatcttcctgggtggcaccatggggtgggggtaggcagtgggcgacgaacggcgctcgagctccactgagccgtcggagtagagaggatgcgcaaagaggggatggccggcgcggcggagggggcggttgaggtggagtgggagggatgacgggcgacggcggcgcggtgcgttggcaggggagaggtggcataatttttgggtgagccgtggtctgcgggaggagggatgggaacggggaggagaggctgaggggagaacgtggaataatctgaaccgttggattcgttgaatggatggatggatggtaaggatttggctggttgatttcaccagttggattgcaaggggacaactcctcctttttatattagtatagatataagataccgaattctaagaggatttctcgtgcaaaaagcccaccgccagctttagataataagataccgaattctgagaggatttctcgtgcaaaaagccctgccacgtggcacatgtggttccaactccccctcccccccccccccggacagtcgtgcgatcaggtttcattagcaaaaagttaaaactccaatgataccgacctaggcaccccaatccagctttcttagtactagatgttggggcgcgcctttgcgcgctgcctgaaagacatcaacacaataagttaatgatccaagaaacaaatgctaattatacaagaatggcttaagatttggtggaaggaaacaaattcacattgggagaggctagaaacaactagggaataggaaagcaaaagtgaaatgaccaaagaatgagctggggtcgagtttgatatctacaacggctaggtgacgtcatctagccattactcacatatttgatatgaaatactgcctggaagttccagtcctgggcgctaggaactttcggccaacacttaggaaaattctcttccactcctaggcccagaagttccggccaaagcttccaaaacttccaggtaggattctctgtcttgggaggggctattttcaaaaaatagctcccaaaaatatttcactaagaaaatatggctaagagcacttaaggatcctcagaaccacacatatgaaacccctcttaatagtatggtttttcccaaactcaaagtgtaaaatagagctagcctaactcggctccggttcttctgaccactttgaatttgatgaattggggggttgtcgacgtttgagatcgcgactacggtatttgcatagtatggggatcgttggtaccatggtatatgcaagattgaagtaaaagagatgcagacaaggatttttatacaggttcgggccccttatctgacaggtaatagccctactcctgttggccaaagccggtgttgctcttattcattataatcacaccagtacaatatttgggataacacatctagctgtcatcgacttagcggcatggataaccaacccgtagtcgacgacagcgtagttttcctcctcaagcacgaacttgtcgagatcagagatgacgctagatccctcttaccagcctctgtaggtaccggatggggtatgtctaggcttatctctgacatcgatagctggcggcgtgtgttggcttgtgtgtatgttgtgttggtcttgtggcttgtcccctctcctcataggggggcttgtatttatacccatagatgtccctttgtccaagtagaactagggagaccaacatggatacaatccaggtagtccttgtcgttttcatatagaactctgttcgtccttccttatctggaactccttttatatacaatgtatgattccgtataagacatgttatgtggtaggccctaccgagcttagtcaactactattaggtatgtggtatccataaccatgataggggtctccacgcgtcctagccttatgtgatcatggctactatagatacaatcgttgctcatatcatggatgaacaaggagatatcaagatcaagttctccatgtgctggaatccgatttagccacatgctacactgctgacttcaaacggctgccaaatctgcatacgacctccattttcagcccatgagtacttgatggaaagctctcggagtcctctttccaatggatcc

SEQ ID NO: 79270 - DNA, 23489 bp, Oryza sativa
ttcagtataccacatattgagatcataggctagtgaagtcccaatcaaaatgaacaatgtggtcaaagcctcgcagttttgcaataggatactctcatctatacaataagtatgatctgcaaaatctaccatccgtatgagcagtaccagcaattacgccaacgaaattgcagcataataataacatcacaaaaaaggaacacattagacgtcaaaatcgatgcacgggtggcgattctccaaccaacacacaacaacagagcaaagcgcgcgtcacgcgagattggcccgtaccttgaggctctcgacgacgccgggcacgacctcgtgctcgagccccgagtactccccctcggtgttctccctgatgacgacgatgtcgacgtcctggtgcctggtggggaggccggggaagttggagcagttgacgagcgaggcgtagaggtcgagctccttgcggagctgcatgttgagggaggagaccccgccgccgacgggggtggcgaggccgcccttgaggcacaccttgttgcggcggatggactcgatgacggcgggcggcacggtgggcatgtcgccgcggacctcgtaggtctcgaagtagaccggcgcgtgcatcacctccatcacctgctgcacggcccccgtcacgagcggcccgatcccgtcccccgggatcagcgtcacggcgcgcgggttcccgtcccctggcctgggcatgtaggtcaccgtgcggcgcgcgccggcgccgccatggtgcgccggggcgggggccggggaggagaggatgcggcggaggaggggggcggatcgccgcgccatgggtgggaggaggaggaggcgaattgcgatcgggaaggcggaggcgaggcgaggcggccgggaagagaggaggaaggagaccgggagacttggagaggggaagaggagagaggaggagaaagggaaggcggagatgtgtactcgagttgttttttgcggtctaatcccttggagatttttgtatttggagaattgcatttcgaagttagacttctttcacaagaataatgacgaggagtccctgccaaatgggcccatcaaaaggccaatctatatttatatatcccgtaataatttaatcggcaaaaaacacataaatgcgtatcaacttgcagaacataagttgagcaatggaagagatgagaggtaaactattgcttgcgtgcttgctggaatattatttttttggttcagcgaatgtatcgatcaattgccactcaatccatccaatattccagtaaactaacctaacgcctatcatcaactatcagttggagactgaggtctgaaggtagcaaatttgggcttttgttagataataatagcagagagaacaagtagaatatggaacgaatttgattcgctgaatgccacaaaagataatacaggagtgtagtatacttcagccattaagatggcagtttcaaaaacgataacgtgtgcgcctcgtctttttagatttacacaaatgtttccacaatttctttcttggtgtctaccatcgaatctgtttacaacgaggagcgagaacaggattgtcagccctgaaagcagcttcttcggctcgagattatactcaaggctcatagctcccaacttttcttataaccaatgcacactagcaaagaaggtgagaagtggtcagcgtgcagtgatagactgatagctagctttaaaacattgaagaattgaactgtactactactagtactagtaacgattcacgaacacctttggtaatgttggcagcacaatggaaccttacaaattaccatttcatacataatacaaagtaacttgctcacaatgagaattcctaaagagatatatacagcctacgcagggatagagcttctactaggctagcaagatccgtatgctctcacccgacccccaccccaatgtttgaagatttttatgattagtacttcatatatagtacataattgggtgcattctcttgttaattcctccatctacttaattgattttattatttttagagatatttaattgtgaaacaagtcgctgcgattagagtgtagaaatcaagaatatataatgaagaaacataagtatgcggtaatgttgtaatttagtatagatgcttttgttttagagctgctgtactcatgtattgcttagtcatgtgttttgtataactccaatgtctataaattccaaagaaccgcaatcttattttggcccctcttgagatttattagttcaagctccactattgtgtgtattgcttaacagcaaaaataattatcagcaaagacaatgcccttataatgcattttaaacaatcgcatgcatacagatagtacaacaaagatgggagtttatcaaatggctgattctatcaaataattacacttacagtcaaggaataatcactataataaggaaatagtgcaacaaaatgagcagccaaaatagtttggcaatttggaatgaacaaacagaaccttattgccttaatcttatcagagtaagtaacagggtaagtcagcaagcatataccttgttgttgctgagaacaaatcactgtccttatttcaatccagcaacctttttcctgagcaatgtattctgtttttcctacaaaacaatatcagaatacagatcagaaataccacatcaaagaataggctagttgttactaacagtagcatatctaaatgcaatccttgcaaaatttgtggccaggcatgactggatgaagtagtagtaataataataagacaacaataacatgatatagaccctgttaaatttgagttgtattataatgtagttcaatcacatgcctatgcaagatgaaaccatatatatgtgcagaaccttaaattctgcgcacagccaatctggatttatcattcaagtattcaatacaacactttgtactgtttctaaagcccttttcaaactaaaaaaacatggataataattatgtatagtccaaaggccccaaacaagttgcatgctcgtgaccatattcatttaccaagatcagcagcattccagggcttaaatcgtgattttgtggcttctgagcaaccaccaaaaagggcataactgctataactgattcttggaagcatatttttcaattctatttttagctttttatatatcataatttattaataatttaatatgagtcttatattgctcaaagtttattacgaagtacataaaacaccttttttacacataaagcatgtcaaaagaaaagaacaacgggtcttaaactcttaactgacagtttagtatcaattcacgtgaaattaagggtattcgagctacaggatttctcaaacagaagaaaattatccatgagaaatacagtatcagatagaggtgctatagctatagcactcacctgtactgctaattgcaattttagttgcctttgcagcttttcacaagatagatagcagtcaccgtctaagaaatgtgtcatggtactatggcggactatctagaagactagaacacagcagcactcaatctcacttagacctaacttgttcagccagactcaaccaaagcagactgcctcctggcaatcagaactgactcatgatatggatgaattacctctttaactattagtctatcaacaagcaagtaaaaaaaacagcactagttaaattagaaatcacaaatttcagatttatacatggttttggcagagctgtcaaggcatagtttcattcacactaggaccaaagtagagcgtggattatacatgtggttactcaaaactcaaactatgcaatttcttccatctcgcatatcaccacagtaatccagcgaaagagctcaccaccttattttggcttatgacaactcaaatagccacacttgtagtcaaaacaaaataatacaacacattgctacaccagaaataggtgttctaaaaagatgtttggtgaatgccttattaactatttagacctcccatagccacttggatcctgcagacctgcatggctggattcacgccctgctccaactcttcatataccactttatctcagcctcaggagatcccagactcccagttacccagcatatcctagctaaatcttattttgaaaatttccttgaagtgggcgatgccacatagcagattaagaaattaaagaagggtaatacaatctgcttccttaagcaaacacggatattcaaaaagaaaattggtttcaggaggcaatgttattgcgttaagcagaacatgaattctttggaaactgatttagcctttctatctagaaaatatttcataccccctctgtccatgatggcagattcatccaaattgttcgatcgtttcttctattctgatgtgaataaatcttgcctaattcacataacagaaatattgtttcaagttagcctaacaattgacacaggatcaatcaatttgtccatagagacaacaatatactccaaaaggcaaaattctgacaacacaaaactcaggatccaacaatcacctgatcgagcacgcgttcgttggtccgctcaacctgccgagcaagcccctccagcttccttagcatcccactgtacatctcctccatttcggaggtcagcgcagaggccgaggtcaccattgcccctaccctctccagcccgaacccttctaccatcccatcaagcgccttctgctcaccaatgctgtaaccctgctttacaggctgctccggcagcgacggcaacggcgactccggcgcgaaggcgtggtactgctccctgaatccgggcccagcgttgacgacgctgagggaggccggcacaaggcgggagtcaacgaggaggaacgcacggtagtcgaacgagtgaacggagaggccagcggcggaggaggatggtgccacgaggaggaagacgagcgggtgggcgagcaccagggtcttcgagagggagcgcgcgagggcggcctcgcgcatggaggggcgcagcggcgagcggcggcgggaggaggagaagaagccgatggcggcggaggggtcgggggagtaggacgacctggtgaagcggccgagcggatcggcgagggaggaaggctgcgcgaccgaggcgtgccccacgacggagatggagagggaggggcccgaggaggcgcgggcctggtcgtcgtcgtcgtcgtcgtagaaggacgggggagccgcggctgcgcggctagccacgccgaagaggagcccgtcggagtcgccgtcggccgagccgcagcaggcgagcagcgccgcgagggcggcgccggagacggagagcttcgcggcggcggcgggggccatcgccgtgagatgggattttctgggggaagctttctgttccggagttcggcgaggcttttccgagacgtgacgggcgagacgaaggtacagcgccttccagacttccacggatgagtgatggcacacgtgggctactaggctgggccgtattgaattctttgtttttcatttggattacgtctattttacctccctcaactcttgctcttgattgaatcgcctccctcaaccgcaataccatatataaccgccaaattgagcccctcggcggtttagctggtgctttggtcatatgtggcatccacgtggcatgttgactacgggccaacgttatagagcacgttgttgcctgccagagtagcttatcccgcggtggtggtgagcgagtgaaaggggaagatgacgtgaggctatggttgtggctcggagcggattaggggaaagcggacgctgcatgagggacggacacacctatagtggaggtgtgtcactcccgtgatcggttgattgtgccaccagaaccatcgtttaatcctcatgcctcctcctccgccgtcgacgcctacatcatcctcttgccgttgccattaggaaaaagggagataattagggatagggaaaagaagaggatgtgttaatgatatgtggggtccatcgtttttttattactccctccgtttcaggttaatggtcaaagtggaaatgacttgtaaatgagaatgagtggctttatgaacctctttgtaagcacttttggtagtgcaacctccggatggagtatgcttccagcaaagtttgtctgggtcttcatttggaacaagctgaacattctgaatggcttggattgcttcttggtcaaaaatttgttgcagcttttgtgtcccattttttgttctcatcccataattctgcaaccttagagggcaagtgcatattaatagcccgagagtttaaatgattatcaatgttttcccagattgaacatcaaggttgattccagatgaatacctgaccttgagagagttgccaaatagttgaagaatttagaaattttctaactttaaggatagaggaccagaaggcagatttggaaatgttttcattagctttccagaaagaggtattattcaaatattttgctttgataatagtagaaactagatcattgggattactaacaattctccaagttgattgaataagaagacttcgattaacattgagcaaatctcgtatacctagtcctccttggtctgtaggtttgcatataccctcccacgatcgccaacaaactcattttttactgtcctcagtttgaactcctgtccactaaaatttcctgataatagttgttagtttattaagcaagcatttagaattagaatagtggacatatataataaacatggatggaagcaaaagtggacttaataagagagtgcatgagaaagtttgtttgctttgatcattgtcaactttgctctaaatttattagggggtgtttagatatatgggggtaaagttttagcgtgtcacgttggatatacggacacacatttaaagtattaaacgcagactaataacaaaacaaattacagattcgtagtactagaatatatcatatctctccaaaataacttatattatgggacgaagggaatagtaaatataagcaccagcatggccatgttaaatataagatttaaattcggatgagctaattccaccacagaaaactttactagtcgagctacgctcacttcaatttgcctctagttttattcttggttttttttatcaaaaagagaaaaaaaagttattattgttggtattttaattgttgtcttctgcggtgtgagaaactaaatgggccatagaaaccgaaatatgggccaatacatgtcaagcccatttctcatgggccgccacaaccatcatctcactccctctctcgattctccgttgccacacgctcgcaagcagaggcggccggcgacggcgcgatgccgccgagacgagggtcgcaggcggcaagaacaaccggctggcggcgggagccgggcgggcgatgcgagcaaccggtgcggcggcggtccaacggccggggagggagtggaagtttggaaccactcgaggtaaaccttccgaatcggtagaaaccccccaactctgaatttgctaggcttttattctggggctgttcactttgatgccaaaaaaaaatcttaccaaattttggcattaccaaaattttagggcctgttcactttgttgccattttcaaccttactaaattttggtaaagttgtcaaaaaaaaagtagctacatttagtttgctgccaaattttggaaactatataagaaatcctgctaaaattttgttgccaaaattttggtaactatgccaaaattttggtagaatttcttatatagttaccaaattttggcagcaaactaaatatagccatatttttagcgactttattaaaatttagtaagcttgaaaatggcattaaagtaaacatgctctttatctttcctgtgaataatcgtatataatcttaggaaccgaataagcccaaccaatataatcgatataaaaaccatcatgaactgaggacataaatctcgcacccccaataaaaaagctatcgatcaacagatcaactgatacaacatttcagccatctgataacctgagctaactaggctatacagtattctgaatttctgacacaattcttgcgttaaaacggataaagtggcctaacaaagtaacaatgtaccaaaacaactcatttaaaagttccgacattggagaaaatccacgaaggcgccatccatgttttcatctgcatcacagaagcctgaaactctatccctgttctattagaaaatcatgctgatgaatacaatactagtaataggtgaaatgaaaaagattgaaatacccaaaatcagtgccctcacatgtcagaatgcaaagttgatttttttacactggaagcatgtcttcccattctaattgtcgtatctgatacaaacaacaaggaatttcaacattgaatacgaaaaacgtttaagaaataaaacaagacagacatgatcgaatctcagtgtggaaccatttggcactcgaacatgttcagtctatctgcattgttgcttgaagtgataagtcaaatctcaggatagaaccatttcgcactcgaacatgttcagtttatctatatcgttgctagtgagtagaagcgaatgaattgaacctccgaatgaaccgttttgcacttgaacagtttctgtattgttttgttttttgaccgatttatctgatactacagaaacaaaacttggctcatcgtccatccaatatttataaaactactgtacatttggcaacccaatacccaagatttaaaactattgtacattaggccacagccataaatagtgctacccaatacccaagatttaaaactattgtacattaggccacagccataaatagttcaggaaacaaatcttggttcatctaaatttgtatgataaatcttaagagtaaatcttggttcatctaaaattatatgagaaaacttaagagtgcaaatgttgttggttagacactcccccttcaggttctctcatttgcatgttgaatctgatgtactcattttctctcttttgcttgttgattctgatgtactctctcttttgcttgttgattctgatatattccaccaagtgttcggtttgggcccaggagaaattattcctatctgcagctgcaaattttccattcaatgtgaccatagctggctggttgcagcagattgggcaccaactttataactgccaataacaaacaatatagcttgacaaacaaataataacacatcctgtatgtgaaaatttcaatcttggaccaaaatatatgttgtactacaaataataaacattaaacaggtctgataaatcagagagaaagctttgtccatctaaaattaaatggaactaatgtacattggaccacagccataaatagttaaggaaacaaatcttggttcatctaaaattatatggaaacagcattgtccgattgagatgatgtttgcactcttcttctaacatggcaccggctgcaaggttccagaacagtcaaattaactgtagatggaactttatcctcaatgtatgttctgatagccgcgagcccccttggagcttccgtgagaacaccatctatcatgggaaaacaccgcctatacttatcttgatcacacctaggaccataaatggtatccaatgtaagacactcaagtgacaccgcattattgaggatataacatgttagttccaccaagctcttcgcagagctgaaaccagtgatcttcacactcttgaggtggccatggtggtgttcaggtatgtgtctcagttgtgaatccgtgaaaatcgattcattcaccatacgtagagtcacctgaccatgaaaaggatgatatgcttgaattagacccagagtgataaaaaaagctttggaggatgaaatgaatgaatgaacaacactagtgccttacatttaatatcaaagtctccaaggaaggagatgcattgataaaagaaaccagagagaaatagtcatatggccgggaaatggtcgatcctgttatcatacgaatggtcaggtgcttaaggtagatgaatttggtaggtagcattggtgcatcaaccacctgcacaacaaatatggcatgtatcagatttattatacaccaggtattattaatgtaatccgtatataacattccctaatgtaatccatatatatggttatactaatgtaatctgtatatatcgctgtactaaagtaatccgtatatattgctatactacaacacctcatcttttagagaatatatacctcattcactgattcaatgacaagagtttcaagatttggcataatggatggcagattggcacgagcatcatggattgcacatcccatgtctagtttcttcatttgcagcgtttccacaactgagaagttaaccctgaatcctctatggaaaaaactagagagatttggagctttgctctctatcactttcaagcttgagcattcaaaaacactaagtctgctgggctgctgtagggcgaaaggtatcttcaggcaagttatcttcgtgcattgagtgagctctaaatgctccaaagcaagagagttggaaagaaggcactctaactcagcccatgtagctcactaaccacagagacagacttgttaggcttctcaagggggcaagttcaggtgtgggatggagggcacaaaatcgaagtttaatgtaccgaagtgagtctcgaaccccatcagacaaaagtgagcatgggaagttgtattgtttgtttgtgtcaaacaaaaaaagggtgagttcttcgatccctggtttaagagcaatctgaagccaactgtcaagataactagtgccatcgaacccacacatgccactgtagtcaagcttgaacgttttcaagctaatgcctgagtggttcctgagaatgcacccaatttttccgtggaaattctcgccaaacgcatttctcttcaagccaatcgtgtctttattaaagataagattgggatgacacctccaagaacgtagaaaagcacgagatacgcaagcagcacgagcagcttcacgcattgacataaaggaatgtatacgagacaatatgtcctgcattacacaaacatcagataaaagatcaacattgatattgcaaatccatatgattacttcaattggagaaagaaaaaacagaagaatcacacagagtaatgttctgccccaggtagctctccacatgaatgcacagggtgaattgcattacataggttagatagtgcagaggaacataaccgtgctagggaaactcagtactgcatagagaggttttcctaacagtgttattttagtggttttctaaatgaaaaaagagacagttgctaacagctagcaccaattaacaactacatgatatatttttacttgcattagtagttgaccataatgtttccttgttattgcaagtagcacccaattattgtaagttatcaacatggtactaaagcatcccacttatgcatcaaattctggagagatgttagcaacctttgcagagagaacagtcactaatagtactaataatgtaggactgtgatcaaatcgcagcactaaaataatctttgctgtttataaatgagctccctccatttagtttcaaattgtacaaaccaatgccatataaaacaaatggagggagtaatatacagccagcctatgggtgagacgtggtgatattatgcttgcaatctaagcctgcatcatcagaattcaatgcctcgtacctcaggaagatatgggattgaatttctcatcattttgccagcttgagaatgaccatcgccatcatgttcacacggtgatatctttcttttacccgttgaggcaataaacccagctgctgcgacacgaaagggattgttatggtagcagagacatgaatcgaagaaaagcaagaaaaaggcacttcaatcccctgagatctcacaaaaaaaggagctcaaacgaagaatgtggaaaggcaataatctgagctgttcaccaaagtgaaaaatttgaagccaaacaaatgaaaaatgggtatccggctcacatcaaaccagatgagccagttattagttaggcaataaaaagagcagctttttatgagctgacaatgacaaacacatctaccgagccaaacgtgacagaaaaaaagatgggcgaaagagttgttcctgttcagagaggaaggaagcttacagcgggctcggatttgcggccggcgatgccgccgccgccgccggccgcgccgctgggacatgagccggttcggcgccaacatccccaaagacgagctcacgaagatacccccttcctccctcggatctgaccgagaaatcacttccgtttccccctccttcagatctctcctcttctcctctcctgccaatttgcggttcggttttgaactcaaattcgcaccggcgacggcgacggcgacggcgccggcgaacggcgggcggagctatctactcgcctacagaacgacaaaagtaaccaaaccctattcagtgtggggactggggagtggtttgatcttcttttttttttttttttggcttttggagatgatctcttgctccggtcttattggattgcggaataagtctattctgactccctcttgggcttgttgaatcgcatccccaactgtaaaaccaaccaggtataacgtctcccccaactttaaaaaggaataagtcaactttggatccctctattttgtcgcccagtccgattttcatcccttgaccgcaaaacgggtacaacccgtcccccaacttacaaaaaccggacaaacgagatccctcggcggttttggctgacgtggcgcctacgtggcttgtttgactaggtctccgtcccacgtggcattgacgtggcgcttacgtggcaattatatctagaaataataaaaagcgtggccccacatgtcagctgcacacaaaaaatatttttaaaatggtgggacccacgtgggccccacgtgtcagcctcactcctctcttcttcccactcccccctctctctctccttcctgggcagcggacggcgcggtaggcagcggagcaggcgagctccggcggcggcagcgggcatggtcggcgccgccctccgaccggagcgccgcggacagcgcggcgtaggcggcgggtgaccggagaagcgcgcgccgggcagtctgagtcggcgagcacagcgacatcgggcggcggaatcccggggtgcttcccgctgccgtcgcaacgagggcaacgggggtccgcctcggcgatgagcacgtaggtgaggcaggacgggtaggcggccgcacgcatggacgggctcgcgggcgtcgccgcgccccccgccggcggcgagcggtggcacttgccgatggaggaggacgaggaggtggacgccgacgatgacgacgacgtggccggggaggcacacgcggcggcggccgacctcccggccgtggcgcgctcgagcgcggagcggaccattcctagcgtgcagaccgcggccaatgtagacgcggccgcggcggtgtaggacggcggcggaggcaggttgaggtcttggtggccgacatggacgccctggagccgaggagtcagaaacgtcttccctgactgcaagaagaagaacaaaaaaaatcagtaaactccatttcttcaagattaacccaagaacagggcaagatcagagccttctgaaactaaattcagatggaacaagtttttttatgttcttcatatgaagaacagagtgcttaatctcctaatattcggaagaaatacagcatgcaacacatgaaccgatctctgatagttgcaaacattgcaaaattgtttccgatcaaagcaaaaaacaaataaccgaacgaatggaacagttcatctcaaaattcgtcgacacaaatagaggcgcagaaacataaaccgaaactctgaggagcggtggggaaggagcggtgggcgcgggcgaagaaggccggggtcaccgacgaggtggtggaggaggtgtgggggcagagggcgaggggccaggagctcgccggcgccccttgccgccacaggaatatggaggatgccgccgcccccgtccctggtattctccgccggcgcccccaactcgccgccggggcagcctcgtcctcgaactcgtcggcggcgtccgcatctgcgcctaccccgtcctggtgggagacgatgaggtcccacatcctcgcgctctccaacatcctcccgccgccggccaattccgacgtcgcggcgctcgccgactccgaccgcccagcgcgcgcgcttctccgtcacccgccgcctacgccgcgctgttcgaggcgctccggtcggggggcggcgccgaccatgcccgccgccgccgccggagcttgcctactccgccgcctacccacgccgtccactacccagataggagagagagaagggaaaaggaagaagagagagaagggagagggaagaagagaggagcgaggctgattatgtggggcccacgtgggccccacatttttaaaattattttttgtgtgcagctgacatgtggggccacgctttttattatttttccgagatataattgccacgtaagcgccacgtcaatgctacatgggacggagacctagttaaacaagccatgtaagcgccacgtcagccaaaaccgccttcagaaccgccgagggaccttgtttgcccggttttcgtaagttgggggacgggttgtacccggttttgtggtcaagggatgaaaatcggactgggcgacaaatagagggacacaaagtgaacttattccctttaaaaatcggtgcaaattgattcatttgtgggcctgccactagggagggtactggttagcctatatttatacccaaatttacccatcctcactacaatgcgtgcccctgagcgtgcacccggctcatgttgtctgtcgtccgtccacgaggtgtgcccctagagggaggcgcgacccccacgaggggaacacgcgcccttgacccctcaactccgcttttctggagccactccttcgaggctatgcgttgggggcttggggtgctcatggacacttattctatatctgcgatttccccttctacccttggcctcgtcgctgggaggaggtggacagtggtgggaaggaaccagaagcggcgaggaggtggagacgcagtcgacggccctggcgaggacagatttgcgacgacgacggcctggggacgacgcaaccgactagatctggactcctgacacaccgctcgtcgtcggccaccgcaccccacacgccactctccgtcagcagtgacaggagagagaggcggcgacaacaggtggcggcgaaagagaggtgacgggagagagagagaggatgtgagagagtggatttggctgccggcgaggtggacggcaaccggcgacgagagagagtaggagaaacggcgacggccgccgagatagagagggagacagcagtgacgggtgagagagggagagagagatgcgagcgatataggcaggagagagcgggaggcggcggcgcatctgggcgaggagggagaggagaagcggcgaggggataaaggggaagaaaaaccgcgaaaagaaaagacagaaaaagagaagagatgggaagaagctagtgggtgctcggtgggctaggggtagggaaggaaatccatatatgtggctatgggttgagacaccctgttgtgggttggagtaccttcattggttgcttgagattttgaagagcccagctgtgacctacgagtatcccccattgggagatgggtgccctatgaacttatgaagtggctttggttagtgagggcacccatagagtgactttggttacagatgtcctatgtgggtattgcagaagctaacagccgacaaaatgagtgagataaaagaagaaaaggaattgcctgggcagaagccttcttcagctcggggcacctacgccatgatatttccgtaccttcgcagttcatccttgccatagaacaacagcgtcgtcgatctcatgccattgcccctgtgcttcacggatgccaagcaaaaagaagccagcaacaacaaagtctattgtctatttaggcctcctttaattcaaagaaaattcataggaattttagaggatttcattcttatacgatttttttcatatatagccatttgaatcaaagaaatgaattctatgtaatcctataaaattcctatgagatgcctaataccatgcacatgaggttttatctcatggaaacttgcctctgagtcatctctcctctaatccctgcatcggcggcccaatcaaatggtcaatcctgcgattcaaatggcccgtagcatgttaaagtctattgtctatttcacaatataaatatttctttcttttgtgatgataagatagtattttcttttgagggataaagataatctattgttttatagtaaaaatgttgaggtatgacttctttaagttttctttttataaataataataaattacccatgcagatgcgcgagcttctttcctagttattataaagattactagccagaatcacgccctacgctgtgtgcatgggtatgaatgtttcaagctgtgttattaagatcaaaacaacacaggtgacttcttttcccaactttctcaactcaactcaatcgttttccacgtgcccgcttttcaaactactaaacggtatattttttgtaaaaaaatttctatacgaaagttgatttaaaaatcatattgatctatttttcaaaaaataataataaatacttaattaatcacgtgctaatggaccactccgttttccgtggacaggagattggttcccaacacacccaaacaaacacagccacagtatctacagttgtaacttttaagaattatatataaacattgtctaaaagaactttatgtcagaagcatacccacatatgcatgtacacattgtgactatcaccaagatttaaatgtgaatacaatctgtttgctcacataattgtttgtacaatcatgtacacttacaaaaaagtagcaatgacagaggacaatggatcttacataatgtggagtataggttagaaaaaacaacaatcattaggtgatatgagaattgcagcattttctcatagataccttcgtcatgaactaattgaatcttttctcatctatagcactgcagcacaaagaaaaatttagtgctttagctcaataaaaacaacagtacatcacttacaacagattagtagacgattggtacctcctttgcataatggcacagaattttgaggtatcccctacagaatacagggcatctttggatgtcatccatatattgctacacaatgagtatatagtaggtagtacaaatactcatataagaaaccgtgttgaaatatctctgtagctttggagaaggggcaaacataacatttcatgaattaaaaaaagttataaaatcatattttgaagtcagcttataatgaaaactctataagtatatttgcaaagaaaaaattcaattggaaggatgggttattagaaaattccaaaacaatgcagcgctgaaaaaaaatgaaagtaggaataatgcttgtcaagaaaaaattacaccccagtgtgccctattggaacatatgacatgtctcatgtaaaattgtttgaagtgcatgtcacttcgtcacacacaaataaattgaaataatactttatgatcaaagcagaaaagagaataacacagtacgtaaagctagagatactaagggttggattctttggaatagcacatatgtattgttaatcggtatggactacacagatcaaccgataatggaactatgcaggttacaactcagaagtacctgtggctttaattctctcaggcaaccatggtttcagtgtcactgaaacaccctgcaaacaacgctaacctatgaaatcaatgttccattaaatattaaacaatagtagcagatatagaaatgactctagcacaagaaaaatgttagctaatatacatagggcctgcactgattttaaaaatgtagtaattgcggtctagtaaagttcacaaatactgaaatcttcaatcgaaccaaataaatatttgttcgctagatgtacaacataacctgtgattaatgccttgacttatagacccaatattgacccaatgtattggttacaatatgattcgtagaataatggagcttcctccagataggaggctaaaagacccgcaccatgaaatcatatcattaccttaatatcggcacaattatctgtctatactgagccctaaagaccctgaggtttgtctcatagaaaattaactgcatgatccaaatataagggtaatatgccaagattgtcaggcttacagtgaatttctgatgatgtatgcatcacaatagccaatataagtttgtcgacaaagaataccatcaatgcaaatgcgtatgttaccattatgtgtactgaattagcgcacgacgaattaacaaataaaatatgatttgttggagaggaaggaaattgaggcaaaaccttccgatagcataaacatgatatgctatcgtggaactaaacctaaattatctgataagaaatatgaagaccacatatatcatcaaaagaagacaataagaaaacattcatacctaaaaacagaagcatagaaaggtggcagcaagaaaactcattgacatgcccacaaaatattattaccagtattgtacaatgaaggaatactgacattacttcgcactcattaacatttacaggaaaaggacaactaagcaaagaacatcaaaacttgaactctccaactaactttttatattttgaagtatatatcttgggaaaaaaatcacatctgccatgtagtactatatcatatacatttatctacaatcctgaatgagcgtaattgataataataaaaaaaggtttttttaagtatatattcttgtagaccaatttgttaagattccagaaacaattggcatatatatgtaccgatgtacatcaggatttcattatgaaggatcatgtacacatctttaacctgtacatttctggtagttgacatagatggtgcactgtcatcttcaatattttatcattattagtgaaaagttttttacgcagagttagctggcataaaagttatacgacattataattaaaaagttgcaggaacaaatgtatttgagaataaacttagatttgccactaaaaattttaccaagcacatagaaggcttttgttaaagagagaaattttactggcgtcagcctaatcatttcttctccttatctcagaagcccgcataggagccaatcagccgaagagagcaaactgaaaagaaagaaattcagcagcatacctgaacgactatggtgttatgtgcggtgacaacggaggagcagattgctcccagcgcggcgcaggccttgatgtgggcttggatgccgccatcgctgccaccagcatgaacaacacatgcggccatggcatctagtgggccatcgtagcaggctattggtgaggggcacaaatgctgttaggagaagatggttgagaatccataataatatacatttcaaatccattttctataataatattttcatagtaaaattttgctgctcctatataaagctattttgatttagcacgacattcatatagtgtaaaaaaaacatatacagatgaccaagaaaatctgtcaactattacagtgcaaaagatcttaatcatatcatataggcagctgcagtaatcctcaaacttttgtagacataatagcaatcaacagaatgatgtcagcaacctgaaaacatatattaaattccaatacaatatatacaggacagaaggagaggatttgatctgtacctggacggtgatgtttaaactttagtactgaataatctagcattctagcctgcactcccttttttctttccttcctaccaatcatgtgaaactcataatgagcagcaagtcaagaatagagatcaggggctagaacagatatgtatatatgcatataatagggatttaagtagtagtgtaccaaattgtgtctgctgatggcttcagcagaggagtagaacaacaaatatggaatcagcgcaagcaagcaggctggatcgatcatatatattgattaagaggattaggcaaagggagtgtaaagttgacctggggaggagtagaatgcgtggtagcagatcgtcaggtcgccaggtcgcagaggtgacgaaccagtcccggcaactccctacggtggcgaactaatcccagtgagattcggcgacacccaaactgtcaggggaagggaacggagacagtgcctgcggcgagagggcgcggccggggaatgagatggcgcttccgccatcccgcggagagagggcgagtgaaaggagacggcgccaccatcgtcttgcagcgagagggcgaggcggcggcaccagccatcaggcgtgggggtggggcgcgaggttgggggcggctgggcagcgctagggttttgtgggggagggtgaaagcatgagatctaagccgttcattcccaaatcaccgatctgagggcagtgaaacatccgccagctgagccacacggatggtcagatcgagcctcacggcgatcgtacggtgaacacaaactcagacgtgggcaatattttacgaaagtaggagggtttttctgaaaaaatcgcatgacgtggcgcagtaaattccaagcattcccacggcgtttaagtaaatcaatataagttagatgaccttgattttacaaaatcatagcttaactagagaaactacttagactactggtataaggataaagacaaacttcatctacagttggcgaaaatatatttaggctgtgttcgcatggggtggatgggaacttattccctccgcacggaaaacggagcggtccattagcgcgttattaattaagtattggctatttttttttcaaaaatagattaatttgatttttttaagcaacttttgtatagaaactttttgtaaaaaacacactgtttagctatttgaaaagcgcgcgcggaaaacgaggaagatgggtcgggaaaaaggagttgcaaacacagccttaactgtcatttatcctagtgtccttaaagttatatgttgtcattgtctttcttgatgaatccgaaaatataagttcgaaaacaagccgattattatactgattgaatttcgctaacattaccactactaaaactacaacgaaatataataacgaagagtaaccgagctgtatatcatggttcattattagagtgagtagtttacacattcctcgcgagtccaagttcagttgcaacgtcaacttcagagacacatcgctcggttgaaaactatcatttcttactaggactcacatcagctagctacacgctactggccgcccctgatctcagagctaaaaccggtgtgcgagaccgaagcgctatccgggtgggcgatagcctgctgcatcccgcgccggcgccggcgccgtcgccgtcagcttgggttcaattctgaacacatttattgccgctttctgcttgacttttatgcttttggcgacttcgattggtgcagaactaaagaagaatctgacttgcatcgcaatatcgcatggtatggtagtagtacttgtgatctctggaaaagaaaagtagaggagttccttttgccaatgtcaaataagatattatgctaatattaacccctttatggctttgctttacttaccggcaaccgactgactctgtttagatccaaactttttcttcaaatttttaattttttcatcacatcaaaactttcctacacacataaacttttaacgtttatgtcacatcgttccaatttcaaccaaacttctaattttagcgtgaagtaaacacacactacgtcctgctaggcctcacatccttgtcaccgtcttttcgtcctgattagttccacgcattttgtggaaaaaaactggtggcactatcgactcagatatcagaataatgttcctgagaggcttcaacgacgtagtattaaaatcagtgataagttatatgataaactgataatgcgattaattgcatggactgtgtagcaaaattaacgcagcttttataagatctgacaaattaaaggttctgaagtatgcacatttgtgaattgcgatgccctggattcaggaacctctctgcaaattgttggtgaagcagacaaatgaattggacgggaaagggaacaggtgagaggatgaaaatgaaagaaagagagatcagagagagaaggaaaaccacgggattattctgatggtatttcacccggatagaaagaagatattctcctggtagtggattcgtgcccctcttttttcaatctgatgcgagacagagttcttagtttggcgagcacggttgacaaagttattcagaaattataatattctgcttgtgattcgccaactgggcattcatctatgcagacattgaactgataatctatagtatgcacagagataacgtcaacattacgaaacccaaatgagcatcttttccatcccaagctgcaagtctccatccgtttcatatcataagtcgttttatttctttaattttttaaaaaagttttatcaaatttatagaaaaaataacaatatctataataccaaagtagtttgttaactattatattgaacatattttaatgatatatgtttgttttgtgtttaaaacgttactatatgtttctataaatttgattaaacataaaaactatttaactagaaaaaaattaaagcaacttatgatataaaatggagggagtagattagccatgaatcaaagcaacttaacgagaggccatgcaacgtgagcgccacgtcagtgaagaccgagtcaaattagctatgtagacgtcacatcagccaaaatcgccgagggatctcatctgcactagttttgacaggacccattgtatctggttttcctgttaacaagttaagagaccttagatgaacttatttcaaagaaaaaaacgtaaagcatcaagacctccctagtatagatggccataaggtccaaggctcgacggcacggcccacgtcacggcattttggcatggcccaagcacggcacggctcaacgagggtcgggcccgtgccgacccgcgatggaagacgagggagagaaaatagacttattttaaaaaggcatgatgggccacccgggccttcggaccgagaatttttttcgttttaagatttttttttaatatttacagaaataatctatcgaccaaaaaaattgcagaaatagcccctgccgcccaaatggtgggcggcatagctgacgtggcagacggtgggtcgaccgcgccgtctgccgccgtcggccaaaa

SEQ ID NO: 79271 - DNA, 17366 bp, Oryza sativa
cttgccaaagcggggcaaaatcattaagctagcattgcgaggcggtcgggtaacaagacgagtggagagcgcgtctaggggtgtaagtggctaacccgcgaaacccacttataggctaaaataaaccgcgaacccgcttattttgaactataagtggattcgcggctgacccacttacagccctaagcgcgtctacgaatctatgaactatttttttttgagagagtacaacgaggatgcacacacgaactcactccacactcacacaacgcaacactacatgcacacacacacacgtgcgcgttcaacacacgcaaatgtagactttgaggacctaaatcctcacatgtgcgtttcccgcacaaatcctcacatgtgtgtttcccgcacagacccactgaacacgcacgcatgtgtgtaccctattatctacttgggaccaaccgaagtgagtcccaaaaatgagggacgagcatcgagtctgggagtcgaacgctggccggcaaggagcaagccacaggctcctgccacctgcgcgtagcgcagtcctcaatctatgaactatttgagtggcacataagaaacaagaagatatcctttcgaggtaaaagaaatcaggagctcaatttagcgactcaacttttcactacttaaacattaatcatatagttaaaagaatttacataataggtgtatctacattaatgctaaatataaatccaatcaaagagaaaccaaataaactcattcatgttggaatatattttttaaaaaagaacattaatatgcatggattgcaacaatggcctatgtcacttcaccaacatgaaacactaaattcaaatatacacatcttgcaaaaaaaaaacaagaagaaagaaacataaagaaatttggctatgagccgtgttagtactatccataattgaatttaattattttgactcactgcatgaatttgtacttgaaatttttcaagttagtctatatattatataaacgtcatcaattttttttgttgatttttctataactatttgattggtacttgaagaatgagaagcaattgcatagaggcgtataatgttagtaccaaataaggcaacaaacaatcaatttatatattcataaattgcatattgtagttccttttttttaatgaattgaagagcgacaatttgattagggatgaaaacggagcggataatttccgtccgctatggacaaaaacggatacggatacctttcggatcggatagttcggatacggatacgaataacgctatggtatcagggtttcagtcggatactgataataattcggatatccggtgaacagtactattcggatatccacagaagccatgagacataccgcatttctttctaactctataaccttcaaatagattttaattgtagtttatctcttaacactagtccatactattaatattatttatttcttaaaaaatatttataaattatacttcattttatataaaatgagctaattatatatgttgatatttgtttctattagaagttgagttggttttcgtgttccgagaaaaaattgtttctgtattcgtgtctgatcatattcgattcttatttgtattcgagataatccgtatttgtttctgtattcgagctatccgtattcgttttcgtgtccggtaaaaaatatgaaaacgaatatggtatgagcattatctgttcgtatccgcttcgttttcatccctaaatttgattgaattgagcagaaaaaaaaaactatacaacaagaaaaatgtgtaaaagtacatgtttggcccttaaggtctgctatggctaaggcagccacacaacaagcttaattcctagccccttctcggcccatgttgtggcctcctccttaatcttgctgactaggcttggtgcaaatagttctttgtgttgaaatatccggtgcagatagttctttgtgttgaaatatcctttggttcctttattgctatatctcccaggagactagcaacaccaaggtgctcgcctgccttggcactccccttgtgttagcgattgccttccaccatttctgcatcgtcgtggttggttcccacaagacgagtattagcttgtcgcaggacgtccaccctaacatggttctccaaattctctttgtatatctacgttctgtcaagtggtggagggtcgtctcctgtgtccaacgacatagggggcatatgtagatgttttaccaacacgtgttaccaatctattcgatgtccaaactctattatagatcaccaaccatgcaaaatcttgctctttcatggggcccatggcttccaaatgagggtatcaaattctgactttgttgtgcctaggagttgcgctttgtaggctgatgccaccatatactcaccatggttggttagcttccaagtggtcgtgtcttcctcgccctctacgagatgcacttcttggactgcattccagacagtgacgagctgactgattagtttggtcatcctagttgcaatcgccgataggttgatgtcgagtagccattggccagatttggtggcctactgtagagttctgtttttcttccagaaagtcgcttagaccagaggggccaacttccttaagccttctcccttgcaaccaagcaaagtcccagaatttcgcttttgtaccatctccaactgtcgtcgtcgttcccacaaagaggagtttgccaatgttgtcgcaaggcgtctccgaccccactcaaagctttcttagataaacaatgtagcaatcagtggcgcttggcgagcccatggttcaatttttcgttttcagtatttgtattggggtgctgatataccgaaatttggtccagaattatttgaattttcgaacaaaatttggtcaaatttgaataaatattactaaattcacacaaaagaataaaaaaaactttggtcgaaccggaaatttgaaccctgcgagccagcctgcgagacttgtcgtagattctgtaaatcttctctgacactgatacaacgatggctcgtgcatcatcctcatcctcctctccggcagcattgatgtccatgtcgaagctacgctcggctggaggatctctgcacgctccataatcttgatgggtgtccgcgagctgaaggagcagaagcttccatccccaatggcgcacgagagctgacgacccggatcaaccattggcagcagctcctgtacagacacctcctcgtcctcgatgctgaaactgctctacgccggcgacggcgacggcgacggcgacgacgaggaggagacattcttgatgcggtacacggcggcgccggcgcgtgcttcggcttggagtgggagacgaagaggttgtcgctagctgctcttctcatcaccgatgggcacccgcttggccgtcgaacgggaggttcttgtcgtcggcgagctcccccacctcttgctatccacgtcgaacgcaggatgtggcggccggcggcggcgtaggacgcgacggcgagcgcggccgggcggaggggacgccgccgatgcggattgtcgccgccacccgcggcggcggcggaggcggcgagaggagaaaaagaaaatcaaaatcaaaatttctctccacctatgacatgtgggccaactgccaagcagccttacttgacggagattaaatctggccgttgattctccatcggacggcggagcgctcacagcagcacaggcttatctcctccctccgggctgatgggtggataggctgacgacgggccaagaagccgaatcccacactgcccgtggccatggcgctgctcctctccccgaccgtctccttcctcgcctcctcctccgcctccccgcctcgcgccagagctctccccgcctccgccaatgtcgcctccaccatccccggtaacctccgtgaacgccttctccgtaccgggacttttgcgcataagttactcgggttgtggggtgttggttcttggattggattatgctgagtgggtacgaggctatccattgttgtgaggtgtgatttgtaattcggtgggaggattggtctagatatttgacgttggtgattcgtggcgtttctgattctctgggatgcggttggctcgttagggaatttcttcaaacacgtcgtgtgcagatgcagtaattcgtgggagattccgtgcatttatcatctctgtacaaagctaggtataattcatctcagtgaactctgcagattctcgaagctttggttctttcgtgcttaaatgataatatcagatgctatgtaagcaccggtcactggcaaagggtgacattcgtagtacaccctacatttggggcctgattgttaatagatgagtagattttacatatctgtgctctgctaagattcatcataatatgtaattgagaacactaggattgttactagttattgtactatatactatccatgaagtggcacacatgagctagacttattagctttcaagtttcttatatgacggagattctatcaaaattttgaaagtagcatgcatgtactctgaattctatatctaaaatgatgcacattgaggcttgccatttgtcctttctgatgctacagccccaaggctccagtgcaagaatctctcctcgcagagccctctgaatgcttctttcaccaagaagaggctagtttctgtccatgcctcggcagaggctggcgcagaagaagctggcacagatcaaccagaggagccaaaacccacggtttcgattgagacaatgccgctcgaaactaagcagaagatgatcatggagcagagggcgaagatgaagctggccaagaagctgaggcagcggcgcaggaggcttgtccagaagaggcggctgaggaagaaaggtagatggccaccatccaagatgaagaagctcaagaacgtctaaccagcagtgatgtcggtcgctgttcttctgtacacctctatgttctgttcatccgtctctgtatttcctaagctgatgcccagcgaattttgctgttcaaaatatgaaacacaatgtttgcaaaatgtgattatttctttcccgatgaaatttcatcttgtattttttagataatggataaaccggtcaccgttaaaaacacacaaagcccagtactgaacaaattttcttctaacatgtccctcctttttctcctttaggctttagctgtcctacagaagtaccactaaatctaatgtgtgttcccatagtggaaatatcatatgcaccttgatgccttctgtgtttgtcaaaaactcaaaatcatagcaaatttcaagaagccttgctgtgctgcactctatatttgtgaggtatttgcctgtatatacacttccatgatgtgttttgttagggcctctcacaactctttcgtctgacctgatgttgattaaagcacaaaggatcaacctggacaaggaaataactggagcaaattcgggtttgtttgttgtttgccactttgtcaggcacgatgtgaacaatctgaagagtgccattttcgattttttttctgatgcccttcctgttgatgtggttgtaaaatttatctgaaatttagccttcttgagccatctttgtgacttgatggtgtaccgtcacaagttcttgaaatgttaaccacgatgttttttgtggaaacaaaatttgtaatctctctatcgtaggaactgaacatggccgtagctgactatgtttttgacctttttcagcatcagtctgacagtctcataagatggattcctagtttcctaagttgctggaaagaatctttgtttgcttgccttgcttggctacatggtgttgttgcctgcatgtgttctactgcccccacgcttctctctttagggcccttgatgcttcgatgcccaaggaaggaacaatcaccacataacctcacaaaactccttttcagttattagttttttttttggtgtgtgtgtaagagtaactaaccatttttagtttttgttataaatattttgatgttttctgctgaaagaactataaagaagatggtagtacaaaatggacttgaatgactcatggttcaaatttgttcaggtaacagctggtctgaattttggatggaagagagccagattttctgtctggatgaatgaactgcaaccgtttgcaccgacaaacaattcgggctttcttctttgcaagatcaccgggatcatggcctgatcggtagcaaatatagatatcaagcaagaacactccgttggcacgctgccttctgaaggagcaaaagcagtcggtgtgtgctgtgaagacacttttttctcatgtgccggtactgatggtcagtataactcacatctcttgtttactttctcactttactcctagcatctttgatcacgatcagtatgatctgatcatcaccttggatcttcagccccattaaaaagcaatcatcggttgtcgatgatcgatcccactattgggttatttggatattacaatcgcattcaatatgaaagaacgaaagaaagatagagagaaaaggggcactgatcagaagaagaaagaagcaaatctgttgcaaaaaaatgtgttctggtgatgcctgagagttgagatgagagctcaactaccagaaaacgactgacactaactaaaggcaagctgatatatgtgctccatggaattcttcactcaaaagaagacagccaggtgaccaaaaacagcctgcctcagctttgtcaacaattgtcataacgcaccgacatgattagctctgattcccaatctattgacaagaattttgtgtggttaaaacaggtaacaacacagcacacactcttaactaactttgtgatcatccatcactttccttgtagtaatttattcagtactaacatctagttgcctttcagatcagcaaccacctggagatattcagatcattaaccaagaaacaatgcaattgtaggacaccaaatgcagactgctaattgctcactaactaaagcttcagaatgagatcaatgaaatgataagcctaatttaagtgcaagaggaaaaaaaaaaggcaaaggcaagcaaagcaaagcaaggcttcatctccaccaagtagagacagtgtcagaccgcacatattccattcctcgcagccaagcaatctcgtcagaaaacaatcatttgggcagaattaattttgatctcaaccagccatgtggctggtcaggtgacggcgacgacgacaacaacggcgactagcggatcaccatgagaagtttctatctgccatgctcccatggaaagagaggagctactaaagaatcatcaaaagagatagaagggtacataaagaggccagtcagagttcagatgaatctgattctgcagccatcagaaaagcaaggcagaattccagctacaaattgggccccattctgaagagtttcatatcatatcatctcctacttagaacttgcacttcagaggaattttgcacgagcaaaatatttagccatatatatatattagtaggaagggaagctagctagtgtggtgtgtgtgtccttactgcaacctgcttcactgaagctcagtgatctttgagaagttccatccatggtgaaccgcgcacatttcgtcatcctcgtcctcgtttaccgcctcctggtacctctctcagccgagccagaccagaccagagaggtagattttgaccatgatcagttgatcaccattagattgcacctgcaagagttggagcagattgttaattgcataatttgcatgagttatcaatttatcatagtggttattgtgaccaatcaatgttggatggaatttgttgcagtcgtatgtcgtctacatgggcggcggcggcggcggcgccggcgccggcgccggcgtggaggaggaggcggcgcgggcgatgcacatggagatgctgacgtccgtcgcgccggccggcgacgatcaggggagggcggcggcggcgctgacgcagagctaccaccacgcgttccagggcttcgccgccgagctcaccgaggcggaggccgccgcgctgtccggtccggccaccgccaaccaccatccgatccattgttcttgatcgattcctttcccggcgatcgccgtgatcgcgccgccgccacggtggtgaatctttttttgttgttgttttgcagggcacgagagggttgtgtccgtgttcagggatcgcgcgctggagctgcacacgacgcggtcgtgggacttcctcgacgtgcagtccggcctccgctccgaccgcctcggccgccgcgcctccggcgacgtcatcatcggcatcgtcgacaccggtgagcgacacgtggcacgtgacattggcctgcgtcgtgtgtgtccagagctctgacgttgtggtgtgatgtcactactgttactgtggacggcgacaggtgtgtggccggagtcggcgagcttcagcgacgccgggatggggccggtgccggcgcggtggcgcggcgtgtgcatggaaggccctgacttcaagaagagcagctgcaacaagaagctcatcggcgcgcggtactacggcagccagcccggctcggcgtcgtcgtcgtcggcggcgggggcggtgacggcgacaggcggctcgccgcgggacgccgtggggcacggcacgcacacggcgtcgacggcggcgggcgcggtggtgcccggcgcggggtactacggcctggcccgcggcgcggcgaagggcggcgcgccggcgagccgcgtggccgtgtacaaggcgtgctcgctgggcgggtgcgcgagctcggccgtgctcaaggccatcgacgacgctgtgggcgacggcgtggacgtggtgtccatctccatcggcatgagctccgccttccagtccgacttcctcgccgaccccatcgcgctcggcgccttccacgcccaccagaggggcgtcctcgtcgtctgctccggcggcaacgacggccccaacccctacaccgtcgtcaactccgccccctggatcctcaccgtcgccgcctccagcatcgaccgctccttccactccaccatcgtcctcggcaacggcaccctcgtcaaggtaatcataccatcgccatgcctcacttcttggccatgaatgagacctcaatcccttctcctcgtcaatggcagggaattgccatcaacttctccaaccagagcatcaccggaggccagtacccgctggtgttcgggccacaggtggccggccggtacacgccggtgtcggaggcaaggttagtagtagtagactatactagcaaccttctttcccatggaggcaaatcgccgagcagttgagctgcgtcgctcatcacaccatgcactgtgcagcaactgctaccccgggtcgctggacgcgcagaaggcggcggggaagatcgtggtgtgcgtgggcacggacccgatggtgtcgcggcgggtgaagaagctggtcgccgagggcgccggcgctagcgggttggtgctcatcgacgacgccgagaaggccgtccccttcgtcgccggcggcttccccttctcccaggtcgccaccgacgccggcgcgcagatcctcgagtacatcaactccaccaagtgagtcgccgtcatcaactaaccatgttttgttacgtgatccgacggctgatgttgcccccggtgcaggaatccgacggctgtgatcctcccaaccgaggacgccaaggacgacaagccggcgccggtggtggccagcttctcggcgcgcggccccggcggcctcaccgaagccatcctcaaggtatcgttggggtaaaaaaaaaacattttaccccctacaattcgttgaaagctgattgaaattctcgctctttccgtcagcgtacaacaatgcgtaagaggtaaaatggctttcttatagtagcatttaaacggagtttgctaacgaaaacctaacgatgatagtatgtttggataaagacacttgtacgacggtatttttaaggaagttgagttcgtcgatagtactttttgaattaggatgaatgatcacctggtaaaattctagaaggataaatggcggtaacttccattttgactgcgtgttggtttttggttagcctgatctgatggcgccgggggtgagcatcctcgccgcgacgatacccaccgccgacaaggaggacgtgcccgccggcaagaacccgtcgccgttcgccatcaagtccggcacgtcgatggcctgcccgcacgtcgccggcgccgccgccttcgtcaagtcggcgcacccaggctggtcgccgtccatgatcagatcagctctcatgaccactggtacgtagccgatcgaatcaagaacgcgacgagagcagaggcgtgtccgattgattgatcgatcgatcggttttgattttggcagcgacgacgaggaacaacctcgggcaggcggtggcgagcagcacgggcgcggcggcgacggggcacgacatgggcgccggggagatcagcccgctgcgggcgctcagccccgggctggtgttcgacaccaccacgcgcgactacctcaacttcctctgctactacggctacaaggagcagctcgtccgcaagctcgccggcgctggcgccgcgggcgccgccttcgcgtgcccgcgcggcgcgccgtcgccggacctcatcgcgtcgggcgtcaactacccgtccatctccgtgccgcggctcctcgccgggaggacggccaccgtgtcgcgcgtcgccatgaacgtggggccaccgaacgcgacgtacgccgcggccgtcgaggcgccccccggcctcgccgtgaaggtgtcgccggagagaaaggtgttctcgagcaggtggacgacggcggcgtaccaggtgagcttcgagatcgccagcggcggcgccggcgccggcgccggggcgagcaaggggtacgtgcacggcgccgtcacctggtccgacggcgcgcactccgtccggacgccgttcgcggttaatgtcatctgattggtgtctctctctctctctctctctctctctctatctctctcttttttttttcattttcattttatttttgattgctgaattccattttttttcttgccttttgtgagtgtatggttttagggtcagtcttggatctcgaagtatggtgttgagtgtccttcctttttttggaaaagcaaggaataattcagattttgagtgtatttacagatttttaattaaccattcacaattgctagtagctgctatcataagtttggacaacctaaggctaatataataacctccaccaatcttagagcacaagtgcacaaccctctaaacctaccagataaaaatcaacaaacttgaaacccattatatcgaatcatgtcgacagaatcatccagttgttgccacttgccaggtgattgggtaatcaacaggagctatacaagattacaagtggaggctactgattgaatttatcccaaaaagttttgcccacagaggattaattagttgcagttgatctcttcgatcaaaactagggccgtttgtcttcagcctaattgcccaccacccgtgtccaaattaagctcaaatcacatgggctaaaagcatggaaaccaaacatttacatatgagcgactactaattttgtgaagggtttaaatatttaaattagatctggtcctgcaagtcccgcaaattgtaggattaattgggcaaagatagtactgcccaaagcatcaatccaatatcaaaatcaagatcatgatctccaaaaaatggaaaagattaaacgttagttgttggcacgtactaccgtgggctctgcttcaattttgtttcgattatttttgtagactaagtcacgtacgtgcagaccatgacctgctctcccaacatttgcaatatttgacgaatttaatttttccgagccctctctaaaattgtctgatttggatcagagcaaagaaaaaaagatagtattatcatagtaaacgatatcacatttcctgaaaacagaaaggagattgcagtttttctctgtgaaacaaaattaataaactcgttaattttctctaatcagatttttttttggcgaaataataagctctgatgagtgattggctaggtgggagagaatatttgaacgtgaaggcgggctagtgcaccgaccgacaggtgggccacaatctacccgcgccggccaaatggatccaccctgtcgcagcgccagtgcaggcgggcacgttgggtgtgtagccggcaggtagccagcccggtcgttaagcctagcttcgtctcgtttccaacactttcccgcggaaagaaaaaaaaaagaaaaaacagagcacgagagagctggagaagccatggccatggcaggaaggcgatgagaaagagataggaagctgacctgcctcttcgtcggtcatggccgcgttgtgacggcgccggcggccggaggacgggacgaagctacgcgcgctgcggcggcggcggcgatcgactgctggtgttgatcaggattcaagggagagaaagatagattgttcatgggggagccaaaccagaggaggttgtaccaagtctggcagggaagcaacgtacgacacgatacgatcatctcgcctctctcttccttccattacttctctttgaaaatcttcttgcaacctgcaatttttgttgtgataatccttgtgaaattcagatcaatattttttttgtttacactttgagatgacagacagctttgctttctccatttttttctttttcagaaatttctctgcggcggacgcctgattttcggtccggatgcgggttctctgttcctgtccaccgtgctcatagtggctcctctggtaggcctatgctgccaatgcatcacaaagatgaactcgatcagttcagagaaacaagttcttggcctccctgtcctcattgccaccatcgttcttggcctagcagtaagtcacaaattctgaaattcagcaatcatcaccactaactacagctgtttatttgtctgaataatctgtcacaactgctcgtgttttttcttgtctgaataatctgtcacaactgctcatgctttttttttgtctgaataattgtaacacaacagctcatgtttttttcttcccctttcatggatcaatttcgagttcaggatttggcattcctgctgatgacatcgagcagggacccggggatcgtgccgaggaacgcgcggccaccggagtcgtgcggcggcggcgacgaggagggggtcgccggagacgtgacgacgccgtcggcggagtgggtgacggcggcgagccctcacctccggctgccgcgcagcaaggacgtggtcgtgaacgggtgcgtcgtgaaggtgaagtactgcgacacgtgcctgctgtacaggccgccacgtgcctcccactgctccatctgcaacaactgcgtccgcaagttcgaccaccactgcccctgggtcggccagtgcatcggtctggtgagcaccatactgttactgatgtagtactgtacattattaagctgatatattgaattactgaaacaaattatttacttcatgcttcgaaaaacaagtttccagctatttcaccggattacttaaacgaattatttacttcaagcattaaaaaataagtttgggggtttgctgaaagtacagtgggctcctctgcctctgcccttccttgctattttttttcctttttaagtagcctttttccttagtatcagtcttctcctttttcggttttttctttctttattctccaataatggcaatatagccgttttgtgttgtgtaactaaactcttttttcttttgatatattgatgtgtaatcttttttcatgttcgtgaaaaaaataagttttcttaaaaaaacttcttctactgcgttgttttaaactatttgttaaatttatttttctaaatatttgattaatccctacaaccaagtagataatccactcgataaaataccaatgatgatatatttgatgagacggaggattgttttcgcattttgtgcagcggaattaccggttcttcttcctgttcatctcgacgtcgaccctcctctgcgtctacgtcttcgtggtgtcctggctgaacatcgtggcgcataaggacggcaacgacggctcgctgctgaaatccatggccggtgagccgttgtccgtcgtgctgatcgtgtacaccttcgtctcggtgtggtttgtcggcggcctcaccgtgttccacctctacctcatgagcacaaaccaggtaggccgcatcaagccatgttgttaaattgtttgttgagttctttcctgaagaaaatgcacgcaagaattgtcacaaagatgtccaatttcgcgacaaaattatcatgctcatcactacttagtgaccaggttgtcaaattctcgattctatcgtaccatttatgactttacgatcgaaggcctgaatctatgattatttacgattttatgattgtaaccttacctagaactatgattatttaccatttttaatatattttttaaaagaaacttccgattccgatctaggatcgagattttaatgaacataaattgcacattttgatttcaagtaaatcctgatctaggattgatttacttgaaatcgatacaaaatttgttctgaaaaaaatatttgtgatcactgatgtgatgcttctctactgcagacaacgtacgagaacttcagatataggtacgacaagaaggagaacccgtataacaggggtgctatatcgaacatagcagaggtgttctgcgctgggatcccgccgtcgatgaacaacttccggtcatgggtggcgccgccgccgctggaggagccggacgacgtcagcgggcagcttccgccgaggaacggggccgatctcaccggcggcgtgaaggagaaggtggacctggagatgggccgcaacggcggcatcatcccggcgatcttgcgggggctggactacgacgagatggagaagaacgatgtcagcgtgcatatcaaggatcggggagcggcaccggcagcgccggacccattcatggccggccggtggcacaacgaggactgtgagagtactccgacggcggtgagccaccatgtaaattcagaacgattatgacgtccccagatgcctctagttgttgcaaatttaaattattctttttgggcgttttggctctaaagcaagttggagaaatcagaaaaattgtaggtgtaaattgggtacacatttctgatggttatcttgaatacctgagattgttcctttgtttgcacggaagaataccaatgcgtgaacatcgcggggaaaatggttgatttgttaacattaaggttgttttgttgccgtcgcggttatggtaagattttctttcaataaattagattccacacgtcaatggctcaaaaagtatggtaaaattcacgtagacttactaaggtgtgcaaagattttgagcacctacatgttaagtaattgttggtaaataagcaaaatatgactgaatcaagcaagccaagtctatgattttcgatttatagctctaaaagatgggaacgtattacacaagttctcacatgtacacacggtacatatgagctagtgattatcaaaaaaattatccatgtgctttcaatagtattgcttctacaagtaaagtcccatttttaaattcatcgtacacggagaacaacaaaaaagataaaattctaacagacttgtagtataaaatagtaatatttttatagctaaaatataataaatttgaggttaagattttatatgtaggtataaaactattgaaactatatgcacaaattttttttagatttttcgatgatatttgttagttcgtgtgtacggagtgtgcatgtgaaacttaagtgtacatggtatatttacctgaaagatatggattaaatttgttagcacctaaaattctacctatagttttttattttgtgttttcgtcgtggcggctaacatatttttcctgtttttgacctatcttgaccgaatccatccttaatattggccctattcactgcaacttttttgcatggctgtgcagccgctacaataactatgttggtgtagttgcaacggctgcagcagcaagctgcaccgaacagggccattaaggtgatggaaatgatttgcagcaaaaacataaacaatcgctatatatattaagttttttttccgacaaagctaacctgtaactttgtatgatgttataaaactgaacttttgatcttctcataaccaattttgccaatggattatagcacctcgtttgccaagtccgaagagattttttggctgactccagtgatattttacaagttacaaaaatgtggtccatcatgcatgcacatatttcattttagactatgcctgtgatatgtcatccactagatatataggttttctccccattttctcttgccacgacatgttatattcctggccagacacgtggctccgtcctagccagtacttgaaccttgaagaaacccgttggacatatctgccaaaatcttgctccgttttttcaattatttttgcgaggaaaaacaaaagagattcgttgttcgtgcacatagaaagcgcagcctgtgaacattagcacataggaagcttgtgcgcctcttgtttctctcattttcgacatcacatcttagtccttttcactaaactacaaaccaggcagtttggttagttttattgctcacagggtgtatcacattgtgagtttaaaggaattctagaaagggttttaccggttcgtgttacttaaatcctatgtggcatgggtgcataacttcatctattagtgttgagttcgggagtaaggattaattggggaccctctcgctcccaacacgtaaaacggagtaatagttagtgtatgatttattaagtattagctaaaataagttaaaaatagattaatatgatttttaaagcaactttactatagattttttttttacaaaatatgcatcgtggagtagtttgggaagcgtgtgcgtggaaaataatagaggtgagttgggaaaggtgggagaaagaacacaacctaggatttaaatcataggtttacgaatatcacatgtaattaggtttccatgtaagagcaagtttaatagtatagccaactactagctccggatcatctatagtcaattatagtcaatttatacaatagttatctataaacatatactacacttttaatatctggtcccatttatcatacacacattgcgtcttagagtctgtgctgtagctggctcccaatctg

SEQ ID NO: 79272 - DNA, 22178 bp, Oryza sativa
gagttactaaaagtaagaaaactgcagcttctttcgacacagcttgaacctctcactgagcagcagctgtcagggatagccaaccttcagcagtcttcacaacaagctgaagatgctctttcacaaggaatggaggcccttcagcagtccttggcagaaacattggctgggtctcttggttcttctggatcaacgggaaacgtggcaaactacatgggccaaatggcaatggccatggggaagcttgggacccttgagaatttccttcgccaggtaccatgttttttctctctctctcttttctagtgtaaattatgtatgtaaaccttgggtatagtcttatgatgtccatggagtatgtagtatgcggattcgagtaaactatagttcaaaattgtgtactaaatcctctttatcttttccactatatgaaggctgacaacctgcggcagcagactcttcaacagatgcaaaggatactgaccactaggcagtctgcccgtgcgcttcttgtgataagcgattactcttcgcggcttcgtgcccttagttccctctggcttgctcggccgaaagaatagcaagcgcaagtaacttgactgcaaccacatttttcgggtttgggaggtgatggtgatcttacctggaagagttgacaatcctgcaaaggacttgattcggagatatttgcacatactataatccaaaagagatccttgtgttcaggtagcttagtcttatggttaagtgcattaggccctggcccatgttgtactgttagccgctgtaaaatactgttccattattacttatgtatctgtaatatcctaattttcagagaatcattagaatgggaattgggaacggtcttattgactatcccgtgggtatttgacatctcttaggaaaaactagcttactgtcatggacacagcgccatgtcaataatctaatcaaggatatgtgaccattcagttgcattggaatttctgtgactgatggattgtgttttgtcgattgaacactacacatgtgatttgtgaacttggtctatgatagcttgaacactacacatgtgatttgtgaactatgacagcaatgaaatcattgtcagcagcaatgaaattagcaacttctactcgtttgatcttcctgggaattagttcattctgctgcgtctcgagaattttcatggctgtcagcagcactcaaatctatgtaatgttttgatgaataacctgatgcgtaacggatggcaaataaatagattcaaaacaaaaaatacaaatgcataatcgtcctcaaaattactagttgtacaagaccatgtgcgatcagttaattacatgtaagggaaccatggtttaaaagaatatattacacactcataaataggctttcaataaaattttagtgagatagatgtgatgttagtttcgtctctttgagcgttggtgggtgcatgggcaggtgtggtgttgcgtgtgtgtaccgtgtaatcgaaaaatacatacatgttcatgccacttttttttcaattctccgaaatctacaatacatacatgttccaagtgtatgtcaacgatggttttatctgtagcttactgccagcagcactgaaagtctgaaaccgtgaagcttttttttaactgtatcaactatggtcattgatttgtgcttttggtagaattagaggtgctcccatgattatgatatgcttcccaacgctaattataggccgcacatttacgctaatgctggaaaagttcttatatttataggacgaagttttagcatctgatttaatacttctaaatttcaggaagaagacaatgatgatgcatgtgtgtatactctgttctaacaatcactcttactggcacaatgtgagcaaaacaacctgcaagcccaaacttcagacatcttgtcgcacaaatcacacctacgatggtcccatcttttaagttaaaaccaagcgtccacaaacttaagattattcatggataaagcatcctaagcagcatctgatcccccccattctcttctatcaacagaagtcagtattgacaggttagacactacctagttcaaacttccaatagtcttatgagcaaagttatatcatatatacgacgagggaggcgcagcaagccaaaccaactgcaaactagtagcctcccttgttaaaagctccaggtctttgccctccttcggatttcggatttcgcatggaggcaggatttcattttctttcatgacaaccatacccagtagtcacagtttgccccccttgtggatgtccagtttccgcatccgtagaaatatcgaccgtgcatcgggcctggtctgtaggtaactttgatctggctcagcacgccgcagtggcagtacatcggcttcttcactgtgatgccggcgtatgggttaacctgcacaggagatcccatcacttccattggcttatggtgtgattggttgggatacggagagtgcgcaggggacgactggcacgttattgactgcggggcagattgccacacaagcgagttggtgatcgaaaacttgaagccccggtgcatcagcaatgcaaggaggcgagcggtgttgcgagcatcatcgagcccacagtgggcacggccctcccatgtaaggccagacaactgaactgcctcttttaagttgcaccggacacccccaaacacttcctggaaaggaaccttcaagtttatccacctgcaatttgtgcaaaagacgtcaatattagaaccacggttggcttctataagaatattcaaaataaactcaggccttttaactcagagactccaacatgacttttaatcattacaaagccaagtaaaaacatgttactctgtacattggatttttacaaggcactgtttgatttggttgggtctccaaaactgaaagtttgaccgttacttttttacaccatattgttcaaacaacaaaattatggccataggaaagtattttaaaatataaatccaatggtgccaattcttaaaacaaaatctagataatgctggactaattctagaagaaaaaaatacaaactttgaacattgatattcgcgtgcgccctatgaaactgaacagagtatcgagtatgcatgcagaaacatctccactacttctcatcataaataagatgagacacgcagcatacagaagaaaaaaacagtcaaattactctattaacctaaccaactttatataaaaagtctatagtgctattcttgtttttaacattatacttccactaataacacattcaaggttgtttctcaccttgttaattacaatgatttcttgtgcaaattggatatagtaacagagcatgaaacataatctcaaaccaggaaatataaaaaaatatacagaacatatatgatgaattttccagttcatgtctaatgagtgtcctgttctcatttatggcacttttttcttcactattttcatatttgccactaccacagtgacctcctaaaaatgtcattttccttttcttacagggcagggtaactgttaagagaattcaagcataatgcatggaaagttcagaaaatcgtaacagaaaaatacaaggacgatattttctatagaatttgtaaactttcagaaaacttaagatcttaaggatgttgcataaatgataaataaacttatcattgtcacctagtagaagttttcatagatttttttcttagtatatcaattttctgagccttttttttcaaatgtgatccttcaatattctgtactttatgatatttttatgctatgagttttgtctttttctcatttttacttttcaaccccctgacagtcaaaccggaaaaatgccttttttttagaagactgctaatgtcgcaaatgtcaaagaccacaaaaattagtggaacaaatgagaatgggagtttcatttgtggcaaacaatttttttccccaaacatgcttgtcttgcaacatatagtctacttctaaatagactatctacttccacaaaatttgaacttgatacctttggaaaagtgaatttccatagtaaaatgtgtcaatgggggattttgcactgtttcttacaaagtccattcaaatttctatgttcaaagacttcaaacaagccctaatatttcatacttacatcatagcgaatagtaaaaacttatcccataatctggtttgatcagagtatagcaactgcagttaagacacactaaaggcacaaggtgaaagaataccttgcaccacagccaaaacgaagaaacaaaaaagaatgcacacagaaccccaaaccggccaattaaagcagctctcctctgtgttcgataaaaaaaagccaaataaagcaccaggcccagccccatagtcaccggtaacccgagtacaacaactggatgggacttgaagaccatcaatgtaaaaaattacaaggggatagttttcttcgaaatgctagttcaggatgcaggatatgacccgaccccaacaaatcagtgtcgatgaattatagaattatcaaataacaaattaaggccccactatttttagcctatagccccagattatcaataggattattcgtgccacacttccaaaagtacgatttctgtcagcgttgcttagttttttctaagttactgtaactttattttatatatatatatatatatatatatatatatatatatatatatatatatatatatacacatacacacacacacacacacacacacacacacacatatatacatacctataaacaagtagatcatccatcaactttcatccggatttcagctaaaaagaacatgacctaaataattataaaatacctacaacacgtattatcaataatcacataattgatagtactctacaaaaaagatcctaatgtaccgctataataaaaccataaaggctgctttctctggctactcctttcattgatgtaaagaaatgtgaaagcaataaaaatataaaagctgcaggctgaagcctctcactcttcccatctctcataaagcatccaagctgcttcctccacaatctccttgtgctcctgctctcctttctccatgaaggagctgtggaaggctgctgtatttcttcaattttgtctaggagtctgagtggcttaccaacttcctacaacctcctaggctgataggcccagcccacatccccctcgtccctctcctttcctctgttctcatccctccctgccacacttcatgaccatacagcaaaccaagttaactactaactcacggatccacaatgaccctgggtcttgaaatgtggcttcaaccctcatcttttttgttctgtccactaggccaacccacatatcgtcctctctcactcccaggcccttatatgagcttgttcagagtgggaaatggaatagcccccccccccccctaaaattctaaaattaggggcaatttttttttgcttaagtatataatactatggcacaagaaagacttaatggattgcaattataacacttgcttgcatcattttttttaaaaaaaaaattcttacgtaaaaaaaaatataacagttgaaaaatatgtttggcagaagattaattattatcagatatatattgttgaagaatttgtttcaagtaattttagacggatgtcgcttttcagtataagttaagatatattaagtgtttacaagcaatctttactattttagcatgaatgcgtaatataattcttaacattgtgaaatgaaaacatatattgcagtaatataatgagaaatatatattttggttattgacacaaatatatgtatactttgtgttttgcaccagggtctcaaattgttgggtacagcctgctcgctccctcaacctccctggcaccctgcccctctcagtgtctaagcctagctgccacaacagcaagcagcgacagcatgattaggtggggcaagaagcaaagcaaagaaaggatgggggagggagagcagcaaatcaatgttagatcaggagaaggagcagcagaggacggactgcattgtaacccaaaaattgcaagaatatggtaccaagctggccgatggggatgagctggggaggaagatgccgcaacatcaaggcagggagaaaatgctggctttgaggcgggtagcacatatccactacacagcgagaccctagggtttccagggtaagcttctccctctcattgtctcccaataaatgcttaggtcacgcctatgtgacgtcttaataatcatgatgttagccaccaaaaatcttggtattaataacttaatctgtaagcctttaacttagtctaaaattgtgctgcttagtcccaataaacaagttagtaaatcccatcctatcttagcttgtttgacgtcacgttccagaaccagaagggaaaccaacaagcagtgatgggtaataggtgggttcagccccaggcctcactggccagttgccagttgccacaatgcaaggccaggcagaaggaaggacaaaagcaggaaataggatggatcggtaactgtggctttaccactaatcaactgttgtatccagttgtttagaggatgagtctccctaacaagggctaaacaatctctctaactggaaattttaacaagctgcctaattgaagatagaatctcaggtaaacatacaaggacagtacagctgctgactggtggcctgcctgattatggtactgacacagtaaaagaacaagaaaaatgtgcaagctggcactttgtacatgatcacaaaagaagtggttgcataatacatgttctgaatctaatatattaccagattgacccaggaaaagaaagttcatcctgtaaaacttttggtctaatgctatgacatggtttttgctgcgttcagataaattactttcttttttcttgtttctgttcagtgcaataatggaaaacacttcagtttactacaaaattaacacgaaggctcctttaaaaagaatcaagtgcatgctccatgtagtgctccaacatactacaaaaattaaaacattagggcaagcaagaaagggaagtttgtttgtgccggtggtttgcttttcgtttttgttcccctttgcttcttccaactcatgttcaattcaaacttgattctaagtagatgtatgctaagttaagaacttcattcagtttcctttggactttttatgctgattttgtagtgaaattaaataagtgtacaggtttaaaccaatgccatggtttgcaatacacaaaatggcatggctcctcatgttaatgtttgaagatgccagaaaaaaaaggagttcccttgagaatggtaaatatgtaaactgattgtcatgggcatcccctagcggatgaacagtaccacgggcactgtagcagttggttaggagatggataagattagtttgagttagtttcttaaggatcaagtcatatcatctctatataagggaagtattgtattcatctcaagtgaagcaatgaatatcaattagtctaatgtctccctcccaacaatgttcttctccctagcctaaatctacatcccttctccaggagccgacgccgcccggctatcttcccgacggtgtttatcccgtcatggcctcgggtcatgacaacttggtatcagagccactcaccatggcttccaatgccaagtgagttctccgtatcacggtgagccatctagtgtacccggtggatgagtatctactccaccagttgtttgatggttacggagcagaaaagaatatcaaagtgttccagatgggaacacatgtggaggcttctattccgttccaaactagagcggccgctgagcatgcttggaaactcaatggccgtgccatctatgacggctgttgttggctgaacatacagtgggcgcaaccttctagtagcacccccgcagcggcaacacctcttgtcgggatcactaaggaattgatagcaaatgtgcttgaattgaaggccatgttgaaggagagtaatgcatcaaaagaggtggaagatgggcgcacaaagcagaaggtggcagcggtagacctagcagtcatggcgccagttgctatgccattaactcagatgtccccgccggcggactccttggtggagcaagagatggcaacacagcagaagaccgtggagggcacgacgaggacattgccagcagtggtgccatcgtctcagtttcctccatcagaggctggtttctcgaactcaaaggagcaagaggcagcgccagcgtggtcctcggaggcgggcggaatggcatggcacgaaggtgggtcggcgttttgcgtgaaggtggagcacagtgatggcgcgtgttgcgcgcagccagggtacgaggccattgcgtggcagcacgattttctgttttagatgggctgcgtgtctccgattcgttggcggcgccgcggtttcagagagatgcagctttgcttcctcccatgtgttggctgttgggctggccgggtcgactattgctgaagacaacggggacctccaaatggtcctggtttaataggtggccacgtgagattttttcagtaacgtcaaaactaagttgctgggcttacaaacttaggacgtggagaacttcaatccttcctgtaacagcatccggatggggtccaccagtgagtgtcgttgacaagatgatattgataccctagcttctgtcatcttagatttattagtttgcactaaagtagcaagtcgagatgtaaaaggcttaagtcactgttaagttttatttagagagtcatcaggcatggcatcactgtgttgcagctcgaggacgagctgctcaaatggaggggtgtagtgtcatgggcatcccctagcggatgaacagtaccacggccactgtagcagttggttaggagatggataagattagattgagttagtttcttaagggtcaagtcacatcatctctatataagggaagtattgtattcatctcaagtgaagcaatgaatatcaattagtctaatgtctccctcccaacaatgttcttctccctagcctaaatctacatcccttctccaggagccgacgccgcccggctatcttcccgacggtgtttatcctgtcatggcctcgggtcatgacactgatgacctaaatttcacactagaaattgaaaaataataatacattgagacagtaatctattgttacgactgaataaatgccaagtcacattaacatggcaagttgtaacataattacaaatccatgtaaaattttgtgcaacaaacacaactaaactattacgtgcaagagagtacaaaactaaggggctgtttgaatcagggactaaaattttagtccctatcacataggatgtttggacattaattagaagtattaaatgtagactaatgacaaacccattccataaccctagactaattcgcgagacgaatctattgagcctaattaatccatgattagcctatgtgatgctatagtaaatatgctaattatggattaattagacttaaaaattttgtctcgcgaattagctctcatttatgcaattagttttattattagtctacatttaatacttctaattagtgtccaaacatccgatgtgacagagattaggtttagtccctggatccaaacaccacctaaacacattagtatagcatgtgaatgttatatcgaaacagaacaggcagcccaagggccaggtaaatatgggatatctgttacctgttaaagtaagggggcttcctgattctctttaatctgcactcagattccaacattacacggcaatcccagttagaccatgtcacaacagcgaagttcttgtgcttaatccctttttcctccaaccacttatcatgcatgagcaatgcctcacttagaggcacacctctgtctacctagacatgcatggaaaaaactatattacctctgaatgaaagaatacttaaaactatcgatcgtatttgtgtgagtaagacataatttttcaaagtgggtaaaatgcagtttcaataagataacaaaattcacatattaatatgtaaatattatgagtttaaatatatgaaagaataaagaacgataatttgttcactaaacatattaggtatgatttgtcatcaaatggattaaatatgttgagttatagactccagagccaaccttgccattaaaaaaaccatctttaaacataaactttaagcacaacttgaagagctcgtaaacaaaaggttataagtaactatgcctgtcatgtgctaaacttgaaatatgatagctaagaatagctgacataatgcaaccaaatctaaatttatatggaaatgcatacttccttacagtttccactttatcagtgtcaaatcaaatgttgcctgaaatacagaacctagttgttttcttgacagatcatcaattgcaaacaagaaacagaaaacaacaagaccctgctcataatgttcaactgccatctctccttggatggctctgaagacaatatcagcagaaatgtgatggctctatggatggttcaggtaaaatagtgagttggaatatttggaagaagatgattcagtaaagctcttagccaaagaaacaaagcttcatatcaaagagagagaagatccaggtgtgaaaggactgtgttcgaccaatcatggattgataggataagtagaacaccacagtacatctttggactatggattgtaaattgatctttgtcatacaaagcacctaaggaacaaatacataaatggtgatttatctaatctagcctacaggagacacatttgaccaagaaattttactgaattctaagaaaattttagtgtgcttataccagttctctaaattggctaataggtgatgcaagctggtaagccacccaacttggagcctagtgcctcaactgtacactggtttttcaatcggcagtaacatgaaacattggctctttttttcctatacacttttaagtacataaatgatcacttagcaatgaaggctattaggccaagcaatcatgttgaaacctttttaatcttgcgtggttatcaaagataacgaatattcaaaactataataggcaccaacctgaatttgttgaatgcccgtaagctccttgcaaaagtcagtcaaaagttgattatatgccggccgaacatacgtttggaaggaagcttcaagttgtccagttgcactgttaaccaagacagatggaaactcaatgatttcttgtggatgtggattgttctccttgtcacaggttgcttcaaagtcaataaccacaaaatattgaaattcctgaagttgtgcatcaggagggtaaccttgagggggcatcttgaatggaagatattgaactctactctcaataggaaaactgtggtccctgtttatttgataaaattggttatctaagttgtaaggttgtggctgtcccggcatttggtaatcagcataaataaatggataggcataatattctgtccgttgaacgggtctgaaaaagccttgatttggaagaggagatgcctccaagactctttctgttgcaatactatcattctttttttcactattctcaggaaacccgttgcttctctgctcttgcaggttatactgagaaattggcttgaggcaccccagaggtgcctctttattaacttgcatttcctctgcataaaataattcaggttaggacataataaattaacactgcaatgtgacaaagttcatgcagttccagaaaaatattgaacttgcaccatttactatcatatcatacgcaacctgatcatttgcaatgaatacttcaggacatcaaaagatgccaagataacatatttccctcaaacaattaatggctgaagtagttcatacactaaggtccaagcaggatattttcatagcaaaggcggcatctcaaaagagcaccgaaaaattaatgcttaaatacagtgtttgacactgggaactactataacagaaaaaaaatgtttcattagtctctgggttaatatgtagggtaccacttgacaagaacaaccgccaattcaaattattatataataaaaaaaaagctatgctccttagtaagctggaaatgtgggttaatatgtagggtaccacttgacaagaacaaccgccaattcaaattattatataataaaaaaaaagctatgctccttagtaagctggaaatgtaggctgtaattctatcgctcatcatccaaacaagaaaagaaagtagaaccttttttttttccatgtaaagggacaaaaaactttttgtttgcaagattacagcactttctgataactatgcactatcatttgacctgagcgcaatatgagtgcaaaaaaaaaaaaaaagaagctaaaacagcagtgcaatctccattggagtttgagttagcttgttgatcaaaggaactgggaaatattcgtgtactagatcatgaactataagtcactcgtatgcaggggcggatccaacttgggacatggggattcaattgaacccgcaaacttttgggcgaacaaaaaaactgttattacttgaattaagagaggtttaaggctatcaaattaaggaggaggagaagatctagaagagaagctagtagggttcacgaacgcaagcaaattccagtcccggtggggtgggagagagagagagagagagatgaatcagaaggaggacgcggatgctcaccaggatcccctcccctccgctgctctgctcgccagatggagatcgccgcccggccctcccctgttcagccgcgacgcgactcgtcttggcggcggcgcaaggagcggaggagacaacgagaacgagacggggagatttctttttcttttacgcgatactcgactagagatggcaatgggaaacatgacacgatatccgacgggtttttactctatcagggaaaaaatgttctaacttttatatctacggatctactaaataactcttacctattaaataagtgtgtatggatatgttttttacctatacctatatgtacccaccatccgttggtgaaagaaaaccatagattgaacctaaaaagaaactcgtagattgaacctaaaacaataaataacgtaagtccctctaactactaaattatagcataaaactcctttcatatattaagcattattccaatttagttatatgaaattattatttaatttcttgattacgtaatgttgttgtataattttctttttactcgcgttgtagaattttctttttactcgcctttgaatgataatcttaatagcattgttgctagagaaaatattaatggtttacagttctaatatggctaattacagtacaaaactataaattctacaagtcaattatatgggtatgggtacccgttacctacacgggtgtgggtacgggacgattctgtacccgcgacgggtgtggtatttaagtgggaatatttatccatcgcgggtgtgggtatggggcaagagaacccgatgggtattgtaacgccccgattttcattcgggattaaaaatcattaaataatgcattttctagaaaataaataaaaattaaagcaatttaatcaagtgaaataatgagggactttaaaatttcctttaaaaatcatggccaaaaatattttgtaatattctcggtgtcctaaaatactctctgaaatttctcgcgaattttcggagctcaagaaataattttaatagaacaaagttcatttaatcaattaaaataaagagaaaacgaattaaaatccttctcctttgctttgggccaaaaaccgcctcctctcaggccggcccagctcacttcccctccccctctcactcaaagtccacctcccctcccattccggtcccctctccctccctctctccgacaggtgggacccgcagccccacctgtcatccccaacctccagccacccaccggcagccgccagccacgccgcccacattgccgcttcctccagcctcctcgcgccttctcacatgcaggcttggacgccgcccatcccctccacctcctcgaccaaacccccctactcgtcccacaaaaatcggcatcggccaagccgccaccaccccacgtcgctacccccactttcccccttcaaatccgccacgtccggccacgatcttcatccccgagccctataaaaacactcccagcacctccctctccatttttccctattctccccgagctccctgcgccccctcccgttctccccacgccgagcccgtgctccgccgctaaccgacgagctctggccgcgcgccgccgccgctagagccgccgccgccctacgccacctgcaccaccagctccgccacttcacgttgcagaacaaccgacgcgcccctctttcattccaccgcccgaacgctgcttccaccgccaacccaagccgccactaccatatgttgcctccggccggccgttgccgccgcgctagccatcaccacgcctcaccgcttgcgctgtcgacttcgctgcatcaagctccaccccgggggctgctttgctcctccaacccaccgcctaaacgccttctccctcgcgctcccaagccacagccgcctttggctgccttcagccgctccccgcgtgcgagaggggtttcgcccggccgtgccaccacctttcctaggtcgtcctgatcctcggccgtccctctgtcgtcgccgtcagtcaccggagcgccgccgcctccctccgcctctccttttttcccctcctccgctgctccccttgcccgcgttgtgctgccgtcgctgctggccgtccggccgggtgccgccgccgcctgttcgagccggctgacgagccagcccccttcctccgttgcctattttggcgctgcccgtggaccgcctgtgctcctggtcctcggcgccacctagaccgcggtggacttggtccaccgtgtgcccttcccttggagccgctgacgtgcgaaaagcttctcccttttgctgacgtcagcgatcacctattttccctttaaaaataattaataattacgcaataaatcgagtttaattgtagaaatccatttaaatggctcaaaacttctaaaattcatatataattcattcgaactttaaattgggccattcaaattgcaaaattcatcttaaattgagctctacatgtttgtttacttttgatgtattgtttacttggtttttagggtttttcatcgttttgcatgccagtgtgtagaatccgtcatttcggaagttcgcgatcgcgaggaaaagagttcagaagatcttttgaagaagcaaggcaagtcatacattccccccttgagcatattgagcctactttataaatgttttaccgtttgcaaataaatatgcatgttttgctaattacatgggataagggtacaacctatctgctcgcttgtgccatattatttgatgtccgtcctttgtcaaacttgggtgataattcgactagcttgtgttacttatgttgacctagctagaactacatgcttagccatgcttaattaccactagctcacataatgggataattacagttttagacatctagtatcttgacgagctgcatgctcgagacatccggccatgtttcattggtcataattatccaactaaaatgcggctgaatgtgggctgtaggtgcatggttttgctagtcgcgcccatagtaattaaggaccggttcacgggaaaccctggaagacttacagtgcttaacacaagcgggaataggtaactgcttgatctgtagtatagctcgaccctttcctaggcaccggtggcgagggtgggcgtgatggagttgggtcgaacggggtgtccggttttccagatgccagattcaccgcgatgcacgaggggactgcccacctccggggtagggggtgggggtgaaacctttgcgtggtgtggatggttaggggagggttatgtgaagggtcttgtcacaatcactcaacatagtgatgtgtctgcgtaggcacggtgacatgccggtggattgtgacttgtgggtatagttgtgcacctctggcaagagtaaaactattcgaatagccgtgcccgcggttatgggcgatcaaccatattcaccgtgattagtctcacctttaactggcttaatgaactaggtagtttaggtggtttggttgggcctgttcaacgtggtgtagcgttgatcagtggagatttaatattaccttaattaatcaactgttttattgtttcgctcaataaaatgctttgcaaccgccactacaagaatctatttaatctgtgacgaaattttcgtgatgtttttagatattgtcacggatatgcaactatggatacaaggcccataataccgtgacagtttatcgatttcgtcataaaccggcccaaaacctgtgacgttatagcaatttcgttgctatttaaatacttcaaaaccatataagagatatgtaaattttgtgaacaatgttactatcacttcatcggatgaagaaatgaccaaaataaaagttatagatattgatgagttatacaactttgatgttgataactttttcagttgaaatcatttagtatttgaaaatattgtttgaagttgtcataatttgaaattcaaattcaaattattgaaatagagtcatatagcaaaatgaccaaaataaaagttgtagatatcgatgatttatgcaactttaatattaccttaattaatcaactgttttattgttttgctcaataaaatgctttgcaacgcgccttcatgcaaatagccacaagccctccgttgtatccccttgcacgtctgcatcactggtgtggcttgctgagtacagttattgtactcagccttgctattattctccttttttagaagtgtagcgcttctgagctgaagacgatgttagaggaccaaggctcagaccccagttgagttttgcctgtggagtggagctgaagcccccgataggattgcctgacatggagccagtgcacaggcgcactaccccggccacatcggttattcgactggtcacagaccggtcacggaacagtcaagcgcaccacgccagcgcgtggtgcgctctctcagaccgccttaaatgcggttaggtgggcgctggaagcgcccgtctaatgcggcacatgcgacgccgcgcggaggaggtcggggtagcccgatgcccgggcatgcgggagcggctgccgccccgcctcgggcccaaccccctctgggggagggccacgtggctaccgggggaagcctctcctctatagcctttataccccgggcccatatcaccgtcacaatgtatttatgtttggctccatctcttaagagcaagtgtaataagattttaagcgatgtcccaaaagtgccacatatgatcgactttagttaaatttgtttattttatatcgtttcaagcatatgaatttctattattttttattggtcttagtattatttacctttgtagatattcaccgaagtgtagtttcttaggagtatgttacaattttcttttatgtcccatcctgatagaaaggaaagcatatgtagttggatgttgatttagtagctgaatcaataattgataggtatgaaaaaggaagatcaatgcatgactgtagaagaaaaatccattattgagagcaataccaaacacgttacagttgttaaatcaactattttcctaacaaacattgaagaaagatacagtagtgagagctatggtaaggactttatatttgttaatcaaccatttttcctaacaaatattttgaagaaaaccccaatggtgagagctatgactagcgctttttatttgttcaccaataataattttcctaacaaacgtttagttggtggattgattcctatatctttttgtcaactgctaaccatatacataaatatatcaggcatacatgtatgaagtttttattgaaaaataattccactagtcagcgtagcatttcccggtatatttgttttgttgccactttcaactttatcaatttttaataggacaataaaccaaatcatctcttactataaaattgtaacccactaactactaaaacttaacatgcaaaaatgtcacatcatcatccactaacaatcattaaatttaaacaacatgcaaacatgttatattatctataattttataaattattaaattttcgagctttcaaaaatgtaagcatgttaaatcatcatcgcacataattcacataatattttaatatatatttattatttttttataatatgctatatacatatatagttcatcatcacttaattaatatttatttctctcttctctcattaagccatatcacatcaattttttttaagtgcttaaatgaataatctatggtccaaattatctctctcattttcttctctcattaatccatatcaccttaattatttttagcctttagataattaatctacggtccaaactatcccaatacttttcttctttcataaagtcatatcaccatacttttacatttaaatcatcattctatatactattcaaatttaaattatcataaaccacgttaacttacgtaatcttatattatctagaaatcctacacattatttttatttattgttaccatactaaagtcccgcagcaacgcgcggggtttcacctagtatactataaccatcattaccaaactaaatcaaacgtattccaaccattgttaacatacaaaattttggtagttttgagatctcccaccctttaaatcacatcaaaatctgttcgaaccaaatatatctcctcatagtcaaaagagtaaaatacagtagcggtccttaaacttgtcatgaggtttcacttaggtccacgaacttgcaaaacgcacatcaaggcctctaaacttggtttattgtatcatcccggtccaaaatctagtttgaccatggtctaacctacgtggcatgccacgtgtgcgtgtgccacgtgcacgatgagatgggattagtgagaggggcagggtgggtgccgcagctcctgcacgccactaccgtcactcccttcttgcgctgccgccgctccctccgtgtgccaacgccgccgtcgctgccccctccgtgcgccgccgtcgctcccactgcctgctgccccctccctccctctgcgcatcagcgccgctgtcagaatccagacagcattcagaggcttcctggtaagcaatgggtgctcgtgttctagctctgcttcgatggagtaatcatgccgtgtgtttgtgcaggcgaagaaggcgctggtgaagctgcaggcgctggtgcgtggcttcctcgttcgccggcaggccgccgccacgctgcagagcatgcaggcgctcatcgcgcgcaggccaccgtgcgcgcccactgcatcggcgccggcgccgccgcccatctccctcacatccaccacgctcccttttggccccgccgctcgctggtacgccgctggcgaaatctcgccgacgacatcaccatgtatatattcgccgtactagttctgttcgatcttgacgttgtgtgttggcgatggatgcagcaggagaggtgcgccaccgacgatacgaggagcgagcacggcgtagcggcgtacagccggcggctgtcgacgagcatcgagtcgtcgtcgtacgggtacgaccggagccccaagatcgtggaggtggacattgggaggcccaagtcgcggtcgtcgtcgtcgcggcgggcgagatccccactgctcgacgccgggtgcgcgagcggcggcgaggagtggtgcgccaactccatgtcgtcgctgctgccgtgctacctccccggcggcgctgccgcaccgccgccccgcatcgccgtccccgacgtcacgccacttcccggactacgactggtgcacgctggagaaggcccggccggcgacggtgcagagcacgccgcgctacgcgcacgcgccgccgaagcagcggccgtagccgcggctgccgctgctcctcatccctccgcgcaccaaagccgtccctccctcccttccgccatctctgctgcatttgtcggtcgccgtgcagcgttgtcgttgtcactaaccatggcgaccggatctggcgacctcgctgtcctcgtcgccaccacggtcccccgacagtcgtgaggagagtggagagacctcgagctcgccaatggagaggggagagagctcgagcttgttgtcctctgccacacggagctcgacgctgccgataccgtcgcccttcgcctaggagttcgttggggaggagagaggtggcccgatctgcgcagagagagagagagagaaagagagagaggaaaggcgatgccgccagggatgagagaggcggcgctgccgccggcggtgagcggagtgggaggggaggcgtcggtggcgtcaggccatctccgtcagtggggaaaaggaggtggggaggggatgagaggggaataagaaggaagaaaaaaaataaaaaaagtctatgttatcgtccacattgcgtgccacgtaggcaacaccatggtcaaaccagattttagaccaggatgatacaataaaccaagtttaaagatcttgatgtgtgttttacaagttcgtggacctaagtgaaacatcatgacaagtttaagaaccgctggtgcattttactctagtcaaaactagttatcgccaaacccaattttgacaagtttgcaagtttcaacaagtaatatttttcttactccctgccacctactccctccgtcccaaaatagctaaacctaggaggggatgtgacattttctagtgcaataaatctggataaaaggctatctagattcattgtattatttttttctttgaaaacacaaaccttttattagaggacagcattagggaaataattcccggtacatcaacaaaagatgaaacataaagtacttaaccatccatctagagaggaagggtagttcaacaaaggaaacataattcctaatgaaaccatggggctgtaaaaagatgtgatcagcagggagccgcggcattgccgcgacgattacatccaaagacctcttttagcatacaccctacttgacaaactggtaatcctcttcggctgcctccacgggaacggcacaattttgaggttcgttgttaagccgtagattttggtgtgcttcaccgggatcaacataaatattccacggagttctccgttgaatctgagaagcactaactgcaatcctgttgatcaggactgaacatgcgatctgtgctcaacgtaaacgaaaaaccctgcatggttactgccacaaggaaaacaataggaaaagtgcttgcctagatcttggatttggggctggctcctccacatcgattcctgccacttgtctccacttgatttgccaaaagcaggtagtagaggccaccggtccttctctcggtcaaaaggccatccaaaccatctccaaaaatctccgccgccctcttctccaaccaactccgccgccatatgatgaaccttgagttcctctcaacactcaaggctgttgttggcccgatctttcggtgagttgtgataactacgatttgggagaaatgttgacgatccgactacaaccgtacaagacgttctgttgcgccttagcgatcgatacgcctctccgtgggttgttgatcttgccagtgcagatcaatcttattcctgcaagcaaatcgaagaaacaagcaagaacaagataaaagcaatctgaattacaaataggaatgaatacacaagataagttggggttccgaagaacaagcagacggacggtctagccgacacgcgtgctgcaagcaagtagcaatggctaaactttaatctatcaaaacccaagaaactctaaaggggtacctaactatttaaggaggtgggaggacgacctaaggggaccctagggtcgtgctccacctggttggggcgcaccccacatgggccccacttgggccggggttccagacgaagttataagcccataggccattataggtgacgcaacaccttctttttgtgatttcggccga

SEQ ID NO: 79273 - DNA, 22645 bp, Oryza sativa
ccaagtgggacccaagtggggtgcgccccaaccaggtggagcacgaccctagagtccctttggtcgtcctcccacctctttaaatagtttggtaccccttcagggtttcttgggttttgtttagatgaaagtttagccattgctacttccttgcagtgcgtgtgtcggctagaccgtccgtctgattgtattcggaaccccaacttatcatttgtattcagttcctatttgcaatatcagattgcttttatcttgttcttgtttgtttcttcgatttgtttgcaggaatagggttgatttgcaccagcaagatcaacaacccacggagaggtgtatcgatcgctaaggcacaacacaacgtcttgtacggttgtagtcgggtcatcaacgtttctttcaaatcgtagttatctcaactcaccgaaagatcgggccaacaacagccttgagtttctgagtggaactcagggtacatcaggtggtatcagagcttttgttgctcggtgagtttttatctacctataaccagaaaatagccatacaaaaaaattgcatccatcacctagacatctttgtgccattgcttcgttctattcagtttttgctttgttgagttttgcgttgcatggttagtcgtgtttctggtcttagcgtctagagtttcaaattctggtcacatttagtaccactgtcgtcgtgtgcttgttgtcgtcgggacgtacaaaaacggaatcgtctttccgccagggtttcatttttcttagttttcagaagtttttctggtcagttttggagttgcatataggttatataggtttttgtcatgtgcatcccgtcatacgtgatggtgcgcctgtgctgctgcgcacgagtaggatggaagcaagggactagattagattggtttctctttgttcagaagaaatagaagattagattagattagattagattagattgatcggtttctatttgaaccggattcggttttccttgcatgcgagttttccttgttttattcggccgtggtggccttcacattaacaggcgagtgagtccgactccctcctccctctccaaatcaccttgtctctctcagttatgagtcctgtcaaacaatttggtgaaattctgttttatgtcggttttgagatctatttgaaaaaatggaactggcataatttgaggtttggacttttacatttgagtccctataatttctgtatttacatttgagtccctgtaatcttacattaaggtccttgagtcggtttttgttaaaaaaatcaaaaaaaagtgagaaaaggcagaaaggtgcgtacaaaagaaaaaaaaagccgcaccaaaaaaagaaaaaaagagaagaaagaaagaaaagtaaaaaaagaaagaaagagagaaggaaaaggaaaaaaatcaattgtatatttgagtttgctttcatatatcagagtgtgcttgagttgtttctagtgctatctggtggtaccgtttgtgtctaggctcgcgtctctagtacgttctagcctaggaccagcacggtactgactttaaacgattattcaacttcgcattatctgatttgagcatttgctacatatttaagcctacccagagctccacatatttgattgcatccgtacagcaagtgtttgccaagacattgatacatccaacctccattggggtgcttggttgagtcggtgtatatcaccattccgcttgcattggtaataatctgtaagagcttggtgaaaagctggagtgtgtgtgactttttcgcctccactacctagtagttaataggagcgtgcatattttgtgtgtgtttcttgtttgctactaaccatggcaaggttacgcaaggagattggagcagctcatgcaaaacgtggatattttcatcttcgacaacaaatggtaggtgatccacatggcgcatataaggtacatgataatgatcttgcaagggtagaatctaatttgccagtttttgatggtaagtatgatttcgccgcttatattaattgggaactagcagtagacaaacagtttgatgagtatgatttctctaatgcttaaatgattaaggctgctagtaataagtgtaccggttctgcatctttttggtggtatactgttggcaataagcttgaaacttgggatgaatgctaaacaatgatgaggaaaaattttgtgttttcatattataaacgaactctccttgagaaattataacatctaaaacaaggtgacaaaactgtgtgggagtattttcataacttcaaattttgtatcacttatagtggtttaaaagaaagcaatgagaacacaatgactagatttttcaaagggcttaattccgatattcaggcttggcttattaacatgacatataatcatataggccacttgttcatgcttgcttgcagtgttaagagcaatattttaaagaacccaaaggagaaacaaactatgcttgtgcctcctattactgacattttgcaggaagctcagaaaattcaccatgaggagaagagcaatatgatcgagatgccatctctatcgcttatgaaggaagaagagaagactgatgcacctacattatctaaagagggtataaaagataaattaaattgtgctgatattactcaaggtgagcgtgcttctgatgagtcacatttgtccactatccatgctaatctagagcaaattttggtggaaactacttctgatttgcctttgtcacaagttgatttacttgttgttccctgtgataaagaagagttgtgtgataatgcttcacttatatccatgccacaattagtgaatgaacatgctatttctagtgttccattgtgtgctaattttaagcatgttgttcacattgctaatgatgttgaggaacgtaaattgataacttctttaaatactttgggctatgttcagtttgatgatttttgtgagctcgataatttggaggagaaattatttgctaagtatgatttgccatgtccaactaatgctatttttaatatctttggcgaatataatgatagaggaatatatttggtgcatagagttttcattttttcggatttagagaaacatgttattgttaatcacactacttcgagtttctctagttttgattggatgaaacaggttattttgaatgaactatgtgaagagcaccatatgaaaaaactgaggacgattttccatgaagaaggggaggatgatgtgaccatggctactacggatacaaccgttgctcacatcatggatgaacaagaaaatatcaagatcaagtcctccatgtgctggaatccgattcggccacctgctacactgttgacttcaaacagccgccaaatctacatacgacctccattttcatcccgtgagtacttgatggaaagctctcggagtcctctttccaacggatctagcctcatcgccaaattccatccaagtcatccttcacctggttggggcgcaccccacatgggccttggtcccaaacgaagttacaagcccaaaggtccatgacaggtgacgcaacaccttgtttcttcatatgcggatgacttggatggaatttggcgatgaggctggatctgttggaaagaggactccgagagctatttgatagatccgacccaggtggggttgacctaggcccaataaattaaggttgcccgaaccccaacagttcttaggcacacccactcgggaaaatgcccaatctccctaaaagactagtccaataggggaagggtggcactcccttttaaggtcgtttcctgctcccaagctaagcaaggtgggattattcagatgctcacacggtcgccgcccgactacaactggaccacttggccccttgttgtgtctttgccagcggttaatagtggaggatatcctcatcatttccacccccttaaacaagggcccagctctaataccaaacgatagatccggcccaggtggggttggccaaggcccaataaattaaggttacccgaaccccaacagttcttaggcacacccacttaggaaaatgtccaatcaccctaaaagactagtccaataggggaagggtggctctcccttttaaggctttaaatagctaggtaccccttcagggtttcttgggttatttttagatgaaagtttagccattgctacttccttgcggtgcgcgtgtcggctagaccatccgtcttcttgtatttggaaccccaacttatcattcgtattcaatttctatttgcaatattagattgcttttatcttgttcttacttgtttcttcgatttgcttgcaggaatagggttgatttgcaccggcaagattaacaacccacggagaggtgaatcgatcgctaaggcgcaacgcaacgtcttgtacggttgtagtcgggtcgtcaacgtttcttccaaatcatagttatctcaactcaccgaaagatcgggccaacaacagccttgagtttcgagtggaactcaaggtacatcatagccacctcataagcaacttgggactaatctcctgtactcaagctcaataaacgcattagcccctttaaccatttagtcattaataaccaaaatccactaggggatagatgcactttcaatgttcactttgattcccttaactagtggccagatataattcgtatccttcgaccgcaatatcggatatctcaaacccccaactattaaagccagtgcattttgactttctcagtgatttcactgacatggcacatacatggcggtgttgacatggttttcgttcaacgtgacgcttatttggcattagaattaaaaaaatatgtgggacccatttgtcaaaaaatattgtggggcccacatatcatcatctccttcccttcttcctcctctctctctcctctcttaggacaatgatggcgtatgtttatgttcagttccgatccaccaccatcgccgtcgccaactgctgctctcctctgacccacgtccttctgcctcggctgatccttctcctccgccaccgtcgctagttgttgcttcttggtgaatatatctgtccacctctttgacctgcctcctccacccgacgccgcggcgaccggcggtgcccttgacgtgatggccgcacaggctcatcatcgtatgtgacgccaaggcagctggagaggtgggcgccatggtggggatggaggagggggagagggagggaggacgccgccagagaagagctcgtcggcgcaggagggggaagcagcgggatcggtgtcgaggggccagaagtgaaacttcggggaggatgaggaggaggcgctgctcagtcgcctctaggcgccggctacggccacagccattgaattggtgcatgactgtttcttggaaggaagatggggggagaggggggaatggtgaggctttgtacgggggtgatgtggcttacgggagggaagaggaggaggaagaagaataggggaggtgggacccacacacgccctcccattttctgatgcagttaagagaagattaattctaatactacataagcgtcacgttggatgaaaaacatgacaacaccgtcacgtatatgccagtcagcgaaactgccctatagagagaatcaaattgcaccagttttaatactttggcgtttgagatatccggtattgtggttcaaaatatgaattacattcggtcattagttaagggagtccaagtgaatttaggctcagatctaaagtacagagttggctgggctgagctgaaatggtagcaggctgaataggttgggctgaatggcagtgcattgactccctcggtgcaacagtgctgtggatggtagcagcacattaagtaataagttcatctaaggtcccttatttttgtcaacgaatccgatttacgtccttcaaccgcaaaaccagatacaacaggtcccgcaactatcaaaaccggtgcagattaggtccctcggcggtttcgatggcggttttggctgacgtggcgcctacgtggctaatttgactcggtctcaatctgacatggcactgatgtgggcgcttacgtggcaatttgatccgaaaaaataataaaccctgtgggacccatatgtcagtttcacacacaaattaataaaagaatggcggggcccacgtgggccccacacgtcagtctaactcacccctcctcttctgcttcctctctccccatctcccctctttttatctctcttgcaacgacggcggcagcagaaatggagaagagtggccgccggccaactcgctcttgcacgcgctcggcggtagaccagggagctcgcctagctccttcccaccggtcgtcgcccttgtccccgatggccgccgtccgccgcccttctccccaatgaccgtcggcgagagaggagggaacggcgcgcggcggcgtcagccggagaggagggagcggggccaccactttcaccagcgccccacaacgacggcttgccggcgccgctcgccgcggtgacgacgatgaccgtggatgtggcggcgccagcgctggccgccggcgtcgtcaacaacgactcgttggaggacgaggtgccgtcaacgtacattccgatggcggccttcctaaccttgagcacgaatagcagcagcgtgaaccagacgatggcctggaagacggagagctggacaactgttagcattatttttgtgtggcagttagcttcgtgcatgcggctagctagtggctgccgaattaattggatcgcgtgctgcgtgcgcgtacaatgcggccgaagtttgtttgcttagtggtgtgtctgctgggctataaaagtcatgtaatctcctgagttaagtgtcaagtgaatgagaaaaactagataaggcgtttgttgtcgagaaattcttctgtgtttgtccacaaagatttttgctccagctagttgaagtgtgcgtgttgctgtaatcctgttaacgacccacttcaacaatgcaattttagaagtagtagtatcaaatccaacacaaggagctagtgaatctgttacaatagtggaaggttttggggtggaagatggagggatacaagggttagaaggttctagtaacttctagacaagtagaggaagagggaaggtagagatcgacaaggaggcaagcccgcctccaggttgttgtcgccgccgttcgccgccttggccaattgatcggtcgatcgatctcctgtaggctgctgctgctcatgtattgtttcaattggacttgtttgggctacatggccatgggctgaccagcctgtggtgcagtcagcggcccatgtgcagcccacctgagacactgacaaatccttggccagagctgacaatgacgagctgctacgcccactcgccgtacatggcgcgcgccatgggcacaccgacgacgagcgagttggtcagcgtggacagcgagaagctggtgatggaccagcgatggcgcagccgcctttgctcatgaaccgtgcccagacgccgatgacggcgacgggttcgtcctgactagatccagatccctcgggatccaccaagagaggcttgagctcggcagcggcggcgagggggtcgggtgaggcgcgggcagcacgaagtcgagcggcgaggtcggctacgaggaggcagcggcgaggtgctcctgcctgtcacgcccggaatttctatccaaaattccaaacgcttacatgtgtgtgaaccctcgtccaggaatcagtcgaggcacacaataacaaattgataatagagtacaattattactctaattaataagcgaataaaatgtcattacagaggtagatagttcctctcaatcaataaagatctaagcagcggaaaataaaaaactagcgaagctccggctccactccacaggcaacttgaccaaggctacacctaatcctccactccatcagcttcactgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaatatttcagaatttaataaaacagttaagtattaatcaatattaatccaacgctatacaacataccctgttgtataggcccaaccattctgaacaaccatcccggctgcacagttctatctccaaaccaggaatataccattccaaaccaggagctaatcaaattattaccaattatagcatcatttactaaggtgagaagggtgagactaatcacgaaagacattgttagacccgcccataaccgcgggcacggctattcgaatagttttactttgatcagaggtgtaccactgtacccacaagacacaaccccacatcatgtcaccatgtgcctcaataccaccacggtatctcggaaaggagtcgtgacaatacccctcgcataacacaatccactgcaatgcaccctcccggatcatagtcacccccttataaacaaggtatggactccccagcgaacccccgtgggcttatctccgccacttctcagtctggtgctccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattatctaatcacgattaaccatcgtgaactatcaataaactatcatgaaataatagtgtggcattagttatcccatgaatgtgctaatgtttctaagcagggctaagcaattatatctaatatctagttgaaccagtataaataaataaagctcaactagtcaaattataacccaaggtatcaaggaataaggtaatcaagaacaaaagggctatatcaaacaataggttaaatccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacaaaaacaagcttgaacagtacatgtggatatttttaatgtgtagatctcaattttagaaaaatttagagacttgaaccaactaaatcggagctaagatgaattagttatgaatttttaaagattaaatcggattaaaacacttaaatcggttaaaattgaattatgatgcaataatgaattatttttgaaaaggaaaagagggtttattgcgtcagcgggctagggtttggtggaccgggcgcacgggcgacggttcacgcaaacggacggccaagattgatcccacccaaaacggacggctgagatcgatcgggtccacagcggctcacgggagacgattccgatgacgtcagcggtgacgtcaccgacagcggcggcggctcggcggaggagacggctcgggcggcgcacgttcgccggcgaacggcggcacctcggcacaaacggagggcaccagcacgtagaggacaacgcggcgaacacaccggtgaccaaaacggcggcggaggaggaacggacgacgacggcgacgaggaggaagcggcggctaccttcgggttgtcgacggcgacgatgctccggcgggttccgacggctgcgaaggggcggacgaggacggcgacgacttgacgagcacaacggcggtcttcccgagcgacggcgacggctgaaacgacggcggagcacggctgagattgcggcggcgacggcgaagctagggcacacggcgctagaacgattccggcgacgagaggcgaaggcgagggtggcggcgggtagaagagacaccgggggtccttttaaaggggctcggaggcggcggcgaaagcccacggcgacggcaacggcgaaggaaagctcggcttggagagagggaaaccgatccgaaacgaactcgactccgacgctttccaaagcgatttagccaaagattccaaaggagaaaaggtagaggagatcccgaggatcatttcccctctatcaattcggccggagaaggaaaggaacggccggatttggaaaggaaacggcggcggcgacgctagggtttgcgggcggcggcggccgaaggaggacgatggatccgacaagcgggacccacctgtcagcgacagcgagggcgcgcgcgcggctgcggactgggccggctgggccgaggagagagaagagagcggttttgggccgactttcggcccaaagccaaaagagactttttaaaacctttttcaatttaaattatttcttaaatgcaattccatttattaaaaatactttcttagctcaaataaatcccagaaaaatctaggaattatagaattaagcaaagtatttaatgaaattttatctggcccaattttatattggaatttattaattaaaattagattttcttttcaagacttttaaaataaattctaaaaattccatttaaacaacaatttatatattttgaatctttagggtgtgacactgccgctcgtggagctcgtggcgggcggcgaggaggcggtcggaagggcctggagacgaggagagcagggcgagcgccgaagcgagagaggaaaggggagagagatgaagagatgggagatggggagagagaggaggaagaagaggggtgaaatgacatgtggggctcacgtgggccccgccattttttattaatttgtgtgtgaaactgacatgtgggtcccacggggtttattatttttccgaattgaattgccacgtaagcgccatgtcagtgccacgtcaaattaagaccgagtcaaattagccacgtaggcgccacgtcagccaaaactgctattgaaaccgccgagggataattcacaccggttttgatagttgagggacctgttgtatctggttttgtgattgaaggatgaaaatcggattcgttgacaagttaggaaccttagatgaacttattccgcacttttgaacggggccttattccattcatgggccgatcaggcaaggcccaggaagcggcggggaagcggcggctagcattgaagcgcgggaaatccaaaatctcatcggccgcctccttccccaatccaaaaaccctagcggagaaatctctcccctcaccgtcccgcgcgctgctcggccgccatgagcgcccccatggaggtctccttctccgcgccgcctcctccggatgcggcatctgctgccgccgcggccccatcgctggtgcccgccgtgtcggcggcggcggtggcggcgaccaccgtttcctgctcgccgcagccaccgacggggtcgccctcggccgacgacaggatcctcgtttcaggtaggttgcctcggttacctcccgttctctagctatgcacggttgttgtggctagcgaatgctgaatcatggtggctgtgtttttttaaaccctgtgattgcagttgaagtgcttctgcacgccactagcacagctcgagccgaggacgtctgcgctgcggtggagaggttggtgtttatctcattttctgttaatttttcgggttgttgatgttgtgagcaacgtcaggcgggttggtttagaaaatggtggttttctagaaatggggagcgattgagtttgagcattgatggaaaacggtgaagctgaacactgaagcaacatggatttgggatatagtatattttctgggtatctaatgcataaaaaacctgggtcttctgtatgttctgaagttacagaaacttgtggtactgtaactagtgaaccaatgcaagtattaagagtgagttgtaaaatgcatcaaccgcagctttgtggaagccttggtggtgccatggcagccttgggcagaggcatcaatggttgctgcaagggacttaacatagtttccggaagagagtttctggattttatttattcgctcacataatttgcgtgaatactagcatcttattcatgagccattagcagctgttatttctcgaacttaatatctactacttgctttatcaatcaggatgttagaagctcgaagcttaagctatgttgatggtcctgtcccgattcctaatgatgatccttttcttcttgcaaatgttaaaaggatccaaatctgcgacactggtatggatctacttagcctggcaattgtgctttctttcttgacctcattgcttatgcatctcttggtacttgccttttatgtagatgagtggactgagaatcacaaagttctgttattttggcaagtcaggcctgttgttcatgtgttccaggtatgcactataaataatgttagctgccaactgcctaaacctcttccacctctttcaagaactgtggttatgaattttgtgttgacatgttggctatcgcgctttattgataaattgcatgtggaatttcttaatactgtacttaattttctcatttgttttctctagagtagagacttccaaaggtacattctacaggtgcatttaactatttgccacccatatctcaatgacatgtgggtccacatgtgtctatgacatgtgggtccagttaattgccacatttaaaagtggcaaatagttaaatatctcacattctacatcctaatgtcttaatactgatccataggaatatgttctttccaatagatggattgctttatgttgtttattggattgaagagacattgatctaattcaaatgtatttacctcaatctggtttgcttatgctgcagttgagcgaagatggtccaggtgaggagccgggtgaggacgatacactctctagcttcaatgagtgggctctgcctgccaaagaatttgatgggttgtgggaaaggtttggtttacattcaatttaaccttaactagtacaattccttgaagaagtacactatccttttctgttgtgttggtaacatcataagtctttgcagcttactctatgaagttggtctcaagcagaggttgctgagatatgctgctagtgctttgctgtttactgaaaagggtgtagacccatgtcttgtttcctggaacaggtaagcgtcttaagaaacacctagggtggaaatgcctgagctctttacgagaaaataggtcatcttaagttacctgtagttgcatatgttaaattgtacactgatttttcattcttttggttgttttgattttctttgtcaacacattgcaggattgtacttttgcatggtccacctggaacaggaaagacttccttgtgtaaagcacttgctcaaaaactttccattcgcttcaagtcaaggtttgtgctgaatgagatacaatactgtataattttggttaatgaatgtgcgttattcatttctataattcttttaggtattccatgtgtcaattgattgaagtcaatgcccattcactgttcagcaagtggttttctgaaagcggaaaactggtatgccttttttgtgctaaccgaaagactgttatatgcatgtgatgattcatatgctgaatgctattatctaatgacacttggcttgctcatgattttgcatgtggtggcttttattcttatgattcatttcgacctttttatactggactttacctggtataattagccaatggatatgcatctttattcgcatcttaaattccgtgtactctgtgcaatccttcattttaggtggccaaacttttccagaagatccaggagatggtggaagaagaaagcaacctggtatttgtattgataggtacgtcagtacgtccttgagcagtgacaagttaacactatatattgacaactaggcaactagcccaaagtgatgaaatgactatacgagtcttcactgtatggtctgtgaagtgattagatgagtccaccaggttcattttgtatatgaatagtttaggaaggttaattttcatgtcaaattgtcaatttggctgagttcaatttaagcttccattatctaaaaatgttgaattgtcaatcacgtttctccttaaagatacacccctatactaatgattatgtatcaaccttggccacctgtttgacatatgactatatgagcgaaggatccttacaatctatattatactctttcacatggagtttgatttgctcgatgttgtatatattgaatcttaaccttatgtgtgttattattgatttttcaatttctagatgaagttgaaagcctagctgctgccagacaggctgccatatctggatctgaaccttcagattccataagggtaaagtttttatttttccatgtaccaatttatcgtgaaatgctcatacctattccttcatcgtgcaacctgcaggttgtaaatgcattacttacacaaatggacaaactcaagtcttggccaaatgttatcattttgacaacatcaaatatcaccacagctattggtattaagttctgcctttttatacctttatgaagttagtaaatcgtccatctcctgatgatctaatttatcatttttgtgagcgaaagacacttctctagtctatagtgatatttgctctacagggagtaaatcctaactcttctctagtttgcagatattgcatttgttgatagagcagacatcaaggcatacgttggacccccaacccttcaagcacgatacgaaattttgaggtcatgcttacaggaacttttgcgagttggaattcttacacatactcaggtatttgttctgtgcttgccaacttggttgatgcctatggtgcccaccttttcattattattatccaagcaccagagttgctctggattactctgtccatggggcacttgattagagcaaacaattcttttggatcttagttgatgaatcgatcaaaacttctccacaagactttcaactttcttgtaacccctgaatgctaaataaactattgtcgcaaattgtagggtggcaattctctttgccttttgagttattttagcctgatggagaaccagcactgtcctgaggtcgcagatcctcatggttcggttcatctctctggcctactccataaagctgcagaaatatgtgaggtaaataacataactgatacatgcatcatcaacagtaatcaagacattcccatcaggctgacagcagcatttcttttctgctacagggattaagcggtcgaacattgaggaaacttcctttcctggcacatgcttctgttgctaacccttcatgctgcgatgcctctgctttcctgcacgctttgatacagactgctcaaagagagctctccgagtcgcgtggttgattgattccatgccggtcacttcgaagagcaaattgctaacagtttcaattccagagatagtttttaagggacctcaaagatagctggaagctaattcagagcctggtgctaaataccggcagacccctgcaatctttaggtttagaacagcagaagtccagaatagatctgattgttgctttgatacttttgtgttttgtagattattatatatatagtatattgtgcctcgaaggatgtcactgagttaaaccagaaacaagacttgattcgagttgctgaatgtttaaaagcatatgttatcacatcttgcgctctatgcttgtggaggtagtgtagtaaccaggacctgcttcacgtgctgcatatacaggaagcacactcaagtgactcaacatggtcatgtctcaagagcactggagctaaagcattcagaaaattgccgggtgtcgttcttaaccgggaattacagagattcaagttgaccgtgatctattcggtatacaactaattaaattcaagtatcgaaccaagagcagcaattcgatatacaactaattttcattgaccgctaaaatgtatagggaaggaatctacaagaaaaacgaactagagccatgctgttgttggcctctccaaggatcttactacagctacaccacaaaatgggtttagcaaatagtgatttgggtctgagactgaaactacgatttcacctctggcctgctctggttgggtcgtatgcgacaggataagtagctggtgcttgtcctgcattggcagctccactgcttgactgaacaactccagcaggatatccagcactactgatcgcgccatacatgcttgcaacatctgtagctacaccactgcttattggttgctgcggtgcagcatacgcactaggataaccgggcaaagcggcctgtgtgtaccctgcaactggataaccaggatagcccgcgtatgcatttgcttgcgcagcatgcatctggtaagcagtagcggcatcataagttgggtaagcatatgccccagcttgggtagatccttgctgatatgccccagcttgggtggtcccttgctgataaaccccagcttgggtggctccttggtgatatgcagagggatgaccggtaaatgcacttgaatatgggtttgaggcagctggcactgccacagcttgtgctgcccctggttgtgaagcagtcacatgtgccacccccgcctgtgctgctactgcttgagccgctgccactgattgttgcaagaatcagatggaattgaaacattagagtgctttacaaagcacaaaaggcataaaatatgtacacattgatagatagattatgtgtatgcatggaaataagccaatcataagcaataaataagcagacactacagcgagtacaaaatgggacatacataagctatatatatgttgagtggcatgaatatggacatgacaaaaccggagtaccagactaacgcgtgtgttgcatattacaaaagcaccgacatatatctatcacaattcaaaatgcatatgcaaatcacatataaaacaaaatgcatatgtaattaaatacatcagaggttcgcaagggaacataactgccgatctatgagtacaggacagtccggttcttaccatgaaccaaacactgagaagttatggtcaaacaataagggaatgaggataccttgagctcgtttttcagcatttgccacatcagcacgcaacttgtcagcctctttggtcatagtcattaaattcatctccatcgtccgcatctgctcaacttgcttgatgtttgtgtttttctcatattcaaaagcagatctatgcatggttacgggaaaacatcatattatcagaggcctgttcgccaccaaagctcaggagtgtatggaaaatgtaaaaaaggaataatatcacaaaccttagactctgatgctcttttcggagcccatctagctcagtcagtaattcaggaagtttcttactgtcaccagagaacttatgtagctctttagttactttatccatctcaacagtgagcatctgcctctcagcaataagtctctttgcctccatatgcacttgatgaagttccttcttcactgcatcaccagcttgtatatctgcttccatcaatctcattctctccatcaaatctctcatatgcatatcagtctctgtctgaacatcacctaggtgagcacggatcatttgcatttctttctcagtatcaacaatatcctgcctcaagacgacatggctagatgccaatcgctgattctctctgataagcttttctgcctcggcggtctgctcagcaagtttcttttccaagatctccagagcggtggcagcgcgatccaaaggttggcggccagaaaggctggctgcagggaaggcgccatcacgcatcaaacctgaagcttggcgtccatccagctgtccatggtatgccattatactgaaatagcaagtaacaccaaaaggagtttaaatcgggaaatcgggagcttcaaccaaaagtgaaaaatgttattaagtagtcatgctaagccatgcatgcataacgacaattaacatggcactcaacattaaataccaggcacgttgcggtctcatcataggtgatggtaatttgaaatattgtactagatactatagttacatccatgaagttgttcaaaaaacatgtggtgccaagaggttaacttacaataaaagatacaaagactccctattaatcaacaaaacaaatagaggagattacattggagttaaaatacagaaacgcaaacggctcacacgtaatgcaggttcgaaatgcaagcacaaaaataatccccaaatccacacaaggctgaactcccgcgaagctgacatcaaatctctaagctaaaacctacatcaacaatccatggccctacactgacagattaacagaggcaaacctaaggccacctccaatgcaaaatacttcaatgggtgcttaggaaaatagaaaaagctaccacaccactaagctgagaacgtcctaacttagggcatggggtgaattcagctcaaccccaattttttttccttaaacaatactgcaccacgcacgtatcaatggacagattaatcgcgaagaaactagatggcttaatcgtagtgaaaagaaaaaaaaacaatccaggtccggatagatttccccaggtcacggagtgacgcggaagaggaggggagactgggagagggggctacgagaggagaggtgatggataccttcaattcgactcaaccgagacagaggccgatggaacgagggctcgtcgcgtcgagtcccccaccccccctggttccgagcctgctcgccggcggcgggggccgtgcgcgccgaggagggctcacaagggagagagagggggtaggatgcggtcgggggaggagataagaggagcccgtccgcaccgcgggtaagtatacggcggccgttcgccggcggcgcgcgcgcgaggaggaggaggaggagaggcggcgggggagcaggtcggccttgccgccgccggaacacagaagagagagagaagggtagcggcggcgacggaggaagggaaagagatggagggagggcagagggaggaagaatgtgggacccggtaaaggcagaggaggccagatgtctcacccctcgcccctcggagtcacgactcgagtcacgaccttgctgcgttggcctactagaccatggccctagccctagggcgaaggccggaattttgacgcgaatattaaggaataaccacgattttgaatccatatcgtctaagtctaaccaccgttttatagagctagccggaatacctgagcgtttctttagtaggctggaattttggctatttatttttagtcttttatttattttaaataactatactaaatgttaggggtatacaattgtatttattttataataaaaatattagtttgaggtagtttaattattcttttgtattgaatattaaaatatgttacgtctcattaagttatcttattttggaacgagtgagtacttatttgctggagggttggctagcgtaacagagttacttcttgatccgatgaccctatttgtgttcataaaagatcagccgagagccacaacccaaccaggaaaggccatctaagtttttcataatcataccgtgtgttagtccgatcgctcagagcgtgcccagtacaagccaggacttgctcaaagactaaatgtaaagatgcaaactaaatgtacgactgcagatagcattgcaaagaatcagatgataattggaaacaacggtcttgaggtccatggagacacagccgcggctgaggaccgataatcaactctcataatcatttcagttaaaggaattaaggctgccagcatttccctttgcaacaaaaggtgttctctttaccttgttacacagcatcgtgtgaagaatactcctcgtgggttcctgaattatttgtggaacagaactaagaaacagatattgcctcacgattccttcctgggaagcgtcgtacaaattgacgatctaaactctatacgaaacaaaaataatcgggagtcgggacaaatgagctagtcccccaaaagaattaatctctcaggcgtgcaccggctggtatctaatccagattggcgattactgcatcagtgacttcctgggtggtgctggtgccgcctagatcctttgttctgtacttgccttccgcaatgacacgcttcaccgccgtctccagccggtcggcgaatgacgggaactgcaaatgcctcaacatcatggcggatgatagaagcagcgcaatagggtttgctttcttctgctctaagatgttctcgtttccgacgtttcctgcagaagcaccttgctcaaagacagcatggtcctgacccacattacctgcaacaggatggcgaatataaggattagtaaaccacgttgaattaattatggtatacaaaaatgaaccaactgggtggtccaaacatataaaatgggtggcaagtgatgactgatgacaagaagtaataacgtaattgttccaaaagaactgatgaaaggtacaaccatgcgtgatgcacagacaacaaactgtctcccagtaagaaaaatattgtcggtgacagaaaaatattgtctcccagccgattgtttagtgtgctgttgcttatacgaattaaaggaacaaggtaaaagttaagatcctacctccaggcataacacctgtccctccagcaatacctgcagccgtgttagcaaccaaattgccataaaggtttggtgtaacctacaaaacgtaccaaagagtagaaagttagaaattctgcaggaattacacggggatacttaacaggaatcatttgggaaaaccagtattcaggaaagtgtcctgcggaacagaaagaaaaagtaaacaaaaaaagggggaattcgacagttgtcgttagctaacatactttatagtacatcatatcaagctaactaaaactgcctgtagctgcatgattgcaacgcttacatactgtcagctggttagaagtgctatagattgtcaaaagattgttttctcaatccttataacaacaaaatttcatttggtttctcttcattttcacattattgagtgtttgcacttttctctcctcccataaagatgatgcaaatctaagcattcccaatttctctgatgttgttcaggacattaaatttctcataatgcttttgaaattctacatgataaataggtcaaatttatagataaggaagcggagcaaaataaatcgtacgatgacactacttttatttcctaatgcaaatgacagaaggaattttaacctggagactatatatagcaaatgtgtatcattagattcattatttatcttgcatcacaagcaaaatttcaatatcctagttgctaaagcatttacaggaatgtatgcttcccaagtacaacaaaatatgttctacaatgctaaaaccacagcatctacaataacttctgataagcttcctcattcagaactgtactttctgagaaagtattacattcattcttcggacataaaacaaacagattaataaaaacagatgtttgaattgcatcataaaatgcaaagcacacgcaaagaaactcagtgcagttcaaacaaggcagctccaaagtactgaacagacagtgatgctccagatagaatgtatgaagtaaagagcataccatgacatcaaattgctcaggctttgcaacaagttgcatacagcagttgtcgacaatgatctcattatactgaataccaggatactttgaggcaacctcacggcaagattccaagaacaaaccatcagcaagcttcatgatgtttgctttatgcactgctgtgactttctttcggttgttaaggtaagcatactcaaaagcatatttggcaatcctctcagagcaaaactttgttatcacctgacaaaagttagtcagtgagactaagatggaaaagaagctcagagaactggaaaaaaaaaagggtgcatttcattccattggcaatcatgtaacacaaaactaatcaatggttcaattgaaagaaaagaaataagcacatatctgatgagtccatgtgccccaaatcaataaatttaaccatcagtctacctattccctctattccattccctacatcccaaatccatgaagctgacctgattacacgtcatataacagtctggccaaataatcacgtcattaaattcttaaagaggccagtgtttgatgcagaataaacaaatcaggaactaaactagcacgttttacaatttaatcaacacgcaaataatgtaaattcatagattgtaccaaacgctttaccaggcaaacagcaaacaacaaaccgtgagttcgattaagctggtctgtactgataaaacgcctgctaatccacatctcaagattggacaaccaaagcagatgccaaacatcaggtcaacaagacaacaatatatattaaaacattcacaccatcccatccttaataagacaacaattctgcagattagatatatgcaacttcactagaaattgcatatataactctaaccgtggacttatcttgtattcagtataccacatattgaga

SEQ ID NO: 79274 - DNA, 25831 bp, Oryza sativa
cgccccaccagagggcgacaagggttttcctgcaaaaaaccctccctccgtcaccgcccgttcctcccccgtttgccacgtcagcttgccgccccagaggtgggcagcagggtctatttttgtaatttttttggccgatagattatttctgtaaatattaaaaaaaaatctaaaaccgaaaaaaattcttcggaccgatacggcacgacccgactgctggtgggccatgcctggacagaagtgcagcccatgggctggcacggcccatgcagagcgagccttatggccatctatactccctagtccctactcccctcttcccaattttccatacctaatacgtagcgtttggttatagctttagctccgcccgccgccgccgccgcctgcgcgaagttgagttcaaaaccgaaccacaaacagactgggattgcatttgcaataggcaggagaggagaggagtagagatctgaaggggggggggaaacggaagtgattttctcggccagatccgtgggaggaagggtatcttcgtgtactcgtctatggggatgttggcgctgaacgggctcatgtccctgcggcgcgaccgccggcggcggcggcggcatcaccggccgcaaatccgagcgcgctgtaagcctctttcctcgctgaacagctcacccgcccatctttatgttaagtttggctcggtggatgtgttcgttattgtcagctcataaaaagatagtatttctttttaatacctatctaactcgtctggattgatgtgggcctgttaccgatttttcacttgtttgacttcaaatttttcactttggtgaatacggaatagcaaagattattgattctccaccactttctccgtttgagctccttttaagttttaatttatttttttttcgcacaactaagcaacggggtatttcagatgggtgataccctgcataggttcctcaggaaaaaaaagatcaaattaattttgggagatatcaagggattgagtgcctttttctgcttttcttccgttcatgtctctgcaaccataacaatcctttttgtgtcgcagcaggtgggcttattgcctcaacgggtaaaagaaagacatcaccctgtcaacaagatgactatgatggtgattctcaagctggcaaaataatgagaaattcaatcccagaccttcctgaggtacgaggcattgaattccgatgatccagaaattttctttagcctgggcatgcttaggctgcgtttgagatgacatctatgatgagattatggtccacatgcaaaacgagacaagtgattagggtatggttaattaggtattaattatccatagattaaaaaaaaggatataacaaaacagaagagagagatagtgacctctgacaataatctatcagcatcaagagtccaataacatgttctgcttgtttgccattttttgctacctgtcttaaactagtgcacaattaaaaggctgctttggtgctcaaatagtcgtgcaggacaccatactaaactacagactgcaccatatagaagcatgacgcctggcgccgcttgttgcccaggagcgaatgccattggctagcagaggaacagcatcagagtccacagcggcaaaagactgggagcccgggcagctgcccatgctggccgggccctgaatccgccgctgcttagatttcaagcataatatcaccacgactcacccatcggactgattatcttgctgactgtgctaggctggctgtatattactccattttttttatatgaccatatggatttgcaatataaatgttgatctttacgtcctccattttttcttcacgcattctgatgtttgtgtatgcaggacatattgtttcgtatacagtcctttatgtcaatgcgtgaagctgctcgtgctgcttgcgtatctcgtgcttttctacattcctggaggtgtcatcccaatcttatctttaataaagatacgattgtcttgaagagaaatgcgtttggagagaatttccacggaaaaattgggcgcattctcaggaaccactcaggcattagcttgaaaacgttccagcttgactacagtggtatgtgtgggttcgatggcactagttatcttgacagttggcttcagattgctcttaaaccagagattgaagaactcaccctttttttgcctgaaacaaacaaacaatacagcttcccatgctcacttttatctgatggggtccgagactcacttcggtacattaaacttcgatgttgtgccctccatcccacacctgaacttggccccttgagaaacctatcaaatctgcatctgttgtatgtgagcattacatgggctgagttagagtgccttctttccaactctcttgctctggagcatttagagctcaatcattgcaaggggataatttgcctgaagataccttgcaccctgcagcagctcagcagccttaatgtcgttgaatgctcaggcttgaaagtgatagagagcaaagctccaaatctctctagtctatttgttagaggatccagggtaaacttctcccttgtagaaacattgcaaataaataagctagacatgggacatgcaatctgtgatgctcgggccaagctgccatccattatgccaaatcttgaaactcttgtcattgaatcggggcatgaggtatgtattctctaaaagatgaggtgctgtagtatggcgatatatacggattactttagtacaatgatatatacggattacattagtataatgatatatatggattacgttagtgagtgttatatatcgattacattagtgatacctgttgtgtaataaatctgatgcatgccatatttgttgtgcaggtggttgatgcaccaatgctgcctaccaaattcctctaccttaagcacctgaccattcatgtgataacaggatcgaccatttcccagccatatgactatttctctctggtttcttttattgatgcgtctccgtccttggagactttgatattaaatgtatgacattggcactgttcattcattcatttcatcctccaaagctttttgatcactctgggtctaattcaagcatatcatccttttcatggtcaggtgactcaggtacgtatggtgcatgaatcgattttcacggattcacaactgagacacatccctggacaccgccatggccacctcaagagtgtgaagatcactggtttcagctctgcgaagagcttggtggaactgacatgttatatcctcaataatgcggtgtcacttgagtgtcttacattggataccatttatggtcctaggtgtgatcaagataagtataggcggtgttttcccatgatagatggtgttctcacggatgctccaagagggcttgcagctatcagaacatacattgaggataaagttccatctacagttaatttgactgttctggaaccttgcagccggtgccatgttagaagaagagggtgaacatcatctcaatcgtgcaatgccgattccattcaattttagatgaaccaatatttgtttcctgaactatttatggctgtggcccaatgtgcaatagtttaattatcttagatggacaatggaccaagctttatctctgtattatcagacctgtttaatgtttattttttgctgtacatgtataagctgaagatttatatgtttttgtccaaaggttgaaattttcaggtgcaggatgtgttgtgatttgtttgttactagcagttacaaagttagtgttcaatctgctgtaaccagggtttgcacttttaatttcagcgaaaatttcggtagcatcggtatttacaaattttttgcactttttgaccgaaattatttgaaattttaaccatacttgaataaactttaaccaaaatcaacaaaaaaattgaggaaatccaaaattttcggttgatataagacttgctggagatgtccaaaaatttcggttgatataatgacttgctgcagacaggaatctcttctcctgggccgaaagcccgaaaccgattgcaagcaaacttgcattccacacgctcattcatttttctatcattgtatccaacacttgatagagtacataagaatgaacatgcaaaacagagaaaaggaaactttgcattccacacgctcattcatttttctatcattgtatcgaacacctagtagagtacataagaatcaacaagcaaaagagtcatcagattcaacatgcaaatgagaaacgaaaggggagtgtaacagacaacattcgcactcttaaagttttctcattagatcgcagtcttaggtactctaaagttttctcattagatcgcagtcttaggtggagtgctttgtattatgtttggtgtacatgaaacaatgaaacaactaagtggcaatgagaaactattattgcaaaatactctatcgaagatgaatggctacagaaggtcttgttatgagtgtgtgtactgaattcttggccaggattaaccaagagattttgtaatcccctataactcttggttttggtttctggtaaggctgcagcctgatcctctttgaagcaaacaggtctgccagaattaaaacatgcactgagagtcctagagacactaaaatagtcatcagatcacaattcacaaacttcaagttggcatagcaaacctgttggtatgatataccaaagggcatttggagttggagacacttttccttgatggatggcactagaaaactcagtttccatcaggggcttacaaacctaactcttgaaagggaacctgaatttcagccattaaaaataaaataaccagcatttctctgcattttaaactgtagaagaaacccatagaaatatttgccaagactaaatcatgaatcaataacaaaccattagagacaacacgacccaaacaatgacatcaaactaggagaacgaacccaataagaaaagcaaaacttaactgggctggctggggcttcctcaaagaagaaaatgcatttggaaaaatatgttcagtcctccatctgaagtagcctcaaatacacccccccccccccccctaatgtctctttcctgacactgaaacacaaagagaagcataccaactttgatcttctttatggaagctacagcgtggccaggaagcccaaaatgtttttttcactaccatacggcatacactccaggttttgattaaatctattcagcaggtactgttgcagattcctttaaaatgaaagaggagataatgggacaatgcaaagtataaccaatgcaggttttgttcatcgaacacttgcggttgctattctccagaagattaggcactagtaacaacaagcaagtcactcacatttagccttcgcatttcaaaacaaatcaaatcaacaacgatcatgaccagtatacctgaagaacaatgtcaggaccccaacacaacagtagccaaaataacaaaacaaaagcttctatggtttcaataaatacctcaaatcatacaagatcaaatatcaatcaggtacaggtactactgtactagtgcttcagtctccaaaattagatgatgcaagaacggtaaaaaaaaaaggcatacaaactgaaaagagaactacgaaaatgaaggtcaaatgtattttccattgcaaatggagaggaagaacaaagagttatcccacagtttatcagctcaaatgcagatggtttgttttggaccatatggtgaaacttgatgccccgatccgccggtagtcagaagaccaacgcagtcggtgcagaatgaaatagcccgtacgccatgagagaaatactagcacgggaggaaatccagccgacgggggaagctcgctgcagcaggatctacaggcgttggtgtcgtcgaaattcatcacataaatcggctaagctcattgccttccctttcaggtgaatttgggaaaaataaatggcacggtaaccaaggaattcgagagaaaaaaaatctgaaccctgtggatccacagtttccgctgcaagaatttccacgaacgatctgatggcaacaaaaaacgaacgacaattgaagaacacgcaacagaaatgcagcaaaattcagaaaggggatttcacgacagatggaagaaatcattcaacgacgtcacaagcaaagtaaaattctgatggacaacacttagatcgggtggacatttccatttcatggtataattgcttggattcaatttacagtgctcgaagcgatctgcatctgctactagaataagcacatggattcatgtactactgttgacgagattctaagaatgttactcatatactactaaggtttcaggatcgacagtcgcaaaagcaagagaaaacgagagtagtctactggaagaaaatgtagcaaacaaccctcaccacacgctcggcgctcgtactcttcacaaacacgccccatggtcatgcatcgtcagcttcctcgttgtcaccttgcgggctgccgaactccgggccgtcctcgccgtcgtcggatccatcatcgccaccgaactccgggtcgtcctcgccgccgtccggtccatcgtcgaggccgagctcggggatgaagaccaccatggtgttgaggtcggcgaccttgtcgcgaactctctcgacattcgcgacaagctagtcccgatcgcgcgtaccattgatcatgtggtcgacgtggtggcggaggaaattgcctgccgtgaccgcgaccgcgtggaacggcccctccggcccatcgacatggcgagcgatgtgggggagtgaccagccttactgaaggaggaggcggccggcgtcgtggtggagggcgttctcccggagcatcggcaccagaacgtcgacgatgacgacgatctcgttcgccaggcgcgcgagctgacgaagcttgtggtcacggaccagatcccacccgcgcgggagccgactggccttcgtcagcaactccagcaaggcgggcgcctggcggagctctacgtccgtgacgatgaccttgatggggtcgtcgcggctggcgtacagcatcgccgcctcgcgaagccccgagattgtgaagagaggcgccgccatgctctcctcctcctcctcttcctcttccgccgcctctctctcctccggacggataatgatttgtggcggtcacggcgacccatctcgtgtggactttatacagacgaggtgagggaggggatttcttccggaagtttcgatctgacaaagcggagatggcgcgggaatatttggccgaaaatttgaaggcgggcgcgcttgcgaaaaaacgaaaaaggaaaagggaaatgagcgcgctcgagcaacgaaaatcgaaaaatgaaaggaataagtccactctgagtcatttaaaaataggtcgaatctaatccatgacaaaaactataaaaccggatatctcgaccctcgaactatttaaactggtgtaatttaactgtcttgtggttttggaagacagttttgttgatttggcactgacgtggcaaggttgaggggttgatgtggcgcttagttggtatttgaattaaaaacgtatacgtggaacccgtttgtcattcacacataaaaaattcagtaccactgagttcgacacacttcaacaatatgccactgactttgtcgatatccataatatactatcgccttttacttaacctctacgatttaccatcaccgtctatagcctgttagtttgcattggagaaaagacaagtgtgcccttactgaagattggcagcactgagaccatgtcgtgcaaggtaccgagagttataataactgtttatttatgcaatatgattataaataattacgagcacatattttaagtattttaattatgagcaaatatctccaaggctacaggagggggcggagttttgttttgccgaggactgttgaggagcggttgaggattgcactaatcacagatgcagctctccagcagggccagggccaccgtgtccccttgcatgcgatggcagcgctgacgacggcggtggcacccgccaccagcaacagctctccaacaggggcgtcgtgtccctttgtttgcaacggcagcaccagcagcagccctccaataggggcgccgtctcccatcagatgtgaccacggcgttgacgacagtggtcggaccgccgctgtggatggcacgcggttgggccagcgctacggatggtgatgctggtgacgaaggtcgtgccggcgctggggacgaaggtcgtacgtgctggcgctagggatggcggtgctggggacagcgagcgggccgacgctagagatggcaacgctggcgaggacatgtgagcggcggtgggcagagatgcggcgtggcgccatgacggcactgggaagggtggcaatccggcgttgggagatgcgatgctaggaagaaaggggccctgggccatgcgaattagatgattcaaagggtatttcggtcattactaaaaaaattaacagtgcaaacagcatgtagcttgacggcgatggtaaatcgtaaaggttaaggaaaaggcgatggcatattatggatatcgacaaagtcagtggcatattgttgaagtgtgtcgaactcagtggtactgagcagattctctcaaaaaattatggggcttactaacatgtggcaccacatgtcattctctctctttcttcttcctcccctcttcctcccttccctctttctctccccttttctccctttcgaccggtcgccgccgcacgggctggagcgatgacgggcgggggccagagcggcggcggccggcgggagctgagatcagcaatggaaacgatggcgtgggcggcaccggggagcatggggaaggtgaggacgctgaggaggaaccagttgaggctgagcggcgcgacggcgtcggaggaggaggaggaggccggcctaccgccctggagcgcggcggcggactcgcggaggaagaagcgcgcgacgctacacatggacatatccactgtggcgaacatctccgccagcaacggcaagcacaacgcgtccgccgcccacaccaccgcccccactgccgtcgccatgcccaggctgaccatgctccaccgccttgccccgacgcatatgcacggacgtctcgaaatcctcctccttcgtggtcacctccgtcgtgccgccgccaccgccctcctcctcctgagcggcggcagcttcgtctgcttcgtctctcagtccttcctcttcctcatgttcgatgggcgcgtggacgccgccgagcgccgtcgccggcggcttcttgtcccacatggacttgcccctgtgctccagcccgtgcggcggtggctggtcgaaggggagagaatgggtgagaaagataggagggtggaagaggggaggaagaagaagagaaagaggatgatatgtggggcacatatgtcagtgggccctataattttttatgtgtgtgaatgacaaacgggtcccacatatacgtttttaatttaaataccaactaaacaccacgtcaatcccacaaagtaggtcaaccctgccacatcagcaaaattgccatctaaaaccatcaagggagtcaaattgcaccgatttcaatagttcgggagtcgagatatccggttttgcggtttaaggtcatggattagattcgggttagtaagtcaaagtggacttattccaaaaaaaaaaaaagaaagaaagaaggtaaagggcgtgctcgagcagaccatgccgggctggccagcccgttgctggtgcggcccaaaaacagcacggcctactgcagtactgctaaccggattgtgtcttgtctcggtcgtctacaaagtgaataagtctacttcacattcttcatctcgtacctgatcgaatcgactggcttaccacaaaaccgtataacacatccttctctttccccgcccattcattctctcaccatctctctcatccggatgggtaatgatcttgagagtgacatgctaaagaagattaattaagaagataccattgaagattttatttcgaaatacactataataatgttttagtgcgatgctttccaggtgaagattagaaaaatattcttcttccgttctattttatgttgctatgagtataaaaatataccatgagtaaaaaatacaattgttttattttatgatttactttctccatccatcctaaaataagttcacctaatatatgatgtgacattccctaaatctacaagtttaaacagataaatttttcagattcataatactataatatgttacattctatactagatacatttatatattaggacgaatggagtaagtttcatacttgtttttttcatatgacctccaaaattcacgggatgtcgcttctcctatctaccactccctccatcctaaaatactctctctgtcccagaatataagaacctagaatcgaatgagacatttcctatactataaacctaagatcggatgtgtatatgtcactttaaaatcttatatattataggacggatggagtaggaactatagcctttttcgtgtgtgcggtactcgtggtttagaaaaccatacggttaccatggttatcacgtgcggtacccttctcatttttaaaactatagtatatctcgtgataatcacacggtttttataataaccaggtaaccttttgggttttggggaaccctggcggtagtgcgtgtgcctcgcacgatggaaatgaaagaaagggagagagatggaaaactacgcatttcatggcttcattagaattacacactcacacaggctttgcaagtcaagtttaactgcaacgtcaacttccgagacccatcggccatcgctcggtagaagcctaatcatttcttcatctctcattttctcacatcagctactcaaagcataaaacagcgtgcgagacccaagcactatccgggtgatatcagtagctggctactactagctgctgtatgcatatgccaccgtcgctgtcagctggttcaattctgaacacatttgttgccgcttttctgcttgactttcaggacttcgattggtgcagaactaaagaagaatctgacttgcatcgcaatatcgcacggtatgacgctacttctgatctctgaaaaagaaaaggaagaggagttcgttttgccaatgtcaaatactccctccatcctataatataagagattttgattttttttttcaacgcttgattactcgtcttattcaaattttttgaaattattatttattttatttgtgacttactttattatacacagtactttaagcacaactttttgtttttatatttgaaagaaaaattaaataagacgagtggtcacatatttaagataaaaactcaaaatcctttgtattatgggactgaggtagtaaaagatatattaagctagtattaacccctttacggctttgctttacctaccggtaaccgactacgtcctggtaggcttcacatccttgtcaccgtctttttgtcctgattagtcccacgcattttgtggaaaaagctggtggtacgatcgactcagatatcagaatgctcatgagaggcttcaacgacgtagtattaaaatcagtgataagctatgtgataaactgataatgtgattaactgcacggactgtgtagcaaatttaacgcagctttttataagatctgacaaattaagagtcattttacggtacctcccacttaaggtggtagtagtgtagtaggaataaatctcaccgttgattttgttggtcattctaataatttgtttaagtgaggtggaagggtaatcttgtaattgtgctcccgtgatagatcaaacgggccaggtttgcagacccaattttatttcatcgtgagttgacgaagcagaagagaacaggagggacagccgccgccaaaatcttgcgctcctagccgccgtccgccttcaatctctcctcgtcgcgcaagcatggtcaccgcggaaccatgcataactgtaatcaatcccaaattcatgctttactgtaattaaacccacaacatgcatgcgtgaatgtttagttgtttttaatcaatttagttatcccgattggcaattgcatgtatcaatgtaattaatccagatgcatgtgatctgttgtacgctagtttttcgtttatttgatcacgtcggtcatgccggttaccgagcagattcccctcccgtcagtggccggccgtcacgatctcgcggacgccgtgtccatgaggaggaggtggcccttcagggagaagcgaacgcggccggaggaagacggccgcagcggcgaagccgccctgctgaaaagcttttatccctttattactctgttcgtcggacggatctacggaatagcgatgaactacgaaacccttcaacaactacgtatttacatcagtgccatgttttttttttctaaaatacccttctactacactactactcaatctaataggtgcaatctaataggtgcagtagaaacaaatatgatctgttggatcttatacaataaacggctcgcattcactcagaggtactctaaaaaaatccattaagatgccctggatgcaggaacctctctgcaaattgctggtggagcagacaaatgaattggacgggaaagggaacaggtgagaggatgaaaatgaaagatagagagagagaaggaaaaccacgggattattctggtggtatttcacccggattttttttagatgatggtatttcacccggatagaaagaagatattctcctggtagtggattcgtgcccctcttttctaaatctgctgcaagacagagttcttagtttggcgagcacggttgacaaagttattcagaaattatactattctgcttgtgattcgccaactgggcattcatctatgcagatattgaactgataatctatactatgcacagagataacgtcaaaattatgaaacccaaacgagcattttttccatcccaagctgcaagttcctccatccatcttatattataatacactttattttttcaaacttttaagtttaatcaaatttatagaaaaatttagcaacatccacaataccaaattagtttatattgaacatatttcaatgatatatgcttattttgtgttaaaaactttactacatgtttttataaatttgattaaacctaaaattatttaactagaaaaaaatcaaagcaacttatagtatagtaaaatggagggagtagtataatatggtttaaatcttagtgctcatgcgtagatagacttttaatatgatcttagtgagaatggggatgggccattggtttccatttgttagggtcttagcttagggaacatattaatgggatgtgagtgtgttgctgcagctaatgaatggtaatgcacaagaacatattccgtgtaataaaaaaactaaaagcgaagtgagcgtagtttaatttgttaggtcagctcgcttggtttaaattctgaattagatacacgtgctcgcatttacgactaattcagctcaatggcggagccaagaatttttttaagcccggacaagtctaatgaatggtaatgcacaagaatctttcacatatgtaagattgtgcaaataatatttttcactaaagtatcatcatggttccttgtatcaactaaacgccgtgacattaagtttgagctagagctagatatagataaacacagaggatcctaatccagtacaaatctgattgattaatcaaatatagatcacaataaagtaatgactaatagaaaaacaattcttattagcacttcagtgctcctgctgatcggccaaacgctgtgcttgctactgctcttgctgccaaaaaaaagtgcagattttcatgcagcttcgccagcaaaacagagcaaccgatgtactgatgcagaccgaggagcccgagcagctgcccagcctggccgggccctaaatccgcccctgattcagctgatgtccgtgctgaattcgtaaattttaagatgtaccgaacccgtaattttagatgagctcatagaaataagatatgtgtatgtttttaccggggttagtgcgtgcattgtgagcgccacatttgtcccgtgtttttataaaaaaaaaatacgcaatagcttcacgccaaggttctctggttgtgatcgatcggagcatcagacagccaggtcggcgcgccagctgccgccgcgagagcagcccgcgcgcgacacgagaggccgcgcgcgccgccacaagtcgctcgccaaagctgcgcgtgcagcacagcagccagccaagccaagccagccagcacgcaacgcaacgcaacggcgcgcgcgcgggcgcgcggcgatcccacccagtcacccacagctcacgccgccgcgggcccaccccccggcccgcacaccattttgccgttccgcccctggaacccgcgcgatttagcgcgcgcccctcgcatttcttttcccacccaacccacccacacggccacaccactccaccaccagaagcgcaagcgactcctctctctctcacctccgctcgcctccgcgcctccgagcaccaaaccctagatctcgcggcggcggcggcgaccggggatggcgaagccctggggaggcgtcggcgcgtgggcgctggacgcggagcgcgccgaggaggaggagcgggagcaggcggcggcgttcccggcgcccgagccgcccgcggccgccggtggcgccgccagcttcccgagcctccgcgaggccgccgcggcggcgggcgggggcaagcagaagaagaagaacaagggcaccaccctgtcgctgtccgagttcagcgggtacggcgcgcaggggcagcgtcggggcggcggtggcgccgcccccgtggatccgagggggctcacccccgaggagatgatgatgctgcccaccggccccagggagcgctccgccgaggagctcgaccgctcccgagggttccgctcctacggcggagggtttggcgccggcggcggggaccgccgcggcgggttcgacgacgaccgccgcgggcccggtaggtcctcggatctcgacatgccctcccgcgccgacgaggcggacaactgggggacgaataagaggttcacgccggctctcggcgactctggccgccgtgataggttcggcggcccctccccagccggccgctccgatgacatcgatgactggtcgcgcgacaagaagccgatgccatcgcgctacccaagcctcggttctggtggtggtggtggtggcggcttccgtgaatcacctggtttccgcgactcaccaggcccctccgactctgaccgttggtctcgtggtggtagctttgcgccgatgccgcacaacggcgagcgtgagaggccgcggctcaaccttgatccaccgaagcgggatcccttggctactgctacgccaccagctgaggtggcacgcaaccggccaagcccatttggggctgcaaggccccgggaggaggtgctggctgagaaagggttggattggaggaagatggagaccgagattgaacagaaaactagccgccctaccagctcacagtccagccggccgaatagcgcacattcctcccgccctgggagccctggatcacaggtctcagcagttgggagtgaaggggcaccgaggtcacggccaaaggtaaatccgtttggtaatgccaagccacgggaagtggtgctgcaagagaaagggaaagactggaggaagatagaccttgagctggaacatcgtgccgttaataggtatgtatatgaagtcacctcttgattgcacttggcatttctcatgaatctcatgatactgcaaacatgcaatgcaagtgtactgatatagcttagcgaaggtgtatttcttgtggtaatggaaacatgcaatactggaggactgatataggttagtaaaaggagtgcttcttgtgataatgtaaaacatgcgtattgcaatactggagtattggtataggttagtaaaggtgcaggcgtgcagccttgcataaagaattgtgcaagttctgcttagttcttttctaatatataaaaaacctagcaatttacgtagcatgtcctaacaataattgccctgctgtttttgttatgtaatattttggaagaattgcttttgtgataacttcataattgaaatccaaaaaatgagcaactagaagtgaaggtttacctttatagtatacttcagtgaattaagcatttaatgttaatgtcgaaccatttattgttatgaagttatctgcattaatcctttgaacggtgcagtggagtcaacaatcaacatttacagcaattgttcagttaaattcaatcttctcttgtgggtgctgaatgtagtgatgcatatgcagttatatgttgtcacttccattcaaacttgattgttcaccgttacgcttagttttgtgggaagtgaaattaactggggtcgctagcaaaatgtagcatgctattgtgttgataaagacataatttgcttttataagtcatcactcatggatggcaaggacatggatacttggattggttccttctgaaattctgttcttttagccagtgcaggtttgttttctattaattcaatatatctgtacctcatttttcaggccagagacgaatgaagaaaggatcttgaaagaagaaataaacctcctcaaggagaaactgaaagaaagtgaggccaataaaactgatggtccggaccaagcttcccctgaggatccagaggatttgtcggagaagataactcagatggaaaagcagcttgagttgcttactattgagttggatgacaaggttcgatttgggcaaagacctggttctggagctggcagggtttcagcagttccaccagctattgcagaggaaccacagattgtggtatccatcgtggataggccacgctctcgtggtggtatggagccatttccgaaaccagctgaggaaagatggggattccaaggtagcagagagaggggctcttttggtggaagcagaagttcagacaggttcgtgcaattcttgctcaatttctttccaggttaatgtttcctattgacagttgcatgtaatttgctggttagctgaaatgcctccttaatccttctatatagtttaattctttttgtaaatgtatgatgcatcacactttcatattgacgttaatttttcatgcctgccttgttgtgtttgtcatgtttagttgaatacggaaccttttatatagttattcttcttgtatggtgatataccatgttttgattataagccaagtagcacttcaactttggacaggtttgagattgaacgtatagtatactgttcgattgaagatgagagttggaatgggatatttgtctaggtaggacactagagattcatagagaggatacaaagctcagaattggggtttcttttttatttgaagataattgtctgcaactttgtataaccttttctttgtattttttttcctctgctttgtatttatctgtaattattctctatttatattatttaataaagtacatgaggagcctctcctgctgtttcttgtaaaaaaaaaaagaaaaggaaccatgatcaccaacagcttaaactttgtgaaccagtggtgaagtgttcttgtatgatggttgcttttttaatgggtagaaataggagcgtagaacctttatatctatcttgttcatcttatttgctttagttcttgatgtgatacaatctggtctatttaaaaatatgatggaagtcaaatcagtttctaaccaattgatgttgatattatcggttcatgtgcagctcttaatcggttttgttttgtttctgttcaggccaatgacaaggcagaggtggtgagatacggcgtttgagcatttgttaaggaaactctgggtcctcgttttttgtttcgaaagaatggggaagaataagtcattttcttctgtgttttgactcccattttgtctgatctagaaagattggagagaagcttgtcaatggaggttactctgcgtgaagctatttattatcgcctcttaagttgtagggtattttggttccctttttgtcatctcccatgccaaaacaagacctggcaaactttgatactaactattgttcctgatcggttcatgtcgcatgtggtctcttaagcattcatggatggagaccttttgtatggatattttgatattttgtacagttgcatgtgttagccatctgttctgttatttgttgctcctactattttgccaatgcttcttaacttctctttactgtgcccgttgtactggtgccttgcaatgacatgcctgaagttctctctcacaccagttccattgcaatagaatgtaggataatccctgcgcgcttgttacttatactctttttttttttacggagggacggtaggtgtttagtacctggaaatatgcaagtgattctcttcgctgttagttgcgtcttgccagcttgtggattactgctgtctttggtcttggtgatttctgccgtactgccgttgcgcgctctgttactggcttagttggtcatatggtttctgttttttatgtcaatcgctacttccaaatcagctgcagcctcacctgtgctattggagaagcaattcgccggagcggggggagtgagggacccagcgctgtggtgaatcaggatcatttacattagaggttctaatgttctcccttcggctaaaaaaaactcaatcttcaggtttaaatctagacacacaccgattgagtgtttttttacgaagggagtagagaataaatagcagagtgtattaggtgagttgtatccacccaatcaagtatgtaaggctcagatgttgcgctacaatattttagaaacatttttattgtgtgttttgcttgtatcacgtgacctgaacaccgaactggaatggtgattactaggagacaaccggccttgttgtggctaccacttcgatctccagttccattttcagcggctagcgttacaccaaactcgtgcagaaagcgtctagccgccagggcacctaaatcgcggctcaactcgaggaggcgcgactacggcgacttgttcgcataaaacggcctcggagactaacgatagggcagtttctggtaagttatgagaaggatgcagtgaatgggctgatttgaggctcgccggaaaggcaacctccgagaaggggaagaaggttggtgatcgttatagtaacattttgaatgtacctttatctcaattcagccgtgtatccgtcatccaatggctactaaaagcgatggaatgccattttgcaatttatcatataattttgagttgctgtcattcatagagaacttagtattagccagtttacgtacggcgttgaccgaaagtaatcggtttttaccggttttccacggtttttggtaaccgatgaggagggtttttatttcaaaaaccaaaaacgtcagcacatcgctgggtgtcctgtgtttctttcatgcaagggtcttctcactcttctgcgcctctttgtggtttggagtacacttgtacttatgctgttgaattttgtgccataataaaagagagaaactgagttgaattttgtgccatcataaagagagaaaccgagtcaggaagtggaggatcatatgagcaggttatttgcattgcacttgcgcctgagtttttcaaagatccatctattattccgttggttttgtaggttgaacatacggaggtgtgtgtgctgggcgctgtagacacactccgtgctgtcgtacacagtcacacattacaattgtacagactactaacacaagcaaaccacaatcacttgttcttcttcttgttctcgaggacgaggaagacggcgagcgcggcgacggagaacgcggagagcacgccggcggcgacctcgatggacgcggtgacgccggtgatgcccgcgacggcgaagctggccgagggcgccgtctcgccataggccacccgcgcccccgacgcgtcgagcgcgtaggcgcgcacgtagtacgacgccgtcgggacgtcgcgtgccaccgtgtactcgaacttgccggcgccgtcgtacggctgctgggcgatcttgaactgacacgccttgtccttgctcaggtcgtcgtgggccttgcgccacccgcggcccacctggctcgccggcgcgtagcacagggtcaccttcaccgccttgtagccggcatccgccccggccgccgccgccgccgccgtcgcgttcagcgaccatgtcacggtgatggcgtcctcgccggcgtgcaggactggtcatcaatttgacagcgtgacaacgttacattgacatgcaacatgttgccaacttggagtcactattccacttgagattgtaagaactagacgaattagaaatttgtgagccaaaacgcttttgcaaagtcaataatatcaggctctagagccaaccaagtgaagaaaaccacggatttattcaagtatttgtcctgaactatatttcgcgtgcagattatgctaggatcgtccccattgaaagatcaaatcaaggtgcaaagtcacaatcctcttgatcagttttcaccaaatcaaagtacaccaaacacaaaacagcacagcaagggagaataatatatatgcatatggatgcacgcaccttggccggcacggggcgacgcctcgacgacgagcgccttcgcgagcgcggagaggcgcgcccccgccgccgccgccgccggcgtgacatggcaagcaccgagaactacaaggagcagcaacagcggtagaaacacgcggtgaattaccgccccaaaccgagccatgatcgttctctgctagaggtggaggccatttgagcggagcggtagcttatatataggcgtggtagcgtcgagtaagttgactcgtggagagggagggagatcgggggagttcaactttgtggggtcgaggagggtagcgatgggtggttccgaaagtcggagcttgatggttcacgcgggtctgactgtcggagcacgtacgtttggctgtctcgtcggctcgatggggcacctcggtcgaccttttgagggccatggcgatgtgaagcggcgaatgcaggctaatgcagctgtgtggtatctgtagtacactgcacagtagtagtagtagactagtagcagtaccacgttaacggtagtagtcagacagtctgttggtggtggtcagaacacggtacactgtttgccggagaaaaatcacgagccctccaatccaagaaataccattaacgaacacagcttcctaaaaatattattgtacaagcgcttttattctaaaaatatcatcgtcgttagattttcgtttgtagccattcgttgagtgctataaaaaaccattttacccctacaaattattaaatgattaaaacttttactctttcagtcaattttcaatattttagtgtaaagagcaaactaattgagtgtaaactaacgaaaagagcaaaatttttaatcaacctttaataatttatagggtaaaatgatctttttatagcacttaacagatggatgcaaccgaaaacttaacaacgatggtaactctagaacaaaagcacttgtacgatgacatttctaaagagattagatttatcgatgatattttttgaattggggagagtctacacatctgtcgacagatttttcatcataaatttgtcaaaatttgtacctttggattaaacccataaacgatagatggatgacacgtgtacagcactgctgaggtcccgcatctactaatcgatagtatggatgggcttccgacgttaattcacactctcgtttcttaatcaaaattagttggttatttatccatattaattattaatccttgagagctcatctgctcatgtatagtgtgatatctactagatattttttagtgcatacaaagatattaccaatccatctactaaagttacattgttgttacactataattacaccatagttacaaatgtaattatggtatagttacactgtaattttaattacattgttgttacactataattacaccatagttacatatgtaattatggtataattgcactgtaattttaattacattgttgttacattataattacaccatagttacatatgtaattatagtataattgcactgtaattttaattatattattgttacactataattgcaccatatttacatacatgtaactatagtataattacattgtaattttagttttctaacactgtaacttcaatataaactttattttgtcttgaaccaacttggcttaattgctctgtggtgtacgtttaacagggaaaactagtgctcttggaatcgatcccccgctacgcacagacttgtctcttttatccatcgtattagttagcacaaatctccacgcaaatcatatggcccaaaaatcgacaaatctttaaacgaaaatctgtcgacagatggatagcgaattcgtttgaattgggatatttatcgatgacattttatgaattttctctttttactatggcagttcgcctgttggcaatgcaattttgcccaagtagcccataaaacctccggaccaacacaagcacaagcaacaacagaagaaaaagcccaaaaacaggtaaggcccaaaccgcgagacaggaagccgcaccaaaaacccacacggccccccacgagagatccatcatccaccgtaatcctcctcgacgtcctcacacgcctcacctcacctcacctcaccgccgtctccttcctcgtctcgtctcgtggcgtcgcccaaaaatcccgagtccaaagccacgcacgcagctcaaaaccccaccgccaccacaccctctgatccgacggcccagatcgctccccccctaattcccgccttgccccctcctccccatgtcgccgccggtggccggcgccgcctcctccggcgacgggccgccggggcgcccgccgcgcgagctctacaccatccctgcctcctcgggtaagcctccgcccccccaccccgaatcgaggtttcctcctcctcctcttgctccccctcgctctcctagggttaggagaggggaggattgggaggaggaggaggaggaggttgcggcacgagaaataattccgtgtgtgcgtgtgtgtgtgcgcgctctcgcaggttggttccagtgggatgagatccacgagacggagcggcgggcgctgccggagttcttcggcggcgccggggggagcgggttcgggacggcgtcgcggaacccgcggatctacagggagtaccgcgactacatcatcagcaggtaccgcgaggacacctcccgccgcctcaccttcaccgaggtccgcaaggcgctcgtcggcgacgtcacgctcctccggaagctcttcgccttcctcgactcctcgggcctcatcaacttctccgcctccccctcccgccccgaggcgcagcagcagcagcggcagacggaggcggaggccgtcgtggaggcgcccgtggggctgcaggtgacgccacggccgccgccgtcgtacttcgcggaggagaagggaggagggggcaacgagaacggattccgtttgccgccgctgacctcgtatagtgatgtatttggagagtgggcgcctgggatggcgcctatatgtgggctctgtggcatggagtgcagagacgggaatgcccaaatattgaaggtactatcgagttataaagttcctttttgcattagctgggataaatgtgggatatcaaggaggaatgcggtatcaattattaagaaaatggaggtgatgagtggctacgtcatcgaacgcaggctggcgcaaagctcttggcagctatctggcaactgagctgtgcgccattctctctccgtttgcattaggttgtcttctttagcaaattttgggttagtaatcatgtcttgctagatttaggatgctaatggttacagcgctactgtgtggcaatcaaatgattggtttgaactttgtatcatgcatgcaaaaaatgtccaaaggtttaaattctaggctttaggaatgcaagtatttaacattttacaacctacagttttgaataaattacttgtcgtcttgtggagaaatagattcgtgaatatgttatgaaataacagttcttacaaaatattaaaggatatttggctctgaaataggtaaagcgtttagattatagattggatcgccatgtatgtgtctagcatgatgtccttctgcactaatggttttcatggaatacatactccgagatgccattattattattttttattatagtatttcttgcagcatcattactctatttatggcattctgtgagatgtatctattattgttttattataggatttcttgcagcatcgctactttatttatggcatcctgtttatgttgtcgtactccttgacatgatttttgttgcttatgcttcatagcacaccaagcttcgacgggaataatctgagaaaagtacatgttatatgtttgttaacatttggtatgcttgcttttcaggatggttttaaagtatgctcaaaatgttatgccaataatgataataagggtgaagcaaatatacatccaggtgacaaaaaggagcggatcgacaatcattcttctagtgcatggacagatgcagaaactctccttctcttggaaggtgtactaaaacatggagatgactgggatctcatcgcccagcatgtccgcacaaagaataaatcagaatgcattgcaaggctaattcagttgccttttggtgaacatatgctgggcacagtaaatggtaaattggataacagactccataaaatccaaacaaccgatggaaaagtgaacaagtccactgtgaaggagtcttcaagtcaaccaactgaaacagttgatgacatgcagattgatggaaatgaagatggcgctgataaatctgttgaagaacatcctacaaaacatagacggttgttttcttcaatagatatcactgtctcattaatggagcaggtaataaataaataacaaacagataacaaaaaactcgtgtgtgaggacacatagattttaaatggaacgaactgatgattgctattggtacctcagttagcgcatcttaccacatcgacaagcccagatgttgttgctgcagctgctgatgccgcaattaaagcactgggtaatgaaaacccccaagcaaggagagcttttcaactcagtgagaaagagtaccaaaccagggcattctcttctaaccatgcccggcagaggtaaagatatggtatatattgttcttatttgccagtatcagtgcagtttgtttgtattaactgttagggattattgcagtgatgatgttggtggtggtgatcgggatgtagaaatgcacgggcacccaggtaggccaaatatttggatcattggatggctaactattacagaattctttctatatctgttggtgcagttgatccaaccggatctgttattatgttgtctagacttgatctgaatcaccacgaccaactattaagaattacaatcagcgtgaaatttgtcatctcttgttattaacgatgagtagatgacaaatctgaacataaattattactaccagttcggaatcttggttttgagcctcctggcttgagttaatgttattatctactccctccgtttcatattataagactttctagcatt

SEQ ID NO: 79275 - DNA, 104618 bp, Oryza sativa
agcagcagcagcaagagcccgcccccggcgccggcgctggcgcggacttctccgcgctcccgccggagctcgtgcacagggcgctggcggccgcgggggcgtcggacgtcgcggcggcaagccgggcgtgccgcgcgtggcgggacgcgctgcggccgctccgggaggccgcggcgctgcacgcgcgggggcgacgcgtcaagcacgcggcaggcgcggccgcggccgcgggcgccgaggggcggaaggcggagaggcagcgcgcgctggggctgttccagcgcgcggcgaggctggggtccgcggcggcgatggtggacgccgggctgatgtgctgggaggaagggcggcgtgacgaggcggtggggtgctaccagaaggcggcggagctagggcaccccgtcgggatgtgcaatctcggcgtctcctacctagaaggtacccccggattttggcctacgggatcaatagctttcttggatactcgatcgagactgtagccgaaagctttgacgaatcttaggacgaattgggtttgctcacagcatgattagaaccattcgtgtttagggcaaagttttgaccttgctctgtcgctggcgtttgtctttttgtgattcttttagtaacctttaactcaagtctgattctaaactagcaggggagaaacctactgggttgttgttgttgctgcaatcatattcttcatctcaacgaattgcaactgattgttgctgccaaatcattttttagctgatccacccaaggctgaggaagctgttagatggttttatccagctgcggctgctggcaatgctcgtgctcaatacaacctgggcctttgcttgcagaatgggaaaggaatcaagcgtaaccagcgggaagctgtaagatgcctcctcttgttacatttacatctgcatatcgcaaattttccccgaaacagaaatacgcagttactatagatgtatccaattgttgaaccagcatcatttattctttgttgtggtatcttgtttctactcctacaagctatggactgtatgaactaaattatagtcaggcaatttagagctgtacgatttagggataatttaccaatttatcagctccgttgtggttttttagcgagttttattttgatctcacattccattgtttacaatgtgatctatcaaaactgagataaccagagtttttgacagaaaggagctttttgatctggttgggtttccctaccgatgtactcataattgcaccatcatgatcagtctgaatttgctaaattggcggtctcaagattaccaccactgtagcgcacaaagttgactgtgtgctttattgccttgaatctgcttgtttaaaataaggaactttgcaaatgcaggcaaaatggtacctgcgagctgcagagggaggaaatgtgcgagccatgtacaacatttccttgtgctacaactatggtgaaggattttcacaggatcaagtgcgttcaaagaggtggctgcaattagctgctgattgcggtcacaagaaagctctttatgaatgtggtattaaactttgtgcggtatgtcattccatttcacctaatgaatgaatcatctaactgtgtggaaacaacgtattaattatatattccttttctgttagccaccatgcagttcttccaattgcacattttagtgcataagtttaggccatgtaataaggtaagatatgtaaatacttgtcataacggtttggttaagggcgtttcaagaaacagaatacggtgtgtgtgctattttaaattttaaaaagccaatatctttaataacagaattagtttgaaattgccaaaaacttgtatgtttgtactgaagtagtatcagctgtataacttatgtcatcgtcgttcgtactattcctactgcttcatcaatgttggcgtgttatgcatttacttatgccttttttttatgatgattcttctcttatttaggcaggagacaaggtgaggtctcttatgtatctagagttggcgacgcgccgtggagaagctgctgcctcacatatgagggatgtaatacttgaatcactttcccttgtgaatgcgcaacgtgccctgtcagatgcggataaatggagaccaagagcactgtataccagaagatgagcaaatgggcccatcacacgtataccaagttaataaccccttgatgccaaaagtaaaatggaaattcaccacctgaaggcccaagtgagcaatatgcatctgtggcatactctagtgtatgtggaactgtgtatatgttaactttcaagcccctctctccttttcttttgtacagaaattatgacagcagaaatactgttacagaaggtcaagtggcaataatatccctgatgcagcataggatagaactttatagttgaattgtttcagattgtaataaataggaacaactggtgtttttttttcgctgaaaaagtgtggatgtaggtccaatgcagtgaaaagtaattctgtgatcagctgttctaaattgatggttggtggaatttgcctttgtgaaatttgaagggttaagggaatctctgtgcgactgtggcccatacattgttgacggcaatgtactagtgaacaaattctaggtgattttatcgtgctatatagtcatctccagatggatgttggttatgatcgcatcaaattcatcctttggtttctattttgaacatcagtcttccctacggtgcatcagttccaatttagctcaaccgttttatgcacatggctgcttttgatctgcagatgttattgatgtcacaataattgtactactaaacggtaccgtatgtctagttgagtctgcagttcccatcgcaatcgctgtatacatcagcaaccccacagaatctgcaaactgcatctagtttcttcacagagaaaatgataagcacatgacaaggctgtctaacacgcgcttttattaatacaggcattaacgtcagccatcccaaatttcaccagacgtggctcaagttcacaaatcaaatggcgcaacaggacacatttcacaaatcaaacagcgcagcaggaaagtcataacagtacagaacacaggaataacaccatgggagtagcttttatttggggcaatatagtgacgagaagcatacgtagcagtgacatgccacagttgcatttcttcgaaacgaagagcagcggaaagctcttcagagcttcgagatgaggccgttctggatggctttgggcgactcggcttccttgatgtcagcgtcggaggagccgggaggcacgtcgaccgccggcgagcagttgaagaacccatgtggctgaaaagaattaaacaagacacaaacaggctttgagctgatactgtaaaaaccagaacggtggaaactagagaagtcgtctgccaaagaggagatatgaaaggctacaagagaaggtctttgttctaaaaaaaaaaaaaggtctttaccatgagcatgaagccgatgcgttccactggcatgacaggccagtcctccagccttgggatatgggtgagcccaaacacatacctgcagatgcagtgtatagttaacaacaatattcccagtcgtgaaccgaagaaagttacacagatgcatcgtagtagcaagtataccagagaacaatgtcagtttcctccaggggcctatccttcttgacccaggtagctaagccctcgtggatacgtggattctgattggggaactcccctccagggaacacctcgtcgctcttgtactgcgtgacccagagattgtgcttcaggaaacccgctctcctcagaaactttgcctcgggtagagccagcggcaaacagtttgaaccaggcacgagcctgtagccggttggctgcccagtacgattaacagcccttgtgttccttacctgatcagatgtcaacaatgttaggtaggaaagaaagatcggtatgtatgatcagctgccacaacacaaaataatgttctttactctgagagttagagttgtggcctaagctatctgttattaggtcaagagtaatgcagctaataagtgcaaaataatagcactgctataaagcagcaagtcaatgcgtcatttctgaagaaagaaaacaatgaccaggtactggaaacgttatcatggtacatcaacaccggcacaatataaaagggatgatactgaaagatgatgctcttacgatccaatgccgtgcagatgaagggtcacaatctcgcattgcttgcagctcagatttcagtagtttttcctcggcatagaaagcgttgttgtgcacattatgtgtgcctgcattttcaactttcacatttacctcaaccacctgtgatagaaagcaacatatcagactatcaatacatgccaagttcaagcaaaaggccctactactactagaactaaacttcacccactgtagacaagttacttgtacaaacagcaggtctaaatcaaagtaacattatgataggccttattgtggaactaggtggaaaacttctattcagtatatccagcaaaactttaattgaaatgcataaaaagcaacccacctgattatgagcctcgttaggtttacaatcaacagccatgtccatacgggcaacaaaaaagtgttggtgaacaggtgcatacagaccaggagcaatggttgtaccatattttcttgattccccaggcatcagagctcccaaactaagaattccagtaagttttacttctgcttctatcttgccatcctatatccaacagaatgaacaaataaattatattgcaaaaatatgtggtagcagaaaattaaagcatcaaaaaattcattaaggaactaaattcagatatgtattcactatctcatgatgtttgcaacagccaaatcggaaataattcatgcataaccgtaccaaaagctacagaaggaatatcagcctttataggttacagcttaatcgctgagggcattataaggaatagtcagttgaaacaattacctgataaaagtgccagtaaaaaccatattcatagttggcaactgtgcagataaatgaaacagtaagcctccttgacctcctaacttctgctaaaccagttctccaatcctggtgtttccaaaggattccgtggtcttcctcatgcaaacatacacaattctcaattgtttccacaccacccgtaaaattcgtgaagtgtgcatcaaaatactttatgaaacctaaacagtcacatccctacaaaaaaaaaggcatataatagtcagatgaaagttaaaactctctggaggtaaaaaatcattaagaactgagcaagcaccctcttaagagaatgagcattcttcccaagtccatcttctccagcatcaaaagcattcttgcgataatgtggttcattgggatctccataaggaacaaccatctcaacaaagctgagcctatgagctatcggccgacgtccacggctgccatcaacatatgcaacagaatagatgaccaaaccctctttaggggtgaagccaatacggaagttccactgctcaacatcattaaaagtgttattaattccagggggaaatatttttttgtttatctcatcataatagagaaaagctttacacaacaatgcaccttctgccattccacaaaatatccgttaatgcggaagctcgggccctcaggttgattgataataagaggtttcaaatcacttcgatcaacaccacctctcgtttccccaggagtgtagtttctcagatgatctggtggggggagaggaaccaacttcctatcttcaaattctatgacaacgttattctgcatatcaacaataacatggatcccttccacaggacgtgcataaccattctccatgggactatcactgtcagttctgcaaaagattagaggcttgccaagtctgcggctgggagcatcagcatcactgtagtagccagcacacctgatgatttagaacaatgttcacattatcattttccatatgatgattctaagacaacaaagccagctatgagatataaaacaaaagaagtttcctaaagcttagcttaccaggcatctaccatgacaagttccatgtcatctacacctcttctcttcatagcttcaataaatggaggatagcttttgacagtagcttcacattcagcatactccatagcatcctgtgaaatatagaaatttgaactgagcgctccaaaaggttctaaaaaacttcaaaagaaaaaacagttcaagctgtaatacaagcataaatatcggaaaactaataaattgtgtcctaaaagcaatgacagcaaacaattcaagctgtaatgcaagcataaatactggaaaactaagaaatcatgttctacaagcaatatttgcagagtaaatttaaatgttgtcttgaagaaatttcacagactaaatgattggaaaattgggacaaaacaatcaaaggaaggaaaaaaaaaactaaacaaatttattttaggcaataccattgcaggctgaacttctggaacaacttcagatgatatcactttccctctgtgatgtccacccctagtagccgcatgcacctcagagagttctactatccaaatgctagtctcatttgattgtctattgtagactgtgagcttggccctcctagggggcaacctgcttggaatgacagcagagcctttggttctaggaagcagtgatggttggaatggtgggaaaaagtaggcatcagctaatgccacgacattcttttctggctccaatagcaccacttcaacaaaacgcatgccatcacgttcctgcaaattcagaaacctctatgtcagctccttttttttaaggttgtagacaaaagtacatggaatattattttgacgaacctcaggcgattttccagcagctcttacagttgctatagccactgcaatttcagcagcagataatggatctaaagggtggcttctctgggctctggtcattataggtatccctgccattttgttccatccagcagaacattagaaacgggtaataataatgaatataattcaattaagacatgtatgctgaacaggtcactcaaacaacttccaagaaattacaaaaatatacatgcatagaccaacaacaaataaccaaactcctgcatgaacatacagacctcttcaataacataggtcaacaatcgataatagataatttggcaggtcaagtagaccatgctagatgtgcttatcaggaaggctaaagaagcaatacataattttttttgaacgaatagaagcaatacataatagttaataaaaaagcagttgttgacctatctgaagatacagataaacaaagcagcggtgacatgaatcttagtacattacagtgcagatatattcattattgttctatcaacttatgtcccccatcttagatctagttgttaacaggaaataaagtcccttatttatacaccacatagacatgattggagaattgtttgatctaattagacgaacacgtaggggtatcaactgcattactgtaaatcatcccttcatgtaacacagttaaaattaggaaggcacgatctattttgaagttaaatttgacgaggtagagtcttaagagactaataattcttctcagtaacccctgccaacatcaggtgaagtattacaccagtgttcaaccgttttcagaaagtatatctgttcaaaaaactgaaaatgactgtctgtctgtctttttagcttataaactatgaagcagaatttgtctaatgcgtaacgatattttggatgagatgagaatcaaagattatgctcagaatcttaataacatttggatggccttttctacggccatcccggcaaagaatagaagatcgtgcccagtgagtttcaaaggaaagcctatttggggtttgctacacaaaaattaagcgttcaacttacgtacactgcacttcttcagcatcccgcaagcattactactttgtgatggccccgtggaccagcctgcatgatcagcttacgaccagtgcctagtggcgcatacagataaagtgcagattccatattgctgatggccccatgattcacatagtcaacaagcctattggtccatcgctgtacgggcatcgttatccatttcagacattttactcgtttccctatatcaaagaatttattggcccatcactaaacagacatcattatccatattcagacattttccttgtttcccatatcaaaactcaccatcaaccaaaaactatggaagaagaaagatagaagcgatcgctgctactagtgatcaaagaaaaagttgaaggttgcaacgcacgacgacaaagcagaaagccagaacagtaaacaacaagcccggactaccggaagatatgtgacagcaagtcccacaagtaggtgtcgcaacatcacgtcatgcccccatgatccattcaccaatgatgttgacatggagtggggacaacctcttcttaattttttctttgcgggggacaacctctttttaattgataatttgtttaaggcagattaatgatttagtgcacctatagatctaaacaaatacatatgaacagttcgcaagctataatctgcatactctgcctgcatgcatcgatcgagaactacgattgagcaaacgtacgtaacgagaactgtccgatcgtacgcgcaaataaataaatctgcatcctctacttgcatgagcacgagaagtccagaactatgcactttgcacaaaactaactgactacatttcccgaactcacacctgagctcgcgaggaaatcatgatctcgagttctccacgaataccactgtcacgtaatcacgtccttatcctactgtcttttacgacccatgcacggcacggcacggcacttccgcaacatttcccatgacccaatcgccaaccactcacacaaatccaccacgcatcaccagcaaaatagcgcaaaatgcccaatccaactcaatcgagagagagagaagggtggagatccccgaatacctttcgaggagaccttcgcggtggtgggctggaccgcggcggcgatctcctccatcacggcgccgccgccacccccggccgccgcggcgacgcggggatcatcgcccgagaccatggagaccttcccagcagcagcagcagccgcgggcgccgcgacgatcgccccgcgtgacgacgacccggggccgccgtcgacgcgccgagcagccgcagcgccgccaccgccgcagcagacgacgaccggcgccttttcctgagttgcggccattggagcggattcgcgagctgaccgtgtccgtattctccgcctccgcctccgcctcgccggctcacacgatctgacatacagcacaggcctccgccctcccgcgcgccttcgtcctcccctcccctcccctccccccacctcccgcttcctcctcctccggcttctggggtttctacgggcttagggctaccgcgaaccctaggacgaaggggaaggaccaggccggcctcgtgcgtttcctcctcctccgcgagagaagccgacgaggaatggggaagagagagagagagagagagagagagaagccggtggcgagtttggaatggtggtggtggcggtggaggaggaggaggaggaggagacgggggctttgggttgttttggagggcgaacgcctcggggctcacgtgcttttataaaggcgaacgggggaaaggtggctgggcgaggccgcgaggggaggggaagtgggtgggctggattcttctgggctccctttcccgcaaatgctacatgcacgggtaaagctgtaccccacattgtgttgatcccggtatgtaagtttttcttctttttcatttatttccttttgagacgatccctccatgaaaagttggcattttcgccaaaacgccaataagaatgccttttctgtggtggtggtagttgatttttgttaaaaatgtctagcgacagctggaaattgatttttgtttttttttcctgggggtggtttttttttatcatgtctcgaaggaaattgaggttgatggcttatcaatgtcattgcaattgccgtgatggtatcctagtggtaatttttgtggtatcttttgtattctaaagaattatggggtgctttgatatgtccctatactcgccggtagctatcaagggaaataatgcagaattgtgataactttttttcataatcaccaagtgctacttatggatttgtgttattttataaacatgtcagctttggatactttagtgatgtgattgaaattattcctttatgagatactagaagagatcattcgatcattccggatcctatgcaattgctagatagtgtgagaagtgatgagcctgaggtcgcatgaaacgctctatcaacatcgtacaataaaatcgggtagtacaaatggtggaatcatttgaaactattggatagaaaataaatggtcataactatatggaattgctattatatactccctacaccggatctccatttcaaaaaagattaccgtgtactttgacaatatttactatggttgttgaagtgtatattgtggctgcgcatccacaagttagaggatatgaggatcatcaaacttttctatagcccttaatcatttgtcatcttcattgccattgccgtgatagcatgttaatgttgtgtatcacataagttattgaaaaaactatttcgacgataataccataaagacgactcgattgtttttttagaataaagtactcctattaagcgaaagtatttctatgaactacttccgctcaataagtactcctacagagtactccttacaactattttagcgacatggcataaagtactcctacaaagtatcatttcaaaatgtattaaaggactatctcaattttaggttataagactttctagcattgcacacatttatatagatgttaatgcatttagtcacacatatatgtctagattcattaacatatatatatgaatgtggacgatgttagaaagtcttataatatgaaacggaggaagtaggatttatcacctttaggaagatatttggggatttgccgcctatatatctgtggtatattaatatgtgatctcaaaacattgcagatcttgaataaataatagaaccttacctttttgaaacagctcataaaaatcacaagagagcgtgacaataaataatgagtgaaaatacttaattggtctctcaaattaattaaaaaaaccggcaactaggtagaactggtcatattcatgcgccagaaagcacttttgtctgcgctgcttgtcatgtatcccaagaggaatattgcagcatggcgaacgcagacaccgcaacctaatcctaacccgttaaagtgctgagtgcttttgcttcacgagattactgcatcgatcgatcccgttaattacatactccttgtatactaaattaaaaaggttaattgggtgtgcacctgacagggtacgtgtgagtacgtgagccgtgaggcgcgagagcacaagcatgcgcaccgagctccgatgacaaggacgggagatgaaggcgttcttatcatctgagccggaagcaaaacgaatcaggatgctcgagcccttctcacgttggcatgcattactcagcgtagtactccagctaggtgccgagcggatattttgtaatgcgggctgattaggatcgactagcaaaaattactacgtcgacattacttcacgacgaaaatttttgtgattaatttatcaggtgccagcaccgtatcaatcaaagactgaatcccaggggagaagtatgctgtggtacgggtgagaattaccaagtatccacatgccaaccagcggcggatctaaaaattttcttgagcctcggcaaacctatcaacgggtgaagcatgcacataaaaccttgaccattaatcacaaacacaagtagatttggcatgtaaaatcttgctttgtgctggttgatcatgcgtgttgggctctattagattgaacgaagcaaggtaatagccaattaggtatgtacttaacgagcaatatgttgtaggccatggagtaatacgctgtcgcaggtctaggagcctgggcacccgcccatgctggccgggccctggctccaccactgatgccaactactatagttgatacggagtatgataatttagtgggactatcaatatggtatttgacagaacacacatccattaaatgtaaattatggatcgttgaattgcttttagatttatgcagcaatgcctaaccctaatactttattctcattccctcagtcccaactcacaccattgtcgcttctccttttcctcgtgtgcacactccactcgccaccgcaccaagccactgccttgcctagttgactgggcggaaggcttcaatggtgtcggtgaggcccctcctttccccctccctcttctttctggcgtgagctgttcgcatgtcatcgtcttccatgtctctggcagctccccaccaataccattggatccaccaccaccggtcatcaccacttaaccaatctttctgctttgtccccaccgtcaacaccaggtccccactctgcttctaacctcgcggcttcggtagcaccattaccatctcatcgctcgcccaatccaccgcccaccgtggggctatcacctcccattgccatctccctagagctaacgaactccttcatcttttctcgttccccttcctccacccctgatcccaacatgggacctaaaagtgtaggtcccctactgaagtttggagtaccaccgatgccgaaaaagatcaggagattgtcggacccgaaggagaagggcaagagcatgaatcacgaagatggactttatgacgaatgatatattagcaattttgtgatttaatttagcaatttatttttcttataacaatcttgtttgtataggtggaccaaagcccgagcatcatggagccacatgtaatggctcactgttgcgggtaagaggacactagcatgtctaatgcacctttcagtcgattgatgctgacagctagtagttgtagcgaggtttgtttgtactcctattcataaatatattccaaacgtactagatacattttgttaccaaacgttgaaaatggtttataagaaggcaatatcattttgtattgtacttcctccatttcacaatttaagattttctagcattgcccatattcatataggtgcttacattatgaaacggaggaagtagcatatgtgatgtgaatagatgcttgcacattggaatatatgaaaagaaaaaaagagaccgcccaccaaccgattacactatcccaacttaaaatgagtgtgctaacttaactcgtagcgcaattgaaagagtttatttcaaaatgtttactagatatttttttgaaaatataaaattatattttgtccgcttaaattcctgcagtaattatgcgggagggatggcgaggtttgatggctacgcgtctatgaattttgaaaccatatggtgtattgtcaacaggggtgagatgaacaccatgggttggaattttggataacgataagagagctgtctgataggagtgggtgtgtatgataggagcacgcactactcgatcacctgctacaacctctcaacagctcagtgttactggagcactcagcttgaggagactgccacctccatcgtttgtttattttttattatcagccataaccataaaattaattcaaaagttaaattctggttaagtagtatagtagataacaatacatatataaaaattttacttataaactattatttttctcaacttacaatcagctatagacaaaatgatgtgctcacccacaacaactatttttcacagctgccgtaaatattttggtgactggatggctccacgtcaccatgggcccacatgtctgctgccttttccgctcacgggccacatcaccagggtccaccagggcttttgagaaaagcgtgggctccagcctccatgtcggtcgcttttagcagcagcagcgcgccagcgcactccggtggctttggcttcgcgcgagcgaggagaggtgcagcggtgtacactgtacagtgcgctacaggttaacgcagcagaagtgcaggcgaggcagggcaggtgcggccgccgtggtggtggtatccagcggtggagcaaccggcggcggcggccgattattggttcctcggttcacgggagtggtgaagcgcagcgtggccaccggccacgtactcgcgtacgtactcacgcccgcacgcacgcacgcctgcgtgcgcttgtgccactttggcgacgagttgacaactgtgagtccgcgacagcgatcacccttcgagtgtgttgggtggtgcaccgacgttgctgtccattatatcggccaccatttgccaatttgctgattgccgattgctacggatacggcactggcttttcggctggttaatcgagatgctctcctttaatttgtgattcgctaaaaaagatgaagaaaaagatatgcttattctgatccatgattaggatgcacgaacgcttaacaaatgctactgatcacttgtgtgtagtgcggtacagcggtaacacccttgccgtgatgaggaggagttcagggaggatctacggctcatacgtacggtcgtggtacatcgtgaggtgaagtcatccgctcaggccaaatctgcgtgcccgggcagctgcaactgcaatatatgatcactcaaaaaactttcaacaatgtcagctcgtggaagctgacgtgtccaggcgtcaaattgatggaattccatttccggagagaccaaagcgagatccccataaaaaacgtctcatcatgcgtccacgcttgcatcgacgtacagtactacgatcgtaaaatattatgcttctttttcgaaagggcccggctaatgtcaccagttcaagtatcctatccaactccaagtcatccaaccttgctaggatgagaacgacacggattagtgcactcagcatggcatgattatgtaggaatccaatgctaactatactcgtctgttttatgatgccatcgagcctagcttgcttgattgatttcgatcaggatgatatgccccttcaaccactctatcctgcatgcttagtttgcccacactccaccctccacagtggcaaagaaagctgcgtgagcgtgacggcctgaatattcctttttaatttggccaaatgaaagctcagattcgcgatatacgtagacacgtagtgcgcctcatcatgcacgattaagaaaaggaaaacgccgagggctggtggtctcaaacaaaacggtgtgcgtgatggaacacgcatacgtacgtactactacattatactcgcttgctccagctttagggcctctttaaatcacagaataaacaaacagagaaatagaaaaaacataggattttgacaggaataaaagtgtaaaatagaggattgcaaaacacaggaaaaacataggaatgaccgtttgattgaaccatagaaaaaacacaggaatttagggagagataaagactcaaaagatttcttccatgaggttctagctcttgttaaaattcctccaaaacttatatgggaagaggcattccataggaattttatgggattccatagggttcattcctttgagtcaaaaggctttataggaaaaattcctatagaaataaaatcctctaaaatttctataaatttccattgaatcaaattgccttaatttagtcccatcgatatccaaaaccatgcgtacgtgtgcatcctgccatcagcccattctgatgcacggcgcaccgtcgtccgtcgtcgcgacaagccaatatgcacatataaacgaatccaccgagcaagccggagcacgacgtcgtgctgcatagctggatgcatcatgcctgagtgcgtttgatacgtacgtacgctcatccaccaacgggcccacgacaaaacgactcgatcgatcggtgaacattgctcgcgttgccgtacgtgcttcgtcggtagtcgtgggtggggtcttggtcaccccgcatgggtaggagctgacgcgtcacgcgtaccgccgtacgtgtcgtatcgtgtagacgagaattttttttaatgttttgaacttttaaaaacattaaaccattccaaaacttattattagaatttgaaccttttttatcacgtcaacctgctagatacaacgagcgtgataattttgttatgccacgcaggatggcgtggccagataatgctgtcacgccaaacagaccgacatgacagtgttccaaaaggtttagagtttttgaaaatgtttatttttaaaatttaaaatttgaaaagtttaaaaataaaaaaaaattgtgtagacgataacgacggtcgcgcaggcttggccgatcccgacccgaccaaccgggggcgctgtcgcatgtgaagtgggctgcgcgcgtgggattctcagtggccttttctggagtagcttctttcggcccgctttgctgccatgggccgatatgtttatttccgtcttactcagagcccaattcgggatatgtggtttcgtttccgcgggcggaagcggagagaaacggcgcgggccccggggagagaaccggcatttcccgctgcgcgcattgccggcgaggcgccaaaaccctaccgcgcgataatcctcttcctctccgctgcgctcccttcccagccggcggcgccaactttagtagccgcaggccgcagccgcccacgaaccgccggcgacgagatccgagaggaggctggccggggctgtcgatggcgtcgtggtgcggcgacctggctgcgccgccccgcctcctcgtcgcccctcgtgagtgcccctcctccgcccccggccatcgttgtgctgtctggtctgtttaggctcgcatgtttcagggcggtagtgcgattagtgattctaattccaaatccccaattggaagcatctggtagcagtagtttgttttcgtcttcaattttcaagattcctttgagctcggtggatttatgtggcttggtcgaaatgccagcggacttaaaaattgtgcgaactgaagattaccgcctgagttttttggttgggccttgggggtcttttaaacactggattacggagcaataagtgtatcacatggaggagcatcacatgcataaatgtataatcagttaatcacatcccattttgtgttttccttgcaggtccttgtgatggcaattgtcaagggaatgttttgtctctccgccacccgagatcaggtgctcttattcctccttgcttctgttttctttgtcggttattaaatctgcactagtaatgtagactaatttggtagcctgttagcatctgaagaatagccatgcagaagtagattatcagcattcaacagttttgcattaactcttgcctcatcatcaaacagatgaagaaacagggtatctgttcatcgacggtcaacttcacgagttcaattggtttaaggagcgatttggatcttggttcttgggtgattatgtttgtgaaggtatggcagacacatagctatgcagttgtcatttctaagaaaaactttgtattttgcctttatggtaaggtttgtctattattatcttgtgtgggctataggaagacattttgataggaattattgccctgcctctgaaatcacccatttagattttgttagcaagtaattaaaatatggaatcagacagacatgttgttaaaggagtggtgctattcttgttctaacacagcaacataaataacttccaaatggcacaatctattccagataaagtttttgaaaaatatcgtactgcggagaaattcaatacctgagtttattgacctgctgtccttcctgacttcttgtagatggcagcctctactactgcacagttgttgatcccatttttattcttctaccaattttgaaagctgcacgtatgtcggtatgccaaatcaaatcagaaatatttctaatatgaggttcacattcaacatatttgcctgttgaaaatttgaaaagctagtccctcaacagctttactgtgctgcagaatggtaaagatccaggaaaatttaggcaactggatgaaatattgtatgttgaaggatatcctggatatcaacacctcatgggtatagcaggaaaccatattgatctggtctgtgaagttaaaggtagatgtttgacttgtatgtttgttctgaagttaaatgttatatgtagttaaatattatagcaaactgctgtcagaatgctgcctacttgtatttgtagtccggtgattgtgcggtgcatttttaccgcttcattaccttgctgaactgaaacacttattggatatggatgtttatgtttcatccgtgctttcctgtgtgttttcatggaagagaagttttacttaaccatctcgcatggatgttttctttcctgcagaagttgctaatgtgaagttctttaggctggacgattccaaggtcttatcttggttgtgctgtaaggttagcttgtgtcagtaattacatctactaactcgatttgcactatgctattccgctgatacttattcttatcagaagctaacccaccttttatctttacttgtccttttcatattacaaaagcaaggatctaacatgaagttagggtggaatgttgcttatgtgggttaggaaaagaggcatcttattgtttttagactgtttgccttgaataaggatgcaacaatccaacaaactgagcacaacattgagaatgttgatgggctaaaacttaattcttccacaccatgttttaatttatatttgtatataaactatgtgcaccaaacattagtctttaagttcactttggttttgaagatgataaataaagcatgaattgggaccctagtgaatttcctatatatttaagaacatgaatgcacatggtcattcttgtaaacgtccctaaataggtgtcagagggtagtggctgctattccttgactgctgtttgtagcattctgcctaccttatgttacaaccttctacaaccattataatgtacggtgtgttccagtactgtttatttgttgcatatttcctgccattttccagttgaacaattttacttcataaatttcatttaactatgttcttgcaaaaatatagctagcatgtgttgtgcccactataacaccactgctatctgctgtaccaacactttgccacatgctacatgcaactcaaaacatcatacaatatttttgcatgattaacctagtaatggctattgttatctgcaagaaacaaatgccactttgggatatcacttagattttttaaaaaattatgctgccttgcaaattcaaaataacagtttgtcttggtagcatcatgagaacataccagttcatgtgccctcataatttatgttttgatacgtcctttagctgtacttaatattcatgcctgtgaatttcgaatcatattgatctcacttcacttgttactctgtagtttcgaaaatactcttatgaatctcatatacaggttcacaatctaaaagaggttttccccaagctaggcaaaaattatgctgcccaaggagaaaaagaattatgtatgttgctgcaactctttttgttaagtctaatacaactgtattagtctattataagaaggatatagctccttgtaaacttatgtttctgtttatttttatgagtgttttatcaaccgatatccaaatgtacataaacattttaccattgctaactttcacaattatatggtaataaaaactgtttgaaaatggatcgtcagtgtgatttacatcctattggatcacttttgtcccaaccttaattagtgaatccactttgcattacaaaattgtctgagtaaacttaaaggagattttgcttgtggaggtggatctcctctaaagaaaaggatatatcaaattatttttaaacattttaactaaagttatgtaacttcaattcaagatattgcacagggattaaattcctgagttacttttgaagcacaactcaagaattttatgaaaatgtaaatcattgttctaatggagcggtttccattgttttggttacagtgaaggatgccgtccaaataattcgcgaatacctgaacgacgaaccatggttaacgttactctgcaagaagttgcagtaagacttctccttgcattatgttgaagattttagttcagtacagacttttaattgactatgcattttttttctgagcgaaatccgatagactatgctcacattggtacaatgcattctccacaggttggatatcaaggagatcattgaagcgaacaaaactagcgaagcttccttctgtgcagagaattctcctgtacctttccaccctgctgaggtaaactccttgaagatgatcagggtgttctacaccggatagctcatgtgctataagcttattaatcgtgttaacgcaggagaagcttggaagtagtagcactaggtcaagcaaagggaggccagcaaagaaacaaaaggctgaggtagaatcgaagaacatcaaagacatgttccggagggtcacaaggaaaggaacgtgatcccatattatttatagtatgacttggttctgatttcgccatcgagacctcgcaaggcgcttcatattattgagggaaagctgaggttttcagattaaagcattgtttatgcttcagaagcattcgtgcagctaatggaattaactgtttaacaaatttactccaagtctcaactttgttaggtttgaaatgtagcattgcaggcgtgtatttaagtatttgagcaaagagtcttgtactatcctactgatttgtatcgtaccaaccaatttccttgaacatcttggccttgggtcactagagtaatctgaaatggttgttaatgttatttgtgagcttcaacacttcctatttgagaacatttctaagttgttccggaggcccggtgtctgttattatctccaaatagtctgtgttactacagatagtctacatgtatgtacgtgcggataggtgctactccaaatagtctatactctaggtattttagacaggtaattctgtacccggtatttagaaagtactcgtatgacgtatcacgctagatggcgaaaggcaagtcactacgtctgaaaacaaaaaggtaaaatgacctagcttttttgtcaatcaactgattatgtgctaaatagagtataatcactttggatgcttagattgctctacattagtttgcccgttgcaccctccagaggaataattaacttatttgccactattatgagtggtgataaaagattaccattgaactcacgtgtcatagatacatgagaactcacatgtcatagacaatgagtgataaatctcggaaatacttctctccggacggccgattctatgcgagaaatcggatgccctttatatccttatgtctctcccacgcgctcttgtgctgccacgtgtccccaccacatatttcgttgcaacaaatcactaacatattttggaaaccctctgttaagggaatccgttttattttttgttccactaaaaatgtttcacctagtgtactcacaatgtttcactatgtatggatctcatgttgtagtgaattgaaacattcttttgcaacaaatcacccacatattatggaaactctctattaagggaatttgttttattttttttctacaaaaaatgtttcacctagtatacttataatgtttcactttgtatggatcaaatgttgcagtgacttgaaacattctttcgctatttgctgaaacattgtttttatataaggtgaaataacgccctatttaaatgaatgaaacatttttatctacccagtgaaacaattctgatatacttggtggaacagcgtgcaacatttaaaaataattcaataataaactatttttttcattggaatatatccatgtgtggtcttgttttaaaaatttaattgtaacgaatttaatagtgcaatcgaattatgatttggacaaataatttaagataaaaaatagtttaaaatagttttgcatacatacatacttgatgacatcatactgacatgggcgtccgattcctagtcgtctctaataaattcttaattgccacctcttaaaagtggaaaaaaaaaagaaaagaaagttaaatgtcccaccaaaggctccgcgcgccgcggccgcacccttccgacgcgggctgaggcgagcggactccagtggaggcagagacgtgggctgctgctccggcccatgggcttccacctcgagcctgggccgtcgctgacgtcatcaactcccccccgtctccccacacacgcactcccctgtcccctccccccgctgctgctaggcccgatccactgctctccccaccggtggtgagtcaccacgctgcgtggcaaaccctagttaaccggcgcggcgtccggcgaccgtacactcggcggaggccgcagagcggcagcggcaggcggcggtgccgccgagggcagtcggctcggctcccgcggcaaagcgggaacgggagagagagcagggcggcacacgcgcgcgctgaggctgcgcgcggtgggcgcggcgtccggcgatgcccgggcaagagctataggaaggcgaagtcgtgggctacagccccagtccccagtgctaaggcagtaagctgctgctcactcctaaccatctccccctttttcccttgcttgatttgttgggggtactgacccttactagtagttttagaaatgagaagattgctgaaacgattgcggttctcaaccttgctcgcgtagtctcatgctgcttgagggcttgcccaggctccaaaatttcctggctccgcactttttagagggatgaatccgatgaaacccaacctggcattgtctcgtcgattctctagtggtaaataggagtttaccataatgaccgagcttgtttgatgattataacttagtgatatataggagtttcccataatacctagttgatttgctgattacaaattaattttatggattggctgaacatgggaatgaaaattggtggcaaattcttgcaaattccttactttctgatccgctccatggttcgtgcttcagtgacccttcccctccatctcggacaagctcatggaccaggcagcggcgaggatgataagttaggatttggggttggggcgggggcagtttcctgggtttggagggaggtctgggcagtactggcacaaccagagtcactgagtcaggagagggcagtgggagggctcagcagcagggacgaaggggaacgagaagttccgaggtggatgacagcactagccgccgggtatggggaaggaggtggcgtaggggcagcggatgcaaggaagatggatcggtgcagtgggatatggaggaaggcaaagtggaggggagggggtggggtgcatcgtctgtagaggtggcagcagttggggatggatttgctgtcggcgacctgacgcctctaaggtagagggtatgcagtggtggagattggttagcaggggtggcgttgagtgatggctgggggatggtgtttacattattggaggagaagatatgggcctttggatctcaatcaaacagtcaaaaagcgtaccatttagtgtaaaaaaaaaacttaccaattatatatagtcagccccataattttaggcacatatattggtcatatattcaagatgctgataccaattatttgcatttccccatgtcatatttagtaattacaagttacgtttatggtctatcaataacagttgtatcagcaaaattacatgtttatgatctgttgtcaattttgtttcgtgtactgtattccaagatgcttacactctcgagggtgttcaatttctgtctcgatataggtttctgattacccaagtgtagatgtgatggacacccatcacagcgatcaatatgcaaagagcagcctgcagctgcaattcagggacacctctgtttcctttgaaaacaacaattctgttttggataagcatgatattacaagccctcaagttggcatgacttttgagacagccgatttggcatatcggttctacttagaatatggctaccgtgcagggttcggggtctcaaagaggacttcccatagtgttgatggggtgaaataccgtgcaacatttgtttgttacaaaggcggcattgctaggatcaagcctggtctcaaagctcgaaggaggcttgttgcaaagactggttgcaaagcaatgatggtagtcaagtataacacaactgaaaaccagtgggaggtagtttttgttgagctggagcataaccatccatgtaatcctgaaatggttagattcatgatgtgctttaaagatctccctgactggcagagggagcaccgcccattcaatgccaagactagattgaatccaaagattcactctggcagaggcaggccacccaaccaaaacaaagacttcatggtgaaaaaaaccttctcacaatcaaattattccattgaagcagcaggcaaggctggaaagctgagatttgcagagggtgatgttgaggcactcttggtcttctttgataagatgcaagctcaaaattcaaactttttctacaactgggacatggatgatgaaggtcggctcaagaatgtttgctgggtcgatgctagatcgagagctgcataccagcacttctgtgatgttgtttgctttgatactgtttatttgacataccaatttgtcattccattggttgcttttcttggaatcaaccatcatgggcaatttgtgttgttgggatgcggtttacttggggacgaatctccagagactttttcttggttattcaagaaatggctaaaatgtatgaatgataaatcacctgaagcaattattaccacccactcaagaccagtggtcaaagctgttgctgaggtatttccaaatactcgtcacagatacaatctttggcatatcatgaaagagcttcctgaaatgtctggaagagttgaggataaggaggcaattagcctaagaatgaaaaaggtagtcttcgacactattacatcaactgattttgagagggaatgggttgagatggtcaatcagtataaccttcatgataatcattggcttacaaccttatttgaagagagggcaaaatgggtaccagcatatgtcaaggatactttctgggctggtatatccactgttcgccgcagtgagcggttggaggccttttttgatggatacattacaccagagaccacaattaagacatttattgaacaatttgatactgctatgaagcttaggtctgaccgagaagcgtatgatgattttcgctcatttcagcaaaggcctcaagtcttgtctggtctactctttgaggagcaatttgcaaatgtttatacaataaatatgtttcagaagttccaagatcacttgaagcagctgatgaacgtgacttgcactgaagtcagtaggaatggatcaatagtgacttacactgtgaccgtcattggtaaggagaggaagtatgactacaaagtgatgtataacagtgctgagaaagaggtgtggtgtatctgcaggtccttccagtttaaaggtattttgtgtagccatgctcttgctgtcttgagacaggaacttgtgatgctgataccttataaatatattctcgatcgctggaggaaggactacaaatgccccgaggaatccaaggaaactcccatctcaccaaaagcgatcaaagctacagggaagggcacaaaaccggaaaatgcccgtgaagataaagtggacaatctgtacaagcatggtcaccagtactttgctgacattgtggaaatgggagcaacggaccctgatgcaatggagtatgttttgtcggtcatgaaagaagccaaagagaaggtacggaagttcgaggaatctcgaaaagatagaaggcctggagacagtccagtttctactggtaagagaaatggcaagtcttcaagaccatccaatgaggatgggggcaatggcatatcagattcaacacctgcgactacaacagtggcgacagtcgcggtggccacatctacaacaatgcaggcaacgcctacaatggtggctatagcgcctacttcggcaactgtgcccgccggaatgtttttggtaccaatgcacccacatccgatggttttcccacctttcacccctgcagtaccaccagtggtagcacctgcagtgccacctccagcaccagcagccaatgtgggtgatgtggcttccaactccacaaggaagagaaagaaaagaaaggggaacaaatgatgttcctaatactgattatgtaagcgcttcactttgccgcttctccttttgtgctgtactttgctttgtggtgttgatttattcagataatctcatcgtgcccttaccccgtattttttgttccaggcctaactcaaatttagtcctacaagctgcaccaggccctcctgtccatgtgtaataatggtttatcatcgtctcctgctgcaggatgatctgcccctctgaatgctttctgtgaattatcccccttgacttggaactgtccgtgcagctttggactgtctactgtaaattgatatggaaagtaatgtattatgtatgtagtgcagcttaggaatgttagtctctgtttctgctcatgtggattgcgacctggagcagcgcagtaccaagactaccagtagcgtagcagtaccccttgctggttggtagagtaccattttctttcctttctggagtttgtcactttatgtaatgatgtaatcacactgaactttattgccaaccactaatgcttagtttcatcttatgccgttggctgttgcactgagccctgagcattattttcatcgtatgcaagctcaccatttcttgtcatactgaaaatcgatcgtgcatatggtatgagaatggtttttcagttttctgaaaattgatcgttcacatgttatgagaatggtttttcagcaagcatatgtagaattgtagattaccgatacaaggagttgacccaggaaggcaggaatagtatttcagcatccgtggtgcgtaggatacttcacttcaccctaaggagttggcccaggtgactcaattatcaagccatgttttgacttgcccgattatactcgtaacagccacagatacgacacttgacgcggctccaagaactcctgtgtatattattctcctgcatcaatcctccagatgaagaaaccaacagtcacatactccatccgttttaaaatattgcaatttagtaccgtatttgacataacctaacctattaatctagacatctctattacaatcttgatcagagtcgtagtagattatatcaaataagataccacattgctatattatagaaaagatgatgtgcttattgtctttaatccttgttagactgtctacgcagacgtagatttccttttaaatacgagggtagttttttaaacaataaactacctttcatagagttctcataaaattctaagccaaaatataaatattgaaccttaattttagattaatctaaagcttcttttaatcattttctttttcaagccttcaccttgaaaccgctagagtaaaaatataaaagtttcattctaaatttattgttacctttatttgaattattttattttctatggcatatcagtcacgaaataatatttctaacctctgatgcattatttacgtagaaaaactgcaaatgtaccatactcactccgtctaaaatataagagattttggatggatgaaacacaacataatattacaaatttggacagagagcatgtccaaattcgtagtattaggatgtgtgtcccatccacccaaaatcttttatatttttagggtggagggagtataatccatgtctcgatgacttcatatgctacccctggacaggatgtaccctcatttttttttgcatgtcactcaaataattatgaaaaactttgagaagatgtattaatatgtgatatatccacaaacattttcaaattcaacttctacatttcgcaacgaaaaaaaaacaaatttgactatgaatatatgttaattagctgtagtttaatttgtttttttcgagatgtaaaagtttaatctgaacttgcatgtatatggagtgatatacattcatattcgtatctttttcataattatttgagtaatatacaaccaacaagagagaacatcctctcgagggattaaaatagtttccatcctaccagcttgttaacgggccaaacgtcaccattatgagtcatgacatgggggaggaagaagggcctattcacttagatgctaaaaaaacattaccaaattttggcattgccgaaattttggcaactgtgtttgccaaaatttttgcaggatttcttatataactaccaaaacttggcagcaaactaaatataaccactttttagcaattttattaaaatttgataaggttaaaaattgacattgcagtgatcaggcccgaaaactttcgacgacgaagccgcacaacctgcctcgccctcgcgccctgccatgccatgccatgccatgaacgagcgggaagctctagaagggccggaattcaaagccgcgactcctcccctaaacctggccaaatgggccgtgccaagccgggccggcccgagcacggcagtactgtagccggcccaggcccggcacggcacgccagcctgtgggccgtgccggcacggcccgttatcccgtgccgtgtttgggccgatgcctcagcccgtgggctggcacggcacggcacgtttactgtagcgtaccggcacggcacggcccaggcatggcacggcccaccggcccatttatttttcctacgattttctaatttttcccatatatttctcatattttttatttttttccacattttatcctatttgtaccatatattttatgatatatttcctaaattttcctcacatttatcctatatttatcattttttcctttatattatgttttttctgcctttttctttttttcccctcaaatttcaatttttatgggccacatgtactagtgggccggctaccagcccacgtgccactacagtagccgtgccggcccggtacggcccagcaccttcttgggctgtgcttgggccgtggccttggcacgtgggccggcacggcacggcccgctataggagccgtgcctaacggcccgtgtcctagtgggccgtgccgtcggcgtgccgtgtcgtgctgggccgggccgcccgtttggcctgctatatcctccccccacccccacccctacccgcacccgtaactcccccgccgcgtcgtcggctctcactgacaccctctggcccacgcgatttccctcgcccgccgcgcccctatccgccacgtgccgcgtgtcgcgcctcccccctcccgccgcgtgccccctccccccgcccacgtcatcacgcccacacagagttaaaactccaccaccaccctcgccaccaacctttcccactgccccactgcaccgcgctcgctcgcttgatatcgatcgatctcaccatgcggctctacctgtacgtgatcgaggcgcggggcctcccggagcacggcggcgatgggggcggagggccgtactacgcgagggcgaaggtggggaagcagagggcgcggacgcgggaggtggaggcgcgcggcggcggggcgtcgggggcggcggcggagtggaacgaggagctggtgctcgaggtggacgggggcgaggcggtggaggtcggggtggcgcggcggcgggagggcggcgggcgcggcgggagggaggtggtgggcagggtgaagctgccggtgcccgccgccgccgtccccgcggggaggaggagaaggacgaccgtgccgccgacgtggttcacgctgcagcccaagcaccaccgccgctggaagaagggcgcggcggaggcggcggattgcggtgcgtacacgcattctctagctttgattatcgaagtaaattacgtgtgattccgtccgtactttgggttaatccgctcccttctcgaatcggtcggcgcgcggcgcggcggccgactttttggtgaagctaccagtatctttgttagctttgccaaatgcagcacgcaagctcgtagtaagagggattagcatgctgttatacggaatgaaaacttagggtgcgttcgtttcatggacaatgagtggagatagcacatcgttttccgcgcgcacgcttcccaaactactaaacggtgtgttttttgcaaaaattttctataggaaaattgctttaaaaaaccatattaatccatttttgcaatttaaaatagttaatactcaattaatcacatactaatggctcatctcgttttgcgtatcttcccaatcttctcgatcccctatccctcaaactcaccctagtagctttcgaagtcattcgtaattgttttttttcattccagcgtagttcgacgacgtctctttcacggctgttcttttactgagactcgtgctgaccagcaacgacatgctcttttaatttgcactgtttgcacaattaatcatgtagccagcttaggccttgtttggttacacaagaattcaatccgggtcaggaataataagtatagtaagaaatttatgatagatataacgagagaccgggatttattctgagtcgggaaccaatttaatcatgatagagacaataagagaccgggaatcaatccactagtcaagaggtgtggaactaatccggatattttgttgtacctaatatgagtaaattggtttccgaccgggaataaatcacggtctcttgttgtacctattataaatttcttgttatacctaccgttcccggcctggaacgaatgcttgtgtaactgaacaagggcttaaggtcttcgcagcatctgtcctaaactagggtggtgtttggattcagggactaaattttagtgtcattagtctacgtttaatacttctaattagtgtccaaacatccaatatgacagggattaaaatttagtccttggatccaaacagagcctagatttggatacatactagtgatctatgatcagcaagggacttgagcaggctactgcgcacataattctcgagagttatttgaacaaatagtcttaatacgatgcaggaaaccaggatcaaattcagtgtttgccagacaattaaccattgtgtctcagtttatagtagtgcagtgtgaggtgtgatccactgattccctttcagctgggaacggcctagtttcggttgtatacacacacatccccgtttggtgtacacattaactcctctgcttttttaatatatgacactgatgactatttgtcttaataaaaaaattatgcaaaaaaaatgtgcttaaagtatgataaaacaagtcgcaataaaataaatgttaattacgtatttttttaataagatgaattggcaaacgtatgtccaaaagttaatgacatcatatattgaaaacggagagggtgttcttctccttcaggtgaatgttctgctgatatgttgttttttgtatggttgtgaaccagggaaaattcttctcaccttttcactgcatggagaaaacagcgacaatactgttatccactcatcaccttgttcgagctctaggagcgacactgacattgaatttgagagatcaacttattgggaacattcaagttccaacagtgggacggttgattctcccaggagttttgcaatagaacgatcttctttagaaaattctgaccgttcagcccaagcaaattccaattccaactctgaagatgatgatctaacagagcctagtgcagcaacagcaaagggcacaagtgacatcgaaccaatggttccagatgcaagctttgaagaagctatggaaatcatgaagtctaaaagcatccctgacatgccagaagatcttaatggtggtgtcatgttcgatcacacttaccttgtggactcgaagaatttgaactctcttatctttgggcctgattctcagttctccaaagagttgcgcgagttgcaaggaactatggactatgaggaacagccatggacatggaacaataataatcctcctagcttaaccaggacatgtcaatacaccaaaggtgcaacaaaatttatgaaagccgtcaaaactattgaagagcaaacatatcttaaagcagatggcaagagttatgtaattatgactcgtgttcgtactcccgaggttccatttggaaattgttttgaggttgttatgctgtacaaaataattcactaccctgagttgtcgtcaagtgaaggaatgtcacatctgactgtatcatacaatgtagagttccttcagagtaccatgatgaaaagtatgattgagggaagtgttcgggatggactgaaagaaaattttgaaagttacgcagaaattttgtctcggcatgtaaaaattgctgattctgctgggatggataaagagcgattattggcaccgctccagactgatcatcagtcagatatcagacttgcttacaagtatttttgcaatttcacagtcatctctacagtgataatggcactgtatgttcttgtacacatctttctgtcaagaccaggccctcttatgggtcttgagttcaaaggtcttgatttacctgacacgtttggagagctgatcatatctggcatactagttcttcagctagaacgtttactgagtatgatatctcgttttgtagaggtaagggtacagcgaggtatgtttgttttctttgttgtgcatttactgtatttctcgtgcactagacatgcaaattaacataaagtcataactatgctaactatgtatcttcttttgtcacaggaagtgatcacgggattaaagcaaatggagatggttggttgttaactgtagctctgctagaggccacaagcttgccgcctgtctctagcggttccgtagatccttatgttgtgttcagctgtaacggcataacacgaacaagctctgtgcaacttcagactcatgaccctcaatggaacggttagtagatttcacacgttaactcactaatctcctatcttaatttaattcatcatctattacaaactgacagaacatttcagagataatggagtttgatgccatggaagaaccacctgctacgttggatgttgaggttttcaattttgatggaccatttgatctggcagtttctctgggacatgctgaaattaacttccttaaacacacgtcagcagaactagcagatatatgggtgccactggaaggtaaattagctcagacttgtcagagtaggttacatttgagaatatttctggagaacacaaaaggacctgagacatcaatgagagagtacttaagtaagatggagaaggaagttggtaagaaggtaacttccgactaacttgttcctgggtactgactcttaactaataattaaacctcttgatgatgcagtatttgtatttatattgcagttacatgttcagtcacctcacagaaatgcaacgttccagaagctttttggtttaccacacgaagaattccttatagcagtttatgcgtgctccttgaaacggaagttgccgttgcaggtatgattgttcccttctctgtgttgaggattcagtttgagcacattgcggttgacatgatatgaaatcaatcctagaattttactttgaaaacattgttttacttaataatccaatatcaccttatactactcttatgtcttcttttggaccattacaatatgaaaacatcaggtcattcacatattatatctgtggatattaatattagtagtaacttgcagttgcttctgatgcagggaagactgtttctgtcagccagaatagttggtttctatgccaatctgtttggacataaaacgaaattcttctttctgtgggaagatgtcgaggaaatcgaagagttaactccatctttcacaacagtaggtactccatctttgttgtttgtcttgaagagcggccggggactcgatgccaagaatggtgcaaagtcccaagataaggaaggcaggttgaagtttcagttccattcgtttgcttcatttagcaaggctagcaggttgttttatctcttcctagctttattaccagtattttttttttgataaaggaagcttttattaatctcagacgattacatcaagttgatagaaccatactaagaaaaataagataaggagaatctatttgacgagaaaactatctgttcttcattgttaggacaataattggactatggaaaaccaaatcatcagctattgaacagagggctaaactagaagaagatcaagaagatgaaaactatgtcgatcttaatgatgttcaatctgtattgagcattggagatgtgccactgtcaaaggagtatactttggaactgcctatcgatgtgagttttctgcttcattagttcttctgctgatagaattgcgtttgtttctccccctttttagtggaagaggctagataagttatacagtacttgtgtaaacatggatgtgaattttcatccctcgagggtatgtcctttcattgcttgcatgtcatataaatagttataaaaaattgaaaaaaaaaaaacaagatagattaactagtggcgttcttgcatttaacgatcacttgtcagtgtacttcactcctgggattcgtttttctgtacagctgcactgcttgaatattttcgtttatactcgaatttctccaactttggttgaattacattcaaatcagttcaaaattcaaacacatgtcggtgggattttgtccgacctcccaaaatcttgtacttccacagataagatcctaacccatgcttgtcaaccaacacgctgttgtgccaccaccatctgcagtctgcagaaacccccgttttccatcgtccctttgtactttgtagtactacatggttgtcacttgtcagcacgctgttgtgcgccaccgttccttcgatcgctttctgtactgtactcacaattgtgtgtgcatcgcaggcggatctgctgatgggggtgttcgacgggggccccctggaggcgaaggcgatgagcagggcgggttgcctcgactacgccgccaccccgtggcaggacgcccggcccggcgtcctggagcggcacgccagctacaagttcaaccgctacatgtccatcttcggcggcgaggtcgtcagcacccagctcaggctcccctccgacgacggcgacggctggaccgtctacgacgtcatcacgctgcgcaacgtccccttcggcgacttcttccgggtacgcacccaacaaatcacaaccacaaccacacctatgaactctcacgtacttactacgagtcctcacgttggatgctagtgcttgctgtagctaagatgtcgtcatgccactgttttttcctctcctttttattttggtgtggtttgaggagagtggttagctaggcaagtggccgtgagtgaaagggtggttatgctgatagtggttaatattaagatatttgcatctatccagtaaaaagtacctcgagatacaaatcgtttatggttagatctaataatcggaaacgatttattaccgtactagtatctagatttactttttattggaccggagaaaatctctaatattaatgtattgtgtgcgcgattaatttgattataatgcagttgcatttgaggcacaacatatggagcgtggaggccgcgtcgtcggaggcggcggcgagcagcgggagccggtgcgagatactggtggggatcgagtgggtgaagaggagcaagttccagaagaggatcgcgaggaacatctgcgagaagctggcgcacagggcgaaggaggtgctcgaggcggccgccagggagatcgccccggccttgtcgggctagcgagaagctggaggagacggctgttttttctttttcttccagcaaggccgcaacggagaagatctctgcagaggagcagagtgcacgactgaactgtgtcggcttttgccttggctgtagcgtagtagtatctccaaaacagaacgaaacaaataggaatacggagatgtataccaactacagtatatacgatatcttcaagaagtacacatgatcccaaaaaagtgtacaagtgtcgagcccgaaccgagctgtgcgtgcgcgcgcgtgaccagccggccgaattccggtggtttttcctcgtgtcgagccggcacgatgtggtgggaggtggccaactgttggtagatcgggcgatgccgtattgaacatgggcgtgacttctcgttggatagacaagatcatcatctgcggaacgtgggtgcatgcgacttcctggtgctgttgatctggccaccgcagtaccgcaccgctcatggggagagtcatggtggtggcgctcggtttgtatggatttccaagtgtacattcctgaggtgtgcatccctcggtttcatcttaggtgtacaggcttgaatgctaatcgagttactcatcataaaaatgtctaattctatataaaatgttatatttataggtttttatcattgttaatcacataaccagtttctcggcaaaatctatatgattaaggcacgcttgaatagaagttttatctgagataagaaaacgagccttataacactttctcgatcactttaaaagaataaataaatgtatcggatctctaacaccgtgaagaccgtatggatcagtctgcaattgcaaatgaattacaactagaagtgaacttgctaacgaaacgagaaaattggcttacgacattataaagcttcaaactgtactacaagtctacaacaacattgaattgtgctaaaaaatcggatgatataaatttgaactctgatttttttttcttttggtacgaacagagaccaatttcccctcgagctcagcctcagagccggcgctaggcaaaggggagggcacccaactactacagtacccaagtcgtcgccgccgccgcctccccccaaaatcgcccaaaataccaccgagccagacgccactacgccataaaagcagccttcactctcgtctcctcctccggcgccgatcccctcccgaattccgccatggatccggcgccgcaggcccaccccatcctctcctacgtgctctcccgcctccccaccctcgccaaggcccgcccggccggcggcggcggcgacttcgacatcgagcagccgcccgtgcacacgccgtcgccgcggacgccctccaccgcgggggagttcgagctcgtggagcgtatgccggggctgcgccacccgtccgtgctccgcgccatgacccgcgccgtcgccgacgtgtcggccgcgcgctccgcgctccaggtcctcggcccgcggcccgaccacgagctcgtcgactcctcccgcgcgatcgtcgccgcgaccgacgccgaggccgggggctcgcggcgggtccccgagggggacctcgaggcctgccgcgccgtggtgcggctcgaggagacgcacgacgcctacgaggcgctgctgcaggaggccgaggggaggctcgaggcggtgtaccggtcggcgatggaggggaaggacctggaggagcccgacgggagggacgaatcggcggcggcagccgccggggatgatgctgcggtgcaggaggaggtgatcgcggtgctgaggcaggccgaggagggcaagccggtggagagcgtccgcctcgtggaccggcagctgcgccacctgccggaggcgttcgggaggatccaggggctccgcgtgctcgatgtctcgcgcaatcagctcgaggtgagaaatctgttatctccgcatgctttagatctgcttgtttagaaccctgtaacccaaacaatgcttgtactgggttttgtacgcatttagacatctgaacggatgggatttttctcttctgtactgtgaaattgtgaattgatggattgaatcttatgttgaagatgatcagaaatatagggccatatgcaaaatgtgtacgtgagcgataaaatgcctgttttgtggtgttgcacacattctaccatttgaactgtatgctgaaaatagtttgggcactgaattttcggtaggattgtgttttttgtgtgtgtgtgttatggtatggtcagttcctattatttttagagtcctcaagactgcgcatgtactattttctttatagatttactagtacaacttatttattggtgatgaaacagttactatcttaggccttaggatgtaaatagtgaaacactgtatgttagtatttctttttgctgtttttatttgattactaaattaggctatgggtggatgagtgctgaaagttatggatatagtgacccactagtcttgttttagagtactgagagttagctgttgaccatctacagtctgaaactcagaataactggatactagtatgtagtaagtattgacagaacaaatgtagaactggtaggagcttggcgtgtatgtaaattcctgattagattgtggattcactttctaatatcatcctgtatttaatggttggcttggatcattggaaaatcataggtaagagtagggaaggctggctttgttttgaattttggccacttcctctatatccgtgtttacattgatgtttagaaatttcttagtttatttttgggatattaggttgtgctcatttgagtttaaaaatagacaaacaattaagcacatactaactataattattttctttgataaacctttatactcagttatttaaagatagacataaacagttaagcgcgtactaaatataattattttctttcataacccttttatcctcagtggcttgcctggtcatatttccatagcgacatactgtacacattttgttaagtatgttgttgttgtgtcccttgcttcattggtgaatcaatgtgattgtaggttattccagatgctataggaggacttgatcatcttgaagagcttcgtcttgcttccaatgccttgatttctcttcctgattccattggactgctattgaatttgaggattctgaatgtgggaagcaacaggctaaggtcattgccagatagcatctcaaagtgcaggtagataactttctttagcttaactcttgggttcagcaaatgttactgttcaagtgactgattggtgcaactccaggtcattaattgagcttgatgcgagctacaacgggctcgcttatctgccaaccaacattgggtatgagctggtaaatctgcggaaactctgggtccatatgaacaagttgcggtcacttccatcatctatctgcgagatgagatcattgtacctcctggatgcacatttcaatgaactatgtggtctgccatctgccatagggaaactttcaagtcttgaaattctgaacctgagcagcaactttagtgacctgaaggatctccctgcttctttcggtgacctgctgaatctgcgcgagcttgacctcagcaacaaccagatccatgctcttcccgacaattttggtcggctggataagctagagaagctcaacctggagcaaaatcccctttctatgccgccaatggagatcgtgaacaaaggcgtggacgcggtgaaagaatacatgttgcagaggtggcttgacatcttgctcgaggaagaacggaagagcatcgcagcagcggagagccctcaagcaccgaccactccttcggcctggctggcacgcagcgtctcctgggtctccgacgtttccggaagccttgtggggtacctcagtggcgagaacaagacggagaaagatgcctacctggatcagcagtactgaaagcgctcacctgtgtggtgtttgtgcaccgtgtacatactataagcgttccatgcttaccatctcatctgggaaaatcgttttgtgttcctggtgagtcgagccatacactcgtgctaggcttgcatcccccaaagcaggctttggggtttattttgcccgttttaacttccggacgtccttttcatagcttcacttgttacagtattatattactttgtcgaataataatgtggagacaaatatgaccggagagtgcgctcaagaatatcaatgctttagagctttaggcctcaatgtttcgacctgtgcgttgtgctggaatggaagcggcggccgtgttagtacaggttgccgtcgccggcaattgtgattcacgttttgctcatccgtttcttggcaattgcgattcatattttgctcatcgtttctcgatctcctttctgtgtatcacgtgttttcaaaattttgcaaatactgtgttacacgtcgctatcgcgtacgagaattctcccaaaacccaatcactttcaacatactccccaccaacaaaaggggagaaaccgaaccagcagcaacgtccacgataatagcgcaaagaaccagacgagcaacacaagtttaatacatcatatagcataataaacaactagtaggtacggtacttatttcgattacacaccgatgattagaagtctttaaacaccactactggcactacaccagaccctctaaggttgctggcgagtaggggtagcacagcagcacgaacgccgcttttaactaggtaagctatttataaatatactacggtctatatcttggatactgcaaggtgctcaatagctgaacacgacgaggtcatcactggcccttctaggaggggcaaaaaagattcacggccacatgcttcctcgccgtccttggtgagcgccttgttcatctccgttctgatcagatgccctgatggggaaataagaagcaaaggttcagattaactcttacccgcaatgacaaaatatggtgcataggaatgagacatcctgaacttaccagttcgtgcagttcatcatggagtgcatcccattcgaggatgccacagagttcatcaatggactgctccaggttgtactcgttccgcctaattatttccttgttcaggtcgacttgcccgaagcccatctgccccagctctctcagcatgttgtcctccacggcactgatgtgatcagatgaaggctcggtaggcaggcaagaagcagcgcgagcagttgcagagggcattccaatggcagcagcaggtgcagtgggctcactgataggagcagcagcagctccgacaggtgcagcggtagtcgcactaacaggagcaggcgcaggtccagatgcaggaatgctaacaggttttggcaggggaacggcttgaggtgcaggtccaggcgtggcagcaggcttcgaagccttttcagctccagcagatgaagtgaggagatcagtagctggcactagcactgattcaaatgctctaggtacagaaggtacggcacttgaaacaagctcaggttccatcggtttggtggcttcatggtatagtgcatgtgcaagaggatcagttatggtgcttccagagtatttacccacaatatctgcagactgaatatttgcatcaacagaatgcttccattctgtgttgcttccttctgggggcatgttcaagtttatagcagcactctgcttgttgctactggttttgaccgggtgctccacctgcacatgaatttggaatccaaatgatcagataacaaaggaagtgccaaagccaatgaggacgaaaaagcaatctatggtggaacaaacctgaataaaaacccaaactcgctgaccaaacatctggccagtgggtgatgccaatctccagtacgacacgtacccaccaggctttgcaggtgtgacaaaatcaacaccaacatcgatctcttgatcaatagggaaaccatccaccgagatctgcacatgccgaatcagagttaacattttagtgcaatactgcctaacactcttgaccattcgttggtagttatactaaatacgaaaagggtagggtgtacccctaatttaactgagctgttgcgtgcaaatagatgtccaccaacccaggtaagacatgtcccatatggccacatggaagatccattgttatgtatgcgccaaatctttgtaaatggggttgatggtgccattactgttccatcagggacagtaacatccttaatgaagcggcaatcatgtagctgtcgaagatgtggaaagagcatctggttctgaaaaatggccagatgacagtcagttgacactgttctggaaatgttttacgagaactatatgatcatgaatttgaacaagttgctgctttcacctgattgaggtctctacatcgtctactcccaaaagatggtctgtctattctggtatattcattcacattgcccattcgagaaaaacaggtattgcataaatcataatcatctttactgcacgcaaaaaacaacaaatcatgttagaataatggctttttttccttccattccaattcaacttacgatgatgaactagaacaaccattgaactcaaaactcacatatttgacttgtagcgagaaccagcgataggagtgaccccacagccatcgcactgtatccatctatgcagtgtgtgctgcgccatgctctcgtgcttatcacttagatccctgtatgggcacctattacagctgctgccttcagaataaggtccataaagaccgactggtgagagattatctggcttggatgtgttacttttgcaggtgcatggagggaaatagtgaccaccctttaggcttctgtcagcttggagggactgaactgggtaatgggagagattctcaggcttagatgtgctacttttgcagatgcacggagggtaagagcaaccacccttgatactgcttttatcagctcggagagactgaagtgggtaacggggaaacagtggtggaggagggcatgtcgagttcaaatcaccaccaatctggccattaggcccaaaggactcagaagaaaggcctagttgtgtccagaaaagatcacttcttaacccttcaccgcaatctgaagcaggagcagaatgaacagtaggtgcaccatgaccaatgctagtaacttgtggcacagcagaggatgtaacagacttgcccttactttgggcattggtacttcccttgttatcaacttttacccagcctgaaagggtatccacataataaggatatcccgatacatgttcagcttgagctttgatgtcatcaagaagcacacccttaagaccaagtgatttagttgatccagagttatgcatatccagagggttcgaagctgaaacagccatgagctcagtgtcatttttaatattcaaacttcccaaagtttgtcccctaccactagaggagccagatgaaccatcagcagaaccactggaagactgcattttgctctttggtgccatcagtttagcaagccggtccagcaaatcagccaatgatggcgctgatgatgcagctttagaacgcaagtcatgtgatatttttgcaaggacagtgggaacttgttctggtacaaattttaaagcttcatcgatagctaatttcacctgagccaattgatcttccagagcagtggacattacagatatggaatccaatacctgctgttttgtctgatgtaccccatcactgctgctcttcaactcaacattaatcctaagagggttcagtctctgactaatggcagcatcacataaatcactatcatcatccagtatgacaacatccccatcctcatcagtataggtgagtacaaactcagtatctggattgaacttaaaagcactcgcaatctttgaccgaagagcagccagattaagatcaaagtgcggaccattcacaaaagcagtgaaccgcttaagagtgccaccgaattttacctgaaacatcaagcaaattaaaagagaaatagataagaataataatctagtaaaattgcacgaggtaaacttaaatagaacagtaagtggtttgctttgcaggcaagatgcttaagcaaatgataactcaattctgttcttatcttagcagctgatcaatgttgattcagttaacagtagcgtcaaaacacaattcacggaaccaaatctcagcacctgatgctacataagtaccaaaattacatggcattaatcagttaaggacgactgccaagttaagccgttgcatgttgagggaagtgggttgtcttctacactgaagagatttatacagccatatcatgcaaacctaaacagatttattcaaccatagcatgcaaaactggaacattcaacataccaacaaattacaaaggaacatacatcaaagtgatcaagatactctacaatcaaatccccatagcaagtactcttgtctagctaatcagaaaaacaaaaagccctgcaataatcttgatttcgaaggagtcctcacaataatcgccggcgttaaggactgatatttctacactattttacaatccctgcaataatcttgatttcgaaagagtcctcacaaaaatcgccgcgttaaggacccgatatttctacacagtttcacaatcgcaaacaatacagaaacgatctaatcctgggcgcccaaaaagatgcaaaatccatcctttcaagaacaacactaccacccggtcgcatcgctccacaacccagcacgggcaacagaacccactccccacctccctgcgacaaaacccccatgcgcgagcaaaccaagaacgcggcattcctagcacagaaacaccgcacccgcgaggagccgggaaaataaattaaaaaaagaaagaaaagaaaacctcaccttcacgacgagatccctctcgccctcgcgcgccgtcggcgcagcgtcccggcggcgagacatcccgaccaaacgaagccccgcgatggcgatggtggcgtgagacgaagacgacgaggcggaggggaggaggagaaggagacgggttgagtcaagacctcccttttaatccgtaagcaaattccgtttccttcgatgggaatggaagggattgggaggaggaaattcacgggctttcgcggggttttctgcgtaaattgtactgcgtcctcgacgctttttgggcccacctgtcagtgagaggcgggtgcctcggtggcgtgacaggatgaaaagggttggggcgttttgtaattctggaattagtttaagtgtgtgctcgtggttttgtactatagtgcttatctcattgtggggtccattggtcagtgggatcgtatggataggggatggaattataatattatacttgtgtaaataatccttgtaataacctaacggacgacctcacgagtcacgaccaaaatactcctccttgtgggctgtggcagcttgcttcacgttcaccgtcagcccgtcaccgatctttctatgacctgtgggccacagcgtgaatctttgtcttatccccgttttgcagcagcaagtcagcaaggacgagtgaatgaccattgaatgctgacgagaccctcgcagttgggaactttggggtgctgggttacctttacttgtggatgtaaaagtactacgcgtcgatgcctcgccttgacacggatgaactactgaccacgggaggcagcgagaggccgacagctcggcacccgccgcatctgcggcggccatccgacttcgccgaggcgagccgtcgcgctcgctgcgcccgtgccccggagatacgagaatttccttggctcggtcgcggtccagcagcacaagccgaaatccacgatgcgacggcgtggaaaacccgcatcagcaacacgccttttctcaggctctcgtcgtgctcgcccccgtctccgttccacggatgcccacgacaccccatccgcgcgcgtggcgcggcccactcgcgtagtcgcgtggatggcacttccaccggctctcgcctctcgcgcggccaccaccactcgcgacgcgggccgcacggtgccacagcccacgtacgttcccccgcacgcacgccacgcgagatcgagccgcgcggctcacgggccggacgcacccaccacgcgcgccaacgggcgagcagaggagaggagacgtgcgtcgtcgtgtgtgcctccgtgcgagacgatgtctgaatctgaacaccgatcctttgcaaaggttggggcaagttaacacgcccgcacgcttcggtcggagcagaaaagggcgagcacttggacactttgcacaggcatcagcttgggcgattaacggagaacaaaaaaagcttggacgattaacacactgcgtggtagcaaagcatgtccgtcgctgcgagcctttgctgcatgtatatatacacggatttttctttccagtgggactggaaaaaaggaaacagttcacagggcgtaaagtcctgtgattaaagcgaatacatgcccgtttcttttcgatatcttgagtgcacataataattgttttggttgttcttctagattagtatacacgtacaactgaacacgtagatgaagaaagcttgtgggcttgtgggctatggcatgatggtatatagtcttctccgggacctacaaaataacacaaatacacactcaactgagcataaaatgcaagaggtggaggtggttgcaacttgcatggaagcaaatgagtggacggtggcctgtggggaaccaaaagaacttcaccgcccaaagtagttcgtctaaggccgtgtttagttatttagacaaaaattttatatgtatacagatacacatttaaaatattaaacgtagaccaataataaaataaattacagacttcgcctgtaaaccgcgagacgaatctattaagtctaattaatccgtcatgatggcaaatgtttaatatagtaccgtattatcaaatcatggtataattaggcttaaaatatttatttcgcaatttacatgtaaactacatatgtgtgtgtccaaacatttaatgctctatgcatctggacaagcagctggacaagcagcatcaccgcacagagtcaatcgtcttagaattggacaagcatttttttacacgatggaaacggtttacatcctcagtaagtgacgaacgaaaaaaaaaaactagaacccaatgtatactaattacaaaattattcactgatatatttaattaatatggtataaattagacagaattgaataatctattcaggtcctgtgaccacacgaaggagtacgtagggacaccaatgtctcctacatatgctacaatgcacaaacacttcagtattttggtgtagaagtgaaagcatcttgaaggttactcatggctatcaagtctttaccttcctacacaatgaatctagagcaaaacatgcgatgaattaagataaactatctcgatttcattaagcagtcagctggtggacctgtgataaggagattaagatgctcgtatctagatccgtcctcagtgcagtacggctgaagttatgtcctcatagtatttgacatcaacatttcatctgcctagggaatatgagctctaatgctctcgagtttccttaagtggaatgccagcccaagttgttgcaacttgcaattgcaactgcacagcgcttgatccgagaaatacagaaggtccgagggcccctttgaatcgcagggtagaaaaaacggatgaataggaaaaacacaggattctgacatgaattgaagtgtaaaactgaggattgcaaacacacagtaaaaacacaggaatggtcgtttgattggagcgcaggaatcggatgagagagatagactcaaaggaaattttccaagaggttggagctcttgctaaatttcctccaaaatccacatgcaatgtgccattccataggaatttcataggatttggaaagcttcaatcctttgaatcaaagggccaaatagaaaaatttcctataggatttgaatcatatgaaattcctacataaatcatttgatttaaaggggccctgaatgtagctatgcagggcaatggtcttctgaatattgtattggctagaacttcaggtcaatacataggggaaagtttcaggcaaattttcattaccacggcccattattttgtgacaacatcagaagagaaaaggagtattctgtaggtcagtgcaaaatcgaagtactgataccatgcaaaaagaaaaaagaaaaagaaaggaaacaaaaacagagttctcgggactaattaagtagaagaacttttagattttgatgatgaatatactcccctttttttataagagaactgatgatgaatgtacctgaactggagtattcaaacttttcctccacatttttggaccacagttgatttccttattgttttgtttacaaagaagcactgcagcaaaggctccccaaatttattaaaccgcactcagtccactcaaccttggcccagctccgcaattagttggactggattgcacaactgtcaaatcaatgggctataatgaatttgttatgcacccacacacacaaaaatatgaaaagaatatcgccatttctgaacctgcacctgataaaaacatctttacatagttccagcttggtttatgtagtccatcacaagtccatttcacataaatattccggaaaaatctgtgttttctaaaagataatgagaatcccgccatttcagcctttcactcaacaggagctagaacctattattatttatcacattacatcgtatgtcgacaaaatccacaaaataacaagataaccaaacatttcaactcaaggaaagagataacataatccggaaaatctctcgttcacaagttgaatcgactaggactgaaaccccactcagtgacaggtaatatcttctaccgaatgctgcacaaaagagccaagtaaacggagtggattctaaactcgaaggagatgaaacaatattgttttaaaaaaaatctacaagataaatttatatgtgttaaatcactccataaacatgaaagctcaaatttaacttatgctcccttagattaagtttttttagaacggatgaaatacaagttaaaaaaaaatctaactgcgaaattcagcaaatttttactgaattttgctctcctcttctcacctctcacttgtcatccctaaaactctcctggtccccgcctcccgcaccacgccgtctccgatcaagattcttccctgatccccttgctgctgctgccatcaaatccttggacatttccagttgcaaatttagactcttcccccgcgattcccagcactcccaagtcccatccttcccgctgccccatcccatcccactatctccctaaccactgtgatttaaccaccgaggaggcggcaagaatcgtgtccagctccgcaccgttgttaggcgggagtggagtggactggttatcgtccacgcaagacgacgacgacgacgacgacggccggagctcgccggagcatcggtgtcagagatgagggtcatgaagctcggaaataggccggacaccttcttctcgtcaggccccgtcaggtagttttgtagttttgttcttgttcatcgactgttacttcgatcgtttggttgtcgtgtgaatcgttttttgtttgatcggtgttggtgttggttgcaggtcggtctccacggatttggccactgacatgcagattcttgtggatggttgcctgtttcgtctccacaaggtaagctgcaaagattttcttgtggtttgcgtcgatcaagaactgaattttttttctctgttttttttttggtctgttggatggaacagtttcctttgctttccaagtgcatgtggctgcaagcgctgtgcgtggagtccggcgacggcggcggcgccgtcgagctgccggctttcccgggcggcgcggaggcgttcgaggcgtgcgccaagttctgctacggcgtggccgtcacgatcgggccgcacaacgtcgtcgccgtccgctgcgccgccgcgcggctcggcatgtccgaggccgccgaccgcggcaacctcgccgcgaagctcgacgccttcctctcctcctgcctcctccgccgctggaaggacgcgctcgccgtgctccactccacgcgccgctacgccgcgctctgcgaggagctcggcgtcacgtcacgctgcgtcgacgccgtcgcggccctcgccgtcggcgatgcctccggcgccgttccggccggttcgtcttcgtcgtcgccgccgtggtgggcgcgtgacatctccgagctcggggttgacctctactggcgcgtcatggtggccgtcaaggcgaccggcaccgtgcacgcgaaggccattggcgacacgctcaaagcctacgcgcgtcggtggctgccgatcgccgccaagaaccaccacgcggcagagcgaaccgccggcggcggcggcggcggcgcggccaatgccgagcgggccaccaagaaccaccgcctcctcgtcgagaagatagtgagcttgctcccggcggagaggaacgccgtctcctgcggcttcttgctgaagcttctcaaggcggcgaacatcctaggcgcttctccggcgtcaaaggcagagctcacgaggagggtggcgtcgcagctggaagacgccaacgtgagcgacctcctgataccggcgccgccgccgtgcgcgggcggggtgctgtacgacgtggacgccgtggtgaccatactcgaggaattcgcgctgcggcaagcggcggcgtcggggagcccgaagggcagcccggcgcgcgcgggcaggcaccggcgatcgatgtcggccgagagcggtgagctcgagggggcgcgccgttcgacgtccatggcggcggtgtcgcacggcgcgatggtccgggtggggaggctggtggacgggttcttggcgatggtggccacaaaggacgcccgcacgccgctcgacaagatgatcgccgtcgccgaggccgtgccggacttcgcgcggccggagcacgacgatctataccgagccatcgacacatatctcagggtgtgcatgcgcgcgacacttgatcacgccgacattgcctcgccatgactaatcttagaattcttgatctctctctcaccgtgtgcctttgcttctgtgccacgtgtaggcgcacccggagatggacaagagctcgaggaagaagctgtgcagggtgctcaactgcaggaagctctcggagaaggcttccatgcacgcggcgcagaacgagctgctccccctccgcgtcgtcgtgcaggtgctcttcttcgagaacgcgcgcgccgccggactctcgtccgggcacggcaaccgcgtcgccgcgcgctttcccggcgacggcggcgacgtcagtgcgctgcttggcactggcaggccaagaacgacggaggagaacggcaaggacgggcagagccccgccgccgccgggagcgtggcggcggacggcgactggagcgtggaggggctgaggcgcgcggcgtcgagggtggcgacgctgaagatgaggctggaggaggaggacggcgaggacgccggcgacgaggcgttcgtgcataggacgcgcgcggggttggcacggagcgcgtcgtcgcgtgtcacggcggcggcggggaggtccaagcggatgctgagcaggctatggccgacgagcagaaccttcacctaaggggcatcaagacacttgagcaaagctgatccgtacataccgtgtacaaatatgcttgaatttgtaagtaaaatttgttccctcgagatttgattttgttccaactagttcttgaagtttggggaagttgtgtgcacagatatgactgcgtgtacactccctccatttttttaaaaaaaacattttgtaaggacgaatatgaacaagggtttatccaaattaatccctaaaaattaatttgttttggacagagcgtgtacatagttggtacagagacacatgaagctatccttcaactgttaaaaaagacttattgctcttttgttgcaacacactacacacccaactcacatccttattagctactgcagagacggaaagttatactttcatcttaaacgaaactcttaaagtttatactctcctaatgcaagatacagaacgcggctaacttaggtcctgattgactggctacagaggcagagttgcagagacaggagaggccaccagtgggaagcggattctctcccgtaactttccttgacatggtcactgacatatgggcctgcgagcgctggcgctcacatgctagtcaccacattcctctaactttacgttagagcatcccaatctcgacgagtgacttggcctgtcttgtgtacgtcaatacactaaagttagtgtatcttaagcaaattttgaaataagaaaaaactaattctattgaccccctcaaacatatatatgtattgagtttttatgactccgtcagtggctggccgcggctgaacagtcgcaacattttttctgtctttggtcttgatcgactcggatgattgcagctgcagcacagccgccacaaaattttgtctcaggtccaggtcacctggttctggttggcgggtgctgtaggcgctgcgcaggaagcacaagcgtgcagggcattagacaacgcctgtgtttgatggcaaaatttccgctatttttttaatggcaaaacatccttgccatctagggagaaaaagaaaattttcgtatcttaaagcaaaacgtagtgctaaaaccatggtttgatacggaaaacacgtagcgctagcgactgatatccaccaccaacaacatcttcttggccgcttgcacaaggtggtacgcgcgaccgacacgtgtgtcacaatctcaggctgacatatgaccatattttcaacatgcgcaacgttatcaatgatcataggccaaaggccagtcgtaatccgtcgctccaaggattggccatgttttagcacaggagcataggacaggagtgcacggtcggccagtcgctgcctcactccagtgcgagagggagatggacaagcacactgcacacagccgtggtcctcctcttgtcactttttagggtaagtttagttcacgctaaaattaaaagtttggttgaaattaaaatgatgtgatgaaaaagttaaaaatttatttgtatagaaaagttttgatgtgatggaaaagttaaaagtttaaagaaaatgtttggtactaaactcagccttaataggtttatcccgcattctcagaaaaaatcgttgttccaaacgccgaaacaatttcgatgtgagggtgaggctacgataagactacagagctgtgtggtatccactcaccagggaatcaaaaaaatctcgcggtgtcaaatcaaatgaacctgatgaaatcgaaactgctgttacaaattgttgtagctgtagcctgagcaaagaaaatactccctccgtcctggaaaaaataaatctagaactggatgtgatatattgtagtacaataaatctagacagaggtacgtccagattcatagtactagaatgtgtcacatataatactaggttagttttttatcggacgaagggagtagtatggcaaaccgggagcagcggctgtagacttaggcaatgaccaacgcatggtataaccccgtaaaaatgtgatgttaagcgggttgaaactacacttatgatatccctcacacagtgcgagccatgccctatcttattttcgcgatacagtacctgttagacagtcgcattttacatttaaaccttggattatttttatttgcatatacgtccaatatttgcagtatacctctaaaaatcacaatcatatataagggcccacccctccctcttctaccacctttctccttccccggcggcgcgacctcccctctcccgtggcctctcccctctctctcgtcggagccgccgcctctctcctcagcgcctcaagcagtggcggtagatcaagcacaatggcggcggatggaggcgcaagaggtagggatcaaggcggtgccggcaaatcgaagcaacaacggcgcagtttcccgagtatgcccttctctccagtccaccccctcgccatcttcttcccctgcgcggggtgacgcctctccccaacgcggctccttgcccgttccttgcccaaagctgatgaaactacacggccctctattgggcatcgtgacgctctgcgagggtgcggtccgggccgagctagcagacatatttggctttgggaggggtgagaccacactccagtgtggagcattggccgtggccttacagagatcctcctcaagagacgcggttacgtgagcccaccgctctcaggcccacatgcagaggcgaagctacaagtacatgtaaatgtaatatgtagagtcagctgactccataggtttttgcaaaacagctaaaaagctattgatatttatgttgaaataatataaaacttaaatatatatatatatatatatatagctttaacctcataggttttagttgctagctctgtcactacccacatgtcagtaacacattgaggatttgcttccggagcagcgggataaaatacgatggtaacagctctgctattgcggctttatcaaattggttcctatctagaaccactccataaaccggctaaatttaagaaaatcaaacaaatttttttattattttgacaaaatgtctgagaatttcagtggttttggccggtaatcgaggagacgaggaagacaaccatgtacgcgcaagacgacgttggcgaaaatttattcctgtgctcgtcgtcggttgacggggtcacgatcactggcggggccacagggagcgaacgacctcggcgtagcacgcgacgacggcggccagtgccagcacgagcagcgccaagccgacggcggccggggcgctctcggccgcccagcacgccatgctcaccggcagcgccatcgcgaacggccacagcagcagcacccgcgcccgcgcccccggcgcgccggcgatgcgccggggcttgccctcctcctccgggagcgcgcacagcgcgagcagcgacgtgaagacgccgaagctgaccacctgcgacgcgaggacggcgaggaggacgtactcgtcccgcgccgcgagctgcgcggcgaaggcggcgcccgccgcgaggacgaccagcgccagcgcccccgtcgccaagggcggcgacgcggtggtgccgcagtcgcagcccgacgacggcttctcgtctgccgccgccgcggacagcagcggctgctgcttctccacgtcggcgaccgaccccatctctgattttgcttccattttacgcacaatggatgattggatgctatgctagcttagctgcactgacaaatccgtgaaataatgcaattacatagctggctatatagtctcaatagtaaaatgaaacaaattcattttaaaaagcagataagctcagcagcgtaagaaccaagaaaatcacataaatattaagccggagctttgatcaaccagcgggctttacaatgctgcaactgcaagagcgtacatacttctgagtatcttaggcggccgctggaaattaattaaggaaataatgacgtcataattagtaagcactataaattgtggctccaaacgactaaccaatagtataaattaacaagaggaacattgttatggttttggaacagaacggtctctgctgtacagtttcaatgaccaaacactctgcactcttacaaagaaaaggacaagctagataaacctatcgctctgtggttcactgtgacagtgaatcagtgatgatatgcatcatgatacataaataattaccaacatagagtatgacaatgaaacatcaaaatcgacaatgatgaaaagcacctcaggaagtaactaagcacatgccaacaaaggccctctttactctatgcaataaaaatgatcttcagtgctacctcttcagatgatacttgcagtagtaatggaaaccaggaccacacaaagtgcagacactgtgatgctgtcaatgacaagtaagctggccagggtgattaactttatccagtctccactttgctgggcaggacagatcattaagatgcgttatgcttagccttagccgttagtgacaagtcacaagctgtctaatcttattgttatcagattaataaagatagtatgacaatgagaaaaccaaataaacagagtgagttctgatatagccaagccgaatcttgagagttctagattggaatgtttgttgtcgggaatcttcaaaacagcatgtgtttccttcttgtcaaaattacaggcatacgtccacagatgaactgagaaaagatggacgtctacaacttgggcaagaacaacggggagacaaaatgtgagtgccacctgatcctcatcgccagatacgccaggcttcaaaatgattatgttgcactccagtcagaaaatggccaggcaatttaacatgatattgcacacatggcagaggttgagcaagtcgttcaagcatttgattttcctccttttttgaaggcatgaagtatttgaactgatctgctctatctgcccaaaatgcctctctgcttaatagatggctcatactttcgcagcatctgctgcagccagtcgctcatcatcaatggcacgctcgtcttcagtggtaagaccctcaatcagtgagatgtatgtgctgtcatcaggggtgatgccattctccaccatctccttcaccatgttctcagcgtcatctccctggccattcttacagagcccctgtatcagcgcattatatgtcaaaagcgttggattgaaccccttattcatcatctcattccgaatcctcagagcatccttgacatcacccttcatgctgtagccactgatcagcgtgttataagtgacaaggtctggctggattcccctctctgtcatctcatcaatgagcttgcgcgcttcatcaacacgtcccagtagacacagccccctcattagcgtattgtaggtcacatcatctggtgcgatccttttcttctccatctcacccattatctcgaaagctcgatcgatgttgccagaagtggagtgactattgatcagagcattgtacaagacaaggtcaggcctaatgcctctccttacagcctcatcaaacagcttatctgtctcctgaacttgccccttcttagacaaggcatatatcaatgccgtataggtcactactgtcgcacggacccctctcctggacatattctcaaaaatctctagtgctttcttcacgttgccctctttgcaatgcccgtttatcaatatattgtacgtgaacacatccggcgcaagaccctttccacccatctcctcgaccaactcatatgcctctgttccacgcccatccatgaacaaggcgtgcacgagtaaattgtaggtcgcgactgtcattgcgacccctctctccaccattctatcacggtaaaggagcgcagtatccagcttaccctggtcacagtatccaccaatcaaggcgttgtacatcacagcttccggtttaacctctcccttggtcagcatttcgtcgaacaccttcactgcctcatcgacccggccaaccttacaccagccagagatcaccgtgccgtaggtgtactggttgggcgcgattcctccgcgttctcgcatctcccgcataatatccagcgccgcctggacgcggccccgggagcagaacccggcgatgacggtgttgtaggtgacggcgttcgggcggggcatctggcggaggagctcgagcgcgcgggcgggcttcccggcggagcagaggtggcggagcatgatgttgaaggtggtggtgcagagcgggaggcggaggcggaacatgtcggcgaagagggcgaaggccggggcggaggggagggcggagaggagcgggtggagcgaggcggtcgagatggggagggatagggacttcatccgcgagtagaggcggagggaggtggcgtgggggcgcacggcggcggaggcggtgagcaggaggttgggcagcgaggacggcgcgccgtcgaggtgcgggagcacggcgagcggcgagagcgccttgtccgcggacagcaccgacttgaagagcgcgagcgccgccgccgacgtcggcgaggcgcgggcggccgccgcgacggcggcggcggcggaggtgggcggcgccatgtggaattggggacttcggaggagggtttttcgtgagttttctacagagttgggcaatggtattgatttttctctcagcagatcgtctaccaaaaggcggtcccacatgcagaggtacagaaactgaacaagacttcaaaaagaaagaaaaaattgaacaagacagagagaaagaaagaagaaaataaactggaaaatgtcatgcagcggcttacatgttacaacaacgcataaacatggttcaaacgttacaacacataaacaaggttcaaaggttacaacacataaacatgttctcacagaacattttcaggttgagatgctacattttttttcttttttttttttttacggggaagagagactactatacttactgctcggctacatagagctggtgttaatacgcaaatccatatacaaaattttcggagatcagttatatgaagggttgaccactccaaatttcgtcactcttataaaaagcgctgcagctctaaaagagtgttgcagctcactagagtggcgaaccctagaccctaaaccctgaaggcgtcttcctgcagcaccgctgcttcccacaactcctcagagcatcacttacgtgtgatccccatccacccagccgaagctttcctgcgacccgaattgaaaatcctattgcaagaaattcaattcaggaaaggcaaatcagattttgttcttaaccgtaacaaaatataagtcagaaaaagaaaggagtattacgagcaaagcacacttacttcccagctgaaaaggtccgtttcgtccgtgtaaagaaaaggcagcgtgtcatcaagagttgggacggggtcctccggaaactcgcagcgctgcagcagatcttcgttgaagtccccggctgttgacgctccagcagaacaccctgcacggtttccagcttctaccatgggccggagagtggatgtgctgcattccccctcctgtgtaaaattcagcaatgcaacagcatgaagtattgtcaaaaaaaaagaaaaaaagaaagagcaattaatttgtttgccctatcctcattatcagtagcatggcttacctgatcatgtgaaatggtgccattctgctccgtgtcacacgggctgttcatcaggcagcgaggcagcggagggttcgttatgggtgtaatgggatcacttcttatggtcagtgcatcagatgcttcttcagtaacagagtccatttcaggcgtgccagtttgcttggaggataattggtagaataccttggaaacaacaagctctccgtcctccccgccttcttccacaccaagattatattgatgcataacccaattagcttgtactatcttgttctttttggagcctttgtaaagaaccagtattttcttccatccttttaagacaccgttatggtaaatctgttggattttccagttttgtgccatcttatgttctcgtcagaagcagcatggccggtgtggctgatctttctacgcttgcgctgaccagaaccatatgcgtttgatattctgtggaagaaatggctgctggtgccgtccagcttgatacctgacagaattacagaggaatgtatgacacatgagctaactaattactactagttcaaaaggcctgataacaacttaaaatatataatccagtaccggggagattttcaggatgtgtatagcagattccttccaccttttctagagttgggatgaagtgatcaataagaccctgaggccctggatttcccaggttaatttttctttctaaatgttcaagtacttcaagatcagatggatcaaatttaacaccgtcagggaattctggccactgtaaagtaacctgcaatgagattttttatttagcaccaacaagaaatgcatagaaaatgtgaaacttaccctactgatatttctgcttaaagccaacctcgtcatacccaaggcaagggagccacaagctttgtggattttatattgaaattgtgacacgtgggagccaggacaataggaataaagtgtagcacacagcacagtaatgagcaaaacaccttttttagtgaataatgaatgatcataaatcgatttagccggaaaaaaaacataaataatagttactcctaatcatagtattagtaaattactaatttacccccaatataccggtagtataatactaccagtagactgatagtataatactaccagtagagagcaccagagcatcgctctttggaagtaatgttgtctagtgttgattttctacacacgaaactttaatggcaaaacatcatcagagtatcagacaactgaactaaaaagttaaatcaagcattcataagtacaataggtagctgaacttacatcgctattatcaatgtgacatttgcagtttgggcattccctccatgcttctggaaccaattctccaagtttacaactcagaagctgagttgcatttcttatttttgtagcaattacctttccaccagctataatccatggcctgcagtaaaaggcagaagtgagacatgttcatcataacaaaaagtcccaacttatctcaaggacaatctatcgccttgtcattcaccaaaaagttcagattttaaggttaatcagcttaacatagtataattgtgctaagttacagatatggaaagacttcttctacatatacggaacttagtctgaacttctagatatagtgacacgcactaattggttcaacagaattaatagcaactaatcatgaatataacaggggttaacataattaattaacaaaccgtacttcgtacagttactaccttgtgccttgtgcatttactacaacaaaaatggtaggagtaagattaaaattaacagctatctaattcagatgtgtcctaggcctgcatgattccaaatgttgagcacatggatggtagcacactaactagtacttagtctagtactacttttggtctccacatcattcgtcatgcaatgctgttgttggaaattcaaagattgacatatctccactctgtttgactttccatgagttccattccctcattccctgctttctgctatagattgctctgtttcaagaaaccaaatgtaaatggacagagcaatctatagcagcgaatggctatatgcctcaaaattttaatggtttaactgcaatccactttggatctgcttacttccctaaactgttgccacattactctccattatgattggctaggcaagggtccaaaagaacagggtaattcaccataggctccacagctcatttactcactgatccagtgttctaggagtactacaaacgtatcgaaatctggaagctgagcccttcaccttagcagctgcaactgtaacaagcctgaccatcagcaacaataagccttcacttagcagctagaatgctgaaaaatccacccaaaccggacattcagagtttcagacagcgtaaggtttcatccaaaatcacattctgacagcgtaaaatcttctgtccatcgattctgaacgccattcctgcaccatcacccagaccggtggcaatccaatcggcaatcagatgacacgaatccgaaatcttcccctctgttagcaacgagcagctgtgaacgatcggaagacgacacatgacccagtctccatagaacagaagcagagtcttcctcctctgcttgtttcttggttgcttccagcgtaagattccccctcaaacctcagtaacctgcaaaaacccccacccccgcatgcaccatccgagaccgctatatccaccgatctcatgcattccggccacgattccatcacgccaccagtaaccagctcgatctccactcgagccacacacaagaatccaaagcgatcgatccccccaccccttccaaaaaccccaacaccagaatccacctctcaccgatcagaccaaccaccactgcattacacctcctcaggtcaacccggaaccacgagccagctggcggaggcgaaatccccaaatcgatccgctcatcagacacggaaaagagaagagagagaggattaaaaaaaaaaactagcccttgcgaacgaacagaagaaaagcgaaggaagaaaaccacccccaagaaaaaggaaccgattaaaccaaaccaggccacaccccgatcgatcggagaaacccccacccccgatgctcaccttgccatgggtgcggcgctgcgacgggagcttgggctgggaggtagagagcatccgaggggggagagaggaggagaagcgagaggagaggaggaacttcttggcaagtgaggcagaggccagaggggggagtggccaaggaagccgggggtataaataggggagcttgcgcgagccagcctcgttggtgggttcgcgtctggaaagggttggggtttctttggctttacccatcgtccgacgaaatccaaaccaaaaccatccatcctgttcgcttggcgggaaaccgggctcgggtgcggcgcggtgcggacgtgcggtgcggctagcccgctactgccttactgtcgcctctcattcagccattctcatctctaattctactgtactctctcaagctgcctaccactacctaccagtgaatgtttcttcaggatgtgttacggccgaagcagctgcagctgctactagcactcttttggtactgtagcgcggttcgatgttttgcagccacaaccattgctactactcctactaccaatcactcccattgaattttcgtgttaaaaatctctgcccacactttgtacagaatccatgtaatctttccacacagggacatgaatattactgtgccactactagtcgttcccatcagacagacacgaataacgctcatcagcactctcctacaggcgcacgtatgcggtatactagtatagtactactatgcgtctatgcggcgagtgttccacgcttccttgcaccggacaaaagcccccgcccgccttggccattggctaggatcaggcacacccgcggtcgtggcccaatggcaatggccggatgcaggagtgagtggggcccacgcgcgccttgtcctttttggttcctgggatgccgccacgtccacgacccactggtggcgcgccgcgcgctcactctcatcgccctgtttttcttcctctccaagccaaagcacgcagccccacactcccgcgagggagggacccagcagaaacggaaactcgcactcgcgcttggtggcacggcgagagctctctcacgtctcagcagccccagccccgaggccccgagcgaagggaagggaaagggaggggagtagtacgcgctgcgctgtagccgcgtgctgcagctggtcgggaaggggagtagccgcgagctgcagggaaggggagtatgcgctgcgctgtagcttggctgtcttggctcggctcgggcgttggctacttgacttgactcgcgcagtgctactacggtctacagtctactgcgggctttgtgtcgaaggcccctgcgcgcgtggacgtggtcgatccaggcgtccgttggatctcgcggtggatgggtggtgcggatcggagagatcggaccacgcaccgctcgctcgttttgggcccatgcacgaccacgtacgccatgttcagaggatgattggaatcagctgtgtaccgtactgtatgtcacaaggaggcggcgcagtgactttgtgacccaccggcaactagcgatacgtattgttgcatgtgccagaagcccagattattcagtgcatatacggagcagcgtatacgtcttaagtgcaggcctgtcgcttgtgtgggcctgcttgggccaaatggagggcccaagtcgactctctttcacgatgagataagcctatgttttctgcccatacaaaagctctgaaaaaaatgcatctttattgccgcgacataggtcatagtacatgtgtatgttttattgccgcgaccgcgcgacgagctggtaaatcctctacagaagtacgcgtacgacttctactgttgcgacttctgcgcaagttcataccactgccaagctgcaaaatctactctactttctagtgctcctattgcactttgtcgtcgtagtagtacgtttacttatctagatcgatatgccagctcatcgtcctaatgaaacatgtagggctcctttgaatcacatgattaaaaaaaagaggaatagaaaaaacacattattctgatagaaatgcaagtgtaaaacaattaattgcaaaacacagaaattaccgtttgattgggctgcacgaaaaacttaggaatcagatgagagagataaacttagaggaaattttccaagagattagagagcatgttaaatttcctatgtttttcctctaaggccccctttgattcaaaggaaattcatagaaattttagaggatttcattcctataggaatttttcctataaagccctttaaatcaaaggaataaaccctatggaatcctatgaaattcctatggaatgcctcttctcatacaagttttggaggaatgttaacaagaggtagaacctcatggaagaaatcctttgagtctttatctctactcaaatttctgtgtttttcctgtggtccaatcaaacggtcattcctatgtttttcctgtgttttgcaatcctctattttacacttatattcctgtcagaatcctatgtttttcctattcctccgtttttttattcctgtgattcaaaggggccctaaaatcgtagaaatacgaaagtttccaccgttttttcttttctcgttcctacgaatcagaggcataaatagtgtatgatttcaatttctttgttttttcttcatttttcctcaattcaaaggggcagtagtattttctatatagtttataatgaaggtaatatctcgctgcagtaaatgaacagaggaaggctcctacggccagagcaaaatccaacggcgagaagtcccacaggtgatccaacggagtagtagtacggggacatgccctgatgcactgttctgatgattggacgtccgggctctccaacgacgagcccgtacattccgccgcgtactgatacagtgtcgtctccaccgcccatggccggaaatcgcgagaccaaatgatggcgtagcctgcgatgagatctcgtcgacttgacgggttgacgagacgacgagaagatggcacgcaacgctatcgcccaccgccgatccctcgagcggtgtccgggtttccgacaggcgcaaacgactcacgacaccacggccagtcgcgagtcaggtcaagggtcaggtcaagggcctcgcatgctgatcaatcgatcggttttgattggactgattctgatatgcgagattactcaaatttgctgctcggcacatcgattcgtcgcaagctcccaacattcgcaattcatcggaggatttttcgaaggaattctatgaaaaaataaattaatttatgtgaaaaatctctgtaaagttcccgtgctcgaaggaaacctgatatgtggcctcaagccctcaactgtgtttcctggtcagtggactctcggcgggtctaccaaaaagggaaaggaagaacagcgacaaataaccattttgtggctggccaacggaaaaaacaactggctacacgagtagtagtagtatccatctcaaacctcttgttgatttgaggcaaccagagcacaatagaacaccgatttgctataccaagtacggagtaccaataatagggtagtgatcagagaatgtttcactgaccgcttcgcccaactgcccaagtcctccaagcctatctatagttctatacgcaatataccttgcccaccgataatagaagcatccacctgtcgatccagccaggccgggcctgcagacagcgagctgtttgaacctagcaattcactaccaaccagctgctaaaccacttggagaacaggtcaagagacggtagattagacgcacaagaaggaataacttagctcaacttgggcattgggttgtgtacttgtgtgtgatattgcctcggattgaccacaggacacataccagacaagcgctcaagtcaatgatggatgaagaaacagaagaagtgctcacgcaatcatgcggcaatttccaacgacggagcaacggaagccagagtttttggtcaaccagaaattggatgcagccatcaaagaaaggaacagaacaccaacgcgaaaaagaaagagagaataaaagcatgtgtggattatctgcagggtaatgctagttctacagcatataaatctgaaatctcacttgattttgcaatctacagcagttctcagtttatgtatcaatcagggaagtaatatgaatgacaggtgaacttgtggtggctaccacagggtaatgagctcctctgggaaggtaaccatgccacgaccgagcatacactatgctgtagcctgtagggtcgtccggtgttagattgcacagtgaaggatgatgaaatcatccatagccactcatcccaagcaatcatccagctaagttagccaatcatatcagatgcaaccgtcacggccagccaatctcggaggtggagaacatggcagtgacaggcctgcacatcagattgaagagtgtagatcatcaaaatctacccactttctctcctgcagtaccctgggagaaggtatctgtaccgatcaacattctgtagcagatagctaggaagatgaacagcagaaaatgtgcttggaatcggccccaacttggcaatgatctcttggaacgtgtactcttcaggaagcatgtcaaaaagatccgcccctctgcatataacatcttgaatcctttcagggttcaggaagtacttaaatctaatccgatcgacatggctgtaagcttgcattttgaaggcaaaatcactaatgtagcgaaagcaaaaactgcagtgccaccctgaatcagcaagaagctcatctgtctgccggaagtgtgcatatcttgtcttcccagacctgtacctgtgtatcgatgccctccaacttttgtcatccaggaaaaattcaaatgagtagaggtaattcctaagctgaagatgaaggatctcaggaatgtcgtcgcaccatctcaggagatcaattgtgtggccacttgggatttcatcaacatctgacatgatcaacaggtcatcatcttctatttttgcaatcttaataagctggtccagggcaaccctctgatatgactcctcaacaaatgggttttctcccttcacgaaccttcccccaatcataccatatgtcagccgtgattcagcaaatccaaatcgatgacgattttccttgaagtgcaggggctttttcaatccagtgaaggttgagttcgactcaagcagcacaaactctgagacataggggcttagttcattccaacgtatttcaagaatatcgagctcattgctgaatagtacagcatcgaagacacgtcgtggggtctcccggactttccacccatgcaacttgcagagtttcgccatggtgacattctcatggtagtaatgagggatagttttgaagggcttgggaggagactcccatattggcctgaggaagtatgtgaccttctgaccatgagcatatatcattaaaattagaattggcactcctatcaatagggccaatagtgctctgaaatcaaatccccgaagtgcacatctcagcctcgacatggtcagaactgcctttgacgcaggctggaaatgaattcacaaagaaaataagaaatcaaacgagcagtagtggacataaaagagttatgaaagaaataagaacagcaaccatctgcatgccaactgctcctccacaaaaactatttaaaatttcagtatgtgcatatattagcaatatttattcctaacgcgggagcaaagtgggcaataaggccataatcaaagcctgcttgccaaaaagatataacctcatgaagcattcgctaaacattagcttttcaaaatacaggtcttgttacagtcagcaaaggcagcatctgaaattcaccggtaactcagaattccactacaaccgcaacaaagtagcaaaggacaaatgagagacctaatgccacagctaaaagcacagatgcaaaaagccaaagacaatttcgctcgtgaagatcagcaaagccatgtaaaaaataggcaacaggaacctggaacaataggtaatcgcaatgcccagctataaccaaattaaactagcttcattaaccaataacacgcaccagccatcacagaagccggtaagatacctaacccaaattatgcagctttaatgggtaaaccaaaaggggtaggcatcccaaattccacaagcttgcaagagcccgaagctttcgccgcacaaagccacgatccaagcaagaaagaggggaagtcccaacctcatcgaaagaaagattctccacagttcgaaaatgccagcacgaaacacgcggttcggccacgtcgcgagattctaccaccaaaaagtcgttactcgttaagaatccggactccatatcgccacccacacctacctaatcccccccatcgcccgcaacggggcagatcgagcgctgcagataagcatgggaaagcaaaccgcccccaaatccgagcaacatcgcatccaaaactcggagcatatggcaatcagcttccacaaaatcggcccgcgtgcggagacggcgacagcgagagcgcgcgcgctcgccgccgcagaccgaacgcgcggcgcgcgtctaggggaatcgaaggaaccgacgcccgcgacaagcggagcatgtctggaccgacggggccatggggagggaagggggaagggagaagggggggtagtaatggctcacctcgccgcacacgccgtcgcagatgccgtcggtcttcttgtggccgtagggcccggtctccggcatggcaggcgcggcctcgcgccagcaaagccccaccaccaccaccagagcaaacgaatccgagcaggagagaaggtcctctccaatggcgaggagggcggggcgcctcccgtggcccgggggtcgccggcgatcgccggtggcggcggcggcggtggttgggtgggggccttgttccgatctcgccctcggagggagggggaggcggacgcttctgggcgttgcccgttacggtggtggcgagttgtgtaattagcgggggagtcgcggggggtcgtgggcgcaaaagcgtgggggcgcgttttggaaccgcctaattatagccgttcgcgtggtggccgtggcctctgcctgcctgcgcctccctcatatccatcgccccggtggtgggcggtgcgtgcgtggcgcggtgcggtgcgagctgggcagttttgtcctcacgcacgcttgggtatttttctagggacataaattaaggggaggccaattaagcgtattgtatatccgtgccatagtcctgaactctgtgtagactctaatgaaaatgggaggctttgcccctcttgataaaaaaaaagtatatccgtgccataatacttaactattttctccgtcccataaaaaacaaacctaatactagatgtgacacatcctaatactacgaatttagatatatatatatatgtcaggattcataatattataatatgtcacatttgttactagatttgttttttataggacggagggagtacgttctttattgcataataagttcatttatgctcattttatttattttaaaataagttaatttttgagtaattattgcattataaagtttgtgagagtgaaaaataaatatatagtagacaaaatgatgaatagttgtattaggatttgataatgtagaggtattgtattttttttattttgtattggtatgtgtgggggtgaaaaatgaactcagtttgagacatatgtagtactccctccgtcttttaatatgtgacaccgttgactttttctcacatatttgaccattcgtcttattcaaaaaaatttatacaaatgtataagatataaatcacacttaaaataatatgagtgataaaacaactcataacaaaataaattataattacgtaaattttttgaataagacgaatggtcaaacatgtgagaaaaattcaacggcgtcatctattaaaaaacggaggtagtatatatctaacccatataccaaggagaaatatagtcagagaatacttataagatatgtgtaattatacactacattttcaacacaaaataaatatttaatattatatttaagaaaattaatttgatattgtagatgttagttttttctatcaacttaatcaaacctagaaaaatttggcaaagaaaattaaagcgacttataatatgaaacggaaagataccttgcaaaatataatcaatgttatatcatgatcttttttgatcataataaatacacacatcatacttatacacatgctgaaccctcacccttattaaaaaaaactttaataaaacagtaccgcaaataagttcgtactccatttgtcctaaaaataatcaaatcatagttatgaatatggacaagtgcttattcaggtttatagcgagcatttgagtttttttagacagaggtgtaggtaataagattaaattttagtggataaagttgtatacctatggtttctcctgatcagcataccatagtactttcttaggttaatattagatattacttggccatgcaaatgacctgtattttggacagctaatcttaaatatgaggtgtgtctttgtaactataatatgccaggttacatttgtactccgtattagctaatcatgtaaggtttatatagttttgagtgtattttgagacgacgtctataaataacattcttagcaaagaaaaatctttcctcacaaagaaaaaggccttctacttttactgttatgacatgaatggttgccaaacgagctacctcaagcttcggaatccaactcacctcaaagtatttgcagtacaactcatcatctttcctgcaaaggataagataaagaaccgcaaacatcacgagaaaaggatatgatatatatatgcaattatgagaggccacccaggtgagatgccaacgtacaaaacggattgatctttccatctatattttgtttcttctcctaaccaatgcatcatctacgctacaaaaaaaaaaaaaggctcttttatcactttcatcagctagaacaaaccatcgtatacacgacgactccacctatctcggcagcatcacattcggagggcatctttcccccaaagcgcccgcgaaaacatgcgtgttcccaacacaactctccaaagatgaattgatcacctgattcccttttggcacaaaattcctctaccacagtatcggcaaatctgtctcgttcaacgcttgcttttgcttactaggccgctattgcaatcgctacgttctcatccactatgcacagtagcaccatgctcctactactgctgtcctagccactacaactgattactctctctatcccagaatatagcaatctaaaatcgaatgagacgtattctaatactacgaatttaaatatgaggtatatccagattcgtattccatctaattttagtatgctacattctgaacggaaggagtaagttttagaagtgatcttaaactaatttaggtgcttttgtagaagccataatctgctttgcttaatcgtttttttcacttctaataaaccttagccataatctgctgttgcgtcggcctcgtcatagccgccccccctccccccccacgttgcagcaaacatcctcccctacccctccccctagtgccctcttccctccacgatccaaacctggtgctctcccattgttcttgggtttgctggtgctattctcatatcaaaaccttctcatttccggcatgctcaacaattggtccaggtgtttgttccaggaactgtgctcctccagcagcttggctggtctatgtcccatgccctccggcgaggtcgcggttgattctctttcatctgcaagttcccccttggccattacccttttgtctacctcctgctcgtttccacccctttccttgagatgtcctcgaccgcaaggttcagcggcactccctcctttaaggcttccttcccttgaagggcgttggagtgcgttgatctaacaagcaatttgatcaagtttgattgaagaagactcattgcgggtggcctttggctgcatctttcagtgtccctccctcctatggggcttccttcccccaaagggcgtcggcgggcttggatccaaaaagcaaaaagaccaagttagcttcttgatggcttcatgcgggtggccttggacttccacagcttttcgttggcttttcttctattccggcatgcatgtggctgtgtgaggaaatggatgttgacaagctagggtgttagctttaggttttggtgtttggtttgggtaattttgcaggtgttgctcgtcaattgttatcttctgtgaggttttttttctttatctgttttctcctctttgtattccccgtgtattctattctcctatcctccagggcccttgcgtttgcgtaggtgaagcctgccctgtataagatcatttggctcaatatattcaggtggggactctctccccccggtgatttagtcaaaaaaaaataatactttgttgcaagcacacaaaaaatttattttaaacatagcaagatgtcgtcgtgataggatactggttgcaagacgatgtctagtgtcttcctgttttattatcaagcatgggtctgtttttttaaccctgaaaaggatggccacaccctatcagtgatcgcacccgcgaaagcgaggagcacgaggagcgcgcgcgcgcggccgttttcttccctgaaacagcgtgcgcgggtcggagcgagatgcgaggggcgtccacgcagtgcagacgcatgcaggccgcggttctctcggctaaaaaactactcgtagtactccagtactacgagttctccgccgcggcgatttgtttcgtgcgtcgcgtgcggcgtggcaagccaaaaagccgctggacttcgcgaggggcacggcggggcggggcaccggccaatcgagccaacacgtcgttgccgtatgcacgccgcggcttggaaattccggcggaaaccgatggttttgttcgacccgtttggcgtttaggcgggcgtcgcccccttcttttatttgtttttgagtagagtgcacggacggtccttaaacattatgtctgtgtgacatgccacatcagcgtcacgtaggatcctgaaggggctgtggctatttgggatttagatgacacattatgacaagttctgagacttggatatgcattttgagagtttaagaacctagatgacacaccgctacaagtttaaggaccgcccatgcactttatactttgttttttttccgttccaatgatggagccgacgagtttctccgtctcaaaataagttctattccacatatatcaatataaaaaaaattaaaataccactatgttattaaatcacaatgtaattagttttttatctacttctaatatatttattttctaatttcataaactccgatgtaataattacttaaaataaataaattttaaaacaaatggaatggaaaaattgatgtattttgagacggaggattatccaagacttatcattgcatatttgtgttaattatttaatgtgtgcgtatcactgtatcagctgagcggagggcgcagtcgatcgatcgacttgaccggttgacttgcaaagaagcacattatataagtatatactacttcttgtacagttcggttggtccatgaagcatgcaaagtaacagtggaaaaaaggccatggaaaatgcgtcgtccactgatgagagatcagtccgtgtcaagttgctagctgctggtcattttcgcgacatgaaacgagaaagaaagggcggcatcgctagtggcccatcgaaaaaatacaaatggacaggcacctctcggtgttttagtgcgtttagtggctcaggggcaaagaccgtgtgaacaagaatcgccctagacttactttgattagacggcgatctgtaccgatccaccacagcttcctctgccgcatgctgagctgaaactaatatgttgggggcgaattcgacacacaagaatttccatagaatttcagtaattactttaaattctacaaaatatattacaggaaccgtcatcatcgatatagaccttagtagctaaatgcgaaagaatatccaaatatgacaagacatatataaacatgatatttattgatgagttttcagttgaaacatatgtaatatccggacaccgattataaacgcaccctcttaatccattataatcctcgaccggctaggccactgacctagtcgtttctctcctatgttattgttactatgcggttatatagcttatgtcactttatttaagactgagagtataggataagagagcaactatatttctattctaaaacctattacaactccaagctatactttgtaaccaactttatacacgtattcaatacaaaaactaacaaatttcacttgacgaatatgccacatcaatctaaacttgttcgtgcgtgaacttccatataccttacttgagtttattcatttttgctacccacgttgagctcttccatgagcctataccaagcccgtcatcttgaagaaatcgacctggatctcctctttcgccgcctcacgccaacgaacctccgtgcacatgccttcccaaccatctccgatgtattctactctgccgcctcctctagcctagagcaagatcgtgttgagccctctgccacttgcacatcacccacactagggtcatgcaccttttacactaattcttgttgctttagatcatcaccgcacaagaaatctaaggtttggtatctcctttttcttcggtgatttgcaatcccgtggttactctggttgaattccatcaacttctaggatctagttgtggctttcgctactattgttgcttcatctcaagctcgcaacccaattaatctatccgcaagacgaagccgacaaattgccatgtcattttcattgccgccaaatgacccaagcgtcatgtctgtctatctccctattaaatacaactcattgaaaagacgtctaggcaacccatccggagtgttcaactataccgatcgatttgtcgattgctttcagccttcaatcaacccgcttgaagtgtccagcaccttgaatcaccgattgctctagtcaccaatcaacatgagaatcatatcgtcttcttgttgattgcaggtcatcgaatggtccgagctacctgtttgaagtgttcaacaccactggttaaaacattgaccgacaccatgctccaccttgcaccaatgtccctccctagtcattatgtgcagattgcacggtgtggagcaccttcatcgcacatctctcccatggatctttcatcatagctaggctctgatatcacttgttataaaaattagcatgacattggcctcgtttccaaacacgaaataacaccataacagacccaatcatgatgaccacaccaagacatgatagttattgacgaggtttagccggattctacgtcctcgaggcatcagttacatgcattcctctttgatctaacataattacaactagcatggtggcccgcgcagcttgcgcggctatcatcattatattttctcacatataatagcatatatgttttctcaatatattgttcaaatatattaaattgacaatataattttaaattttgcaataactttacgaaactactaatgggtaatattcatattgtattttatatacgtgttagttattaattattttaatatcaatttttaattatttgtaaattatatatattcctatatgcactctagactcgtcttttaatatatattttttaattccgaattttctgtaaactgtatttctatatagactctatgctcttcttccaatattatttatttttatttctgaatttttattatttttaattgtatttctatgtggactctaaacttatctttcaatattctttaatttttaatttcgaatttcagttacttctaaattgcattcctatattgactttaaactcttcttcccatgtttttcttaatatcgaattttagttatttgtaaattgtatttttatacggactctaaactctactttaattttattatgtttattccaaattttagttagttttaaattcctatatggactctatactctaattctaatattctattttttttaattccgaatttctattttttttcttaattgtatttctatatagactctatattctatttctaatattccttattttttaattccgaatttcttttttttcttaattgtatttctatatagactctatactctatttctaatattccttatttttaattccgaatttctattatttcctaattgtatttctatatggactctatactctacttctaatattctttattttaaattctgaatttcagttatttcctaattgtatttttatatggactctagtctcctcttctaatattccttattttttaattccgaatttcaactatttctaaattgtatttctatatggactctagtctcctcttctaatattcatttttttaattccgaaattcagctttttctaaattgtatttctatatgaactctgttttttatttttctccgattaatgtgagaatttctagaccataagagcgaacgtgaaggctcctttttctattcctttaataatataatagatatattgggtctgaaagtcccttaaccagctagaccatcggtcaatcattcccttccctatgctactattgtcatgcggttataccggggtaggggtgaaaacagagcggattcggacggatagtagttataccatatcttaaaccattttttaaagcgaatgtagagcgggtgtggatgatgtgcggatgcggatacgaagcggattatttcggacgttggatttggtactgagtctgtgcggactcggttcggaaacggacaaaaagttgtcggatgttaaatttgtattcaatccatacaacaagagggcatcaatacaattagccgcaatacgatggcaaaacaacatctgaacatgatctcagctctctaggaaaaccaatcaaaacacaacaataatataattttgcttaattggtaaagtacagcttgtataatataacacatccagcaaattgtcaattgcttaagggctcaaataatccaagatacatagcacgacagacgacggcaagaagcagcaatggggacacggaacgacagacgatggggatggcgttggcgacgggccgacgttggcgcctggcgacggggatggtgctggtgacggtggcgcctaggcgctggcgctggcgacgggccgaccgccgacggtggatggtggcgatggggacgacaggaggaggcgacgggccgatggaggacgcgctgacgcaggggagtggggacggcaggcgacggtgccagcaatgccagaggcggcgcgctagaaggaggagcggtggcggcgctagcagcctgcaacggcgcatgtgtggagttggagaaatcgagagacgcgtgagaagatgagagtcagaaagatttgggggatggttggattaggttatgatagatgggccactcgatggaaaatgggctaaattgagtagttgtgtggcatgaaaattgtggattatccgccaaatagtacatcggatcggataatccgattaaaatatcgaataatccgcatccgtcggatatcgttgataccacatccggctccgcatccgcatccgccggatatctaaaaacccttaccatatcctcacttcggacggactcgaagcggatcggatcggataatatccgctccattttcacccctataccggggtgtctctttaattaatttaagagaggatctagaataagagtctagctctacttttacgctaaagacctattacgactctaagtctcactctgtactgattttgctagatatctattttgggatggatgtcaactaacactgatggggactgagcttgtaagatgtgtgggtgcaggaattgttgcacgggataatgttagagataaggataatagacatatattcaacttcaacaattgctatgaaatttctccattctaaaagaggcccaagacatttttgaattatcgggaaggagttttcaaatgatacaataatacgtgataaagaatcaatttgctaacagtattcctacataagctagctaaacgagaacgatggaagagtatgggcagaactgcataagtacgtaagacggaatacagcatatatggtgccttgtggttgtggtgatgtcaatgtgatcctgtgatgcgaatatgagcatgacggcattttcgtcagccacctatgaagtatgaactctcctagttcgtcttgaaagagcataagacttacgcaatcattgcattaaggaggagaaagctaaggatgaactcaaagcaaatggaacctagttaaggtgagacaaactaaaccaagtaactaattggagtctaatttatactagtacatctgtacatgtcaagactcaagacacatcattcaggtcaggtagatatctgctggacagttggccaaaacatgacacatcaaagtatcaaacaccattgccagatcaatcatgccatggttaggtttatgctagttatccagaacacgcaatattttttgtttgtgagctgatacctgcctgagataagatgatgagaaacaagttaagccaattctaagcaggttctatctacacacccacatggacatgtacaccatgaagtccacatggaggctgtccattacaagcccttgaaattaatatttttgtcatcttttttctctcctaccaactcttgtgtcatttgtctattgccttgcctgctaatctttaatcaggtctctcccaatgacatcttaggaggctactatcggttcgcttatgcttatgcttatcagccaaaatttaaattttcatccttaaatttggagttgattttgaggttttttcatcgaagtttatttttcagcctttgcttttagatcgctaagaacgtgtatataaaagttttatccacaaattgtttttcgtttataaatatgccgtttcgcttattccaccaataagcgaaacgatggcagctcttagttggttaaaggagttgcaattaatgtgtgcaattacttgtaggttgcgattccgtgctctggttatgccgaagcgtacaagcattttggctgtaatatgctgggaacattgctgtcctggctctgagctagtagctctttcaatccacctcaagaaaagcattactttaattaaggcaattaattaatgcctaagtcattttgaacatataggacatactttatgagtaaaaaataataaaaacaaataggctactcctttatgtgtaggtaaaaaaatattattaaatctcaatttagaatacaggaatttcatttgcgatttaaatttgttctcttgcgatttcttttagccgtttagagataagtgtcacgtaggcagataactgcttttaacaaccgcaatccgtatcatttatcaaccaccaattcatcatcaaagagttgaagattgttcgcatctaaattgttgtttactccgcattattctctctatcatgtcatcagatatagtatataattattggtcaatttgcatcgaacattataaacaaatccatctcatagttctttccgatgtctattttatatccattggcgaggctacacatagttaaaaatttaatcaactctttgaagaaacgaactggccggttaattaaatttttaactaaaccggccaaacgatgaaacttggcataaatttactgggtgattcatcgcttcgttggacttgtgctgctgcctcaatgtctgaattgttgtcttctcttcggacagcgatggctagattgaaattttcgtttcgttaattttttgtttggctcgtggtagaatccaaagggcggattttcccttcagagaaattgtgtcttaacgcgatttggactttgtaagggcacttttaacaagcagagttcaaaaaagtttaaagttatggtttggattgtgtgaaatcattgtcatgattaatatttgtgacgaacaattggctttgcaaaatgatttattcggtgaattggtttggaaagatgtgtggatgttagtgtgagtgcgtgtgactaatgtgggttaggttgtgatatctgtgccaaaaatcggttgttttgtctgattgtgtgaaggtgacttgaggtcaaccttggtcaatgatgaggaccgggactatgtttagggaggaacagaggtctagtgcggtcgggatactatgtgagaaggtgactagagtcagaaatcttggaggtcaacttcggtcaacggtggggatcggcactaaactcggggaggagttgagatccagacggtcaaggataccgggtgacgaagtttgatatgagatggcatacggtggatggacattatatgggagagatcttcgcaacgggcttcacgaggtgtgcgtgcaagcgtcggtgttcgcgaagggaattgaaaagttggagtatatggtgctacagtacacgaggtactgtagtgtgcaggtatgcatgcatgtacggtgctgtatatgtacgtgtgcatgaccggttggccgagcaacagcagagcggctcggtgggcttcggtggctgttggcggcatgccaagtcggcccaggagaagcaagggcccagctggcagcgagtcggagacggtcacgcgtggacgtcagcttgggagcaaatcagttttggatttctggtgtggccggttgtttgctgcacgtttggaaattgtaaaacgtatggaaattgagagattgagtcctgttgtgaattggagttcaacacctattttgagtaggaggtttttatgtataaatagagagggagggggtggcctcccggtatcggttttagtaatccgagtttgagagattagataaggtttcgtgagaaacttttgaggggtgctgtggctgcaccttgtaaacaatatacttgagcaataaagatcatattcaatcatcaaggcatcgacgatctattccggtgtcgtaagttttatgtttatgtttggttttagcattaacttgtgattattcgttttgctgcgattttgtccaagttaatccatccaaaatctttctaatacttcatagatcagatttgaaaagtttcgttgattggttcttgttagatttgaatttgcttaagttttaggtttagttcagatttgctgaaattctgagacagctgaatttcgagggtgttttctcttaaaccgtttattagtttgcaaatccctccagtggagttgtttcttggtttgtatagtttattatgtaaagtttgcaactcgatccaacggttggtttaagagaaatcgtgtttttaccgaagctctgtcgtgctgtttttagtctgatggtcaaaccgcgagaggaacagcggtcaaaccgattagagttcggtcagatcgatcctagtaggtcggatagaccgccaaacatgtgttccattggcttttgaggttggggtgtgttttgatctattaagattcgattatttgacttccgctgacgaaatctaccattcaccccccctctggtaggcttggttacttgtgttcgatcctacagattgttcctcgaaccagcgctcgcggttagaggggttcttctttttctccctgctctagcccctagtgtgcaggataaattttcactaagtaagagtttctatataggatagatataggatgtacgtgcgcacatcacagggacggaagtagcagggggcttgaacaccccctaaggccatgttcgattgggccgagaacggccggggtcacggcccaacccccgtggatcaacctggcgaggaagcaatcccagcccatgggaaaagttgcgttcggttaagcccagacgatgattttaacccggcccaccacagggttcccctattgtccaggcccaagaaaaaatcacctagtgcggaggcttggaaaaaacacttagagaggcggcacaacgagaggaggcgctgcggcatgactcggacgcgacgacgacgacacgctctctcctcgggcagctgtctcctccggtggccacatgttaatgaccaaatttggtaaattatgcatcagctgaagcggatttggaaggaaattgacaatcacagaaacagagcaagaatcagcatcgaattgcgtcggctatggtgtgcatcggctaattccgaatcggataagggaagccgatgtagccgattccaacaaagtgatgttggaatcattgtcggattttgttggtgtgcttcatgaggattgccacctatggattaagtctgaaaaaggcaattatgtctattaattaaaaaatagtttgttagtttcttttatctttaggaaagtgtgtttagtgtccgataatgactttaagttttccatttatctttaggatagtttctttcttctcctataaggactagtatctacccatgggtataaatatgtacacccagggtcattataatatcaatctttcgatcaatgcaactctcgacgcatcaccaccctctttaccgaggtttttacttatcaaccggcggaagttggcacatgatgcggggctgcatcggttcagttcgatctccggtgaagcggtaagtcctacgttccgccggcccaggtaaatatatcggttacgtcagcgtcgtccaaggctgcatcagtacatttgacctcttggattgctctggtttggttgatatatttgcctacctgatatctcaattctatctctgattgcattgtgtttagagacgcatcggtttagttggaactgtctcggttaggtccgatcttctgtcttagccgatatatctctacaatcacaatgtcgttctaaatagatttattatatccatcacattagacagatctatcggcttatcgagtattagattatcatacaatctcgtgctgcatcggttgtgtccgacctactagattgttgttgataatataagtcttgttaagccaataggttcatgctagtgttttatcggggtgctagccgataagttatctggacgttgcatcggcttataaggatcacatatacatatgagctggatttagccgatcacaacaaagagtttactgatttatctaatcttgtggattctatgacatcggacctccagccgatgtattatttaaccttcggatcagtacgtgttctatcatatcatattgttagccgattggtttctactggataatatcattatatattttattacatcttcatcagccgattgcctccatattgttatttatataatgtcggaatctacattggatatatagccgatagctcaaaaccctatcaatatcggctggtatcggcatcggctggattactccatcagcttgtcagccgatcgactcattgatctactgtttacatatcttgtcagttgcaggatcaaactgactggcacgtccgcatctcatcaatctttggacctgcactggagctaagcagatctcccaggccagtgtttgttttttgcatcaacaccaccttctcccaagtccccttcccctctcccctcctcttctagggttagggcttctcacgtgcgcgctgctgctgcggcagcgacaacgcacggtggtggcaggtgtggcgaggacgctgctgcatcacaccccctcgccatggctccgttgaagctccgccgctgcggcaaggagaagtaggaggacacggacgtggtgaccgcttcgagtgttctttcttccactggtttctttatttgttcttctttctcccctttgatctgttacctagatttccagatttcctcctcccttagttcttggaggtccttaaatatgattgtttgattctcattatggcatacatttactattatttgtatgcaactttggcttttctgaggccgtgcaaaaagactagcaatatttgcatatttgtttccgactcttgcttccatatgccgcttcttcttcgcgatcaaagtcataagactatctatgttggggggagtagctttgaccttgcccggagaggacaaaggctcccattttctcccaccaatcttgctctcgatgagctcacaagcggaggctccgaggagccaccgcagggccctcggaagccgccccaaggggaagggggcgcttcagaggcttcgtcaggcttcggggaacgtgaccccgaagggggaccccggaggcaacagccaggataacatcgcagagagccttaatctcgcattttaggcggccaactacctttgatactgttggctcaacaccctaggtgaaggccaaggtacatcgttatcacgcctcagcctcgagcagtgcaccccgggaaacatggggtcccccgggaatgctggcttaatgggcgcagtcccatacgatgtcccttggagagttaccagaccgcccttgagcgggggccacttgtcaacctccatccttgagttaagcccagaaggtctatctctgtaatttcccttaccaatgtaagactacataaagatgtaatacgccccccccgggggggagggggagaggggggcaaatgaaataatagataaaaaccacatcccttcttcccttgtgcttgaacccctttggattttattccaacattggcgccgtccatggggatcgagcaaagagagaacaaagcagtgcaagtgaaggatgccttcaaagcatgcaacgaagcagaaggacaccacggcagccacgcgactgtgtagggcaacgcgccccctggtttggctgggtgaactagtgatcgcccctccggctgacgccgacggtagcgccaccgggagtggcaccaaacttgagcccgagaccctctgcgatgcggccgtagaacctatcccacaggtggcgccggcgggtgatctagctacggacattcgcgctccgggggcgccgacgcgcggatatccgtgaattaggtttttcggacctgtcgtggacggttttggcaatatgatgggtgaatatttctgatattgcggtttagagatataaattaaacccgacgtaaagatgaagggatagaaggtgaacttattccttctttttccttgaacgtaggctaaactttttgattttttattgcctaggcgcctagcccctgttctctccggattgggccgaaagccagcccactatccctactcccgcaggcctgtaatcctcaatttgggccgcattcttgttagcaaagacccgacccaagtatagaatctagggtttataacaagaccgaaggaaggacgaacatacagattcctatcctctctcgccatgacaacaatgtcgtcgaggctcgcatctcgcgccgcccgcttagctgcggtggcggcatctcgcgccgcccgcttagctgcggcgtccgcatctcgtaccggggccggggacccctcagcgcgggccaccgccactgccgcatctcgcgccgctcgcttagctgcggcggccgcatctcatgccggaggccccacagcgcgcgcgattgcggctgccgtatctcgcgccgcccgctcaatctcctcgaagctccttgacgacgacatcgctgcccgcctctccttccgctacagcaccgagcccccaggtaaaccttaacacccaatcccgctctcttcatggtctcccagcaaatgagaattttcagaatatgccactcaatttgcaccaccttcaggatttgccattaatccatgtttggcgaacaaaattgcataacaccgtaatctcgagagaatttgtatttaaaagataatgcagatgaattcctaatccccgtgcctgagaatttcagaatatgccactcaattcacaccaccttcagaatttgccactcaatttgcaactttttcaaaacatgccactaaggactctaattgtttcatccccaccaagcacgggaattgtttcattccgtgtcactccgtctctctgaagttacgcgtcgtcgcccgtccgtatcgtgccgtccgttgcgtcatcttgccgccgccagcgtggggaggaaggccgccggcgtgggtgaggagcttggccggtgttggggaggaagagctcgccattccggtgcagggaggaagagctcgctagcatgaacggtgtagaagcttgccgacatggggaggagagctctgccggtgcgggaggaagagctcgtgggcatgggaaggaggagctgccggcgttggaaaggaagagccaccggtgttgggaaggaataactcgcgcgggaaggaagagttcaccggcatgtacggggaagaaacttgtcggcgtggagaggaggagctctgccggcatggggaggaagagctcaccggcgttggggaggaggacccgccggcgtggggagggagaacttgccggcgtggaggaggagctcattggcggcgcccagatgactcaaacggacgtcgtgacacgggcgggcgacggcgctcggcttcggagggcggagtggcacgggatgaaacaattcgcgtccttagtggcatgttctgaaaatgttggaaattgagtggcaaattctgaaggtggtgcgaattgagtggcatattctgaaaataaacagccaaccatggatttagtaacagactaatattcgtgtcatcaaaacaatgttggcatttattgtgtttagtttttacaccattatcacgtgtgatatctctcagcttgaaagctcaacttttctaccaataaaaattttggctggaacctcttgagccaaaggctgggatctaattccattatctgaaacatcatataaattcttctttgtgcttgcgaaaaatcaaatttgttcacactactaacttttgcgaattgaattgtgatagatgatggtaagtgcgttacagccaaggacctcgagtcagatcaagccgtatgggccttatatgagcgctggtgcaagtcatacaacaagaagcgtgaccatgctgagatgattcgccggttcgacatattcaagctgaaagcatcgcttgtgcacagctggaacaattatgttcatgaagacaaagaggaattagctcgtgcaaaaaagagaagggatttaggcaaacctgtcgatccttggtacctacaagaggaattaggcccatccgccgatgggggagacactgttaaccaatactggcggggcatgttgaaggaaaatgaccaagggatggatctgcctgacatccaaggaggaaaaaaaatgagcactgaagattgaacatgttacataagagcgatttaatttgcttatggaaatcccttaccctcaaggagttgaacttagctccccatataaatcaactgtaataataagttatgatttgccgttccatgtgtagtctatgcttatgtcgtaccatcttatctaagtggtcatgaattccatatgcttccgcctgtgggaagtttgtgtattttagccttttgggtttacgggcacaagtgttcaaacagatcaagatcaagtgtgaagatggtatatatgtcagttgtttgtacattaattcgttgagcaataggacgaaagtaaaggtgagtattgtcttgtctaaaaaattcaacattttcaccattatcattcatgcattgtttgtttatatatatataaaaacggaaaagaaggaaggggaacaggaagaggtgcgctaggaaattggcaataaactaataaagaggaaatttattccatattctcaatttgtctgtctaaaaaattcaacattttcaccattatcattcatgcattgtttgtttatatgtatatagaaaagaaggaagggggaacaggaagaggtgcgctaggaaattggtatatatataaagagtactgcttccaatttcctctttattagtttatacaggaagaggtgcgctaggacctttataaactaatacatcaatcttacttgaatacatataaagaggatggaactaaagttgttatttagattagttggcttattgaacaaacagctgtttattacctgtgtaaacaattacttagatattttcgccgggtcaattacttagatattgatcatatggcttttaatttagtttatctagaaaaatatttttgcaacttacttgttaggttgtttggcaattcgttgagttcgacatgcgcagtcttgatttttttttaaaacacaacacactttgttaaaccacagcgtttaggggaattgaattccccaatacatcgcccaggataaacataagagttggaccatatttaacaagagagaggtcaactgaaaaaaagaagcaaactttataatgaaactaagcagcaatgaaggagcaaatcgatagggtactgtggcagggccgcgacaattgcatccaagggcctctattgatatgtactccgcttgacgaactggtaaaccccttcggctgcctccacggaaacgacacatatgagaggtttggtgcgaagccgtagattttggtgtgaacatcaccggactccacaaaagatttccacggggttcatcattgaatctgacaagcttggactgcaaacctgcaaaccaaagttgcaaatccaatctgggctcaacccgaacgataaatcctgcatggttattgctgccaagagataaagaggaagaatttccccaaatccagccaaccaaagacttaatccaaagatggtggcgaagaacatgctgtcttggtaactcgatggagaaggttgaagaaaaggagatcatccgagtcgcatccacgccgccattgcaggacacatccgcaccaccgacgccgtcgcggactgcaacggcgcagccgtcgccgccgcggggtgcatcggcgcagctttcgccgccgggggccacatccgcgctgccgtcgccgccgagggcagcaacggcatggccgccgccgccgcgggccgcatccgcgtggccgccgccgccgcgagccgcatccgtgaggccgccgccgcagctgaccgaaaccgagtcgccgccgccgccacagactgcatccgagcccctgtcgccgccgcaggtcgcatccgagccgccgccaccaccgcaggccagatccgcgtcgctgccgtcgtctcggatcgattctgcgtcgccatcgccgtcacgagctgcatccgcgtcgaatccgcctccatctccaacttccataccacaccaacgaggaggaaacgggaagaacccgacctaacgagactagcccggctacttagctatactaggggaggggggacgacccctctccctcccgccgccggcgacgaggccgccggaatcgaggaggaagaggggtcgagagaggggatttactgtagcaagtgaggtttcgagagagagcgctcgtgagtcgtgagaggtttccgcagccttgatttctagttacacgcgcagcctcaaggcaccatctgattcttttcagatttcagacaactcgaataacttcaaatttcagattcttgcctataattcttttgcaatgtaaagaatttcaataagtgctgtagggccaattgtacaaataccatggcttgctgaactaggagaacctatctcaatctctatgccatggtcggaattgtgtatcaacgcaggaaaaagaaggggaaggagatggcgcacagctgtgattgtgccgaaccgtgaacagtaccgcgcagatcagcgtttccgttagcgtgacaggggagttagtttcctttaaatcagtaaattgttagttacaagagtaagcctataagagggcatccattcggatattttggatccatttttactatatctcactcgaaagattttttcttatctctcactcgattttctcacttaaatttacagtccattttcttgtaagttacattgtaatttatgaaacttacactgtaacttgtaacttttgtaagttacactgtaatttttgaatcttcgcatgtaaattttaaattttgtattggatttggtctttttattgaggatatggtaatttagtgtccattatggtgtttcttaattgctttttgctttttattatatctatcggattttaatctaaagattaaaaatctgtgtgatacgatcataaaaatctttcgaaagacgtataggtactccctttttggatatgcaatagattaatcttcatctcatctcctgtttctctcttctcatcccgtgttctctccggcgatccacgacggatcgccgttcgcgcaaactacccaaacctcgtccacccacaactcacacatatcccatccgttcactattggcgcataacaacttgttatcagagactgtggttcaggacgacacatccagcgataagcagccgctgctcgagccgacggatgccgttgccaagctgcaggacaccatgtccgacgtgctcaccggcttggggttgttggcgtccaaaagcgatcttgctgaccttcgtcgttcggtggccgtcgtgacatcgcgtctcacgtccctggaacagcaaccaggggtggcctcgtcttcaacaactccgcttcaacctcgcctcggcggctcggcggcgcgggcatgttgcccaacccgtcccaacccaatctgaacgttggcgcggcagagctggcggcgggcacggggacaggcgcgggaacgggcaccggaggcggcagcgttccccgtttctacaagctcgagtttcccattcgacggcaaagaagatcctctcaactggctgcaacattgcgagcagttcttccgccacaatccgctcggagaactcaaacgtctttcccagacggggaccgtggcggcatatcaggagaaattcctggcgctcgcaagctgcgtccaagatcccctgtcggaagggcaacaggtgcaggcttgcaatggataacaccaacgcgggctgctgctcaccagtcaccagcatgtgagtccgtcgctgccaggtgccagtcaaacccatcttctctcatcgcccacgcccctatacctcctgtccaactgcagcattgttcgctgtccatctaaagtcttacagctattcaccatacggttttgctgcattacggttctttgtgttgcgttgtgcagttcggttggagctggaggacgaccaaggcacaacagagaatgcatatccgagccaaaattatatatcagaaacaccaaaaatggtggtacagtagtttttttttttctgttctccactcaaccagtttggttggacctaactgactgcaactcaaagaagaccgacagttcgacggacggacacaagatgagtctcccactgctaacttttacatggcagacctaacaagatattgttcgtattctgtatggattatatgcaaaaagaatgcttttatggatatgtactccggttttgccattcaatcaaggatgccgtttcgctttcctttttatcctgggcaaatcttctctgctaccctgctggtacctgccatccatacaacacgaccatacataaatcacaatgcaacaagtctcatctcacataaatcacaatgcagcaagtctctcacagaagattatcaggttaatatgttatttgtctgaattggaattgacgagatacaacttacagattagttgaagcttcaggggacttgcgcacctgacgctgtgaggttgttgggcgtgctcgcatcagcagcacaagtgatctcattgagaggattgctgaaaacatagaaatgggcagatcaagcaattaattgttagtggatcaacacatcaacaaatatcagttctggttgacaaattctgataaactaatcgctgacaaatgcagaaagtgcatatagaaagcactacaagatgttactatattgcaggcagcataagtgacaacaagaattctggtaactcaaggatggtaaaattacccaaataataaagcattgtccttaaggagggatagaattggacctgctttatgcaaaatgccgatcgctacatatgaaaaacaaggcccagattctgctgtggtaaataacaacaaaaatgaagcacaaaaccatacaatctacctaacccaaattctggtaactcaaaagcacaagtaccaatagctaagcagatgacatattaagaacaagctataccatataatctacctaacccaaattctggtaactcaaaagcacaagtaccaatagctaagcagatgacatattaagaacaagctatctatctctctatactcattcggtaaaggcaagatatactgaaaaaataaagtcttatccttaatgacttatgattggctgattagtctcaacagtaacatgcaaaatttgccactaaggcactgacctcataaatcttgacatggcatcagctacctgaagacagtgaattccttcctcggtcataaactctggaagttcacatatgtttttttctatattcaagtcaattttgatatcattagagttaaaaaaaaaaactggcatccatttgacaaaatatatgaacaagggcattactgaagtttgcatcagacaggttgtcgatggttgggcaagtgcagctcagatcatccctctccactgaggcgtatacagctatctcgatggtgtctaagtggggatctagatgaaaaaaacacagattagtcacatttaaggctaatgcattgctcattgaagtttttttttttttttgagcaaggaccaaggcccccatttctattaccagaaatggatacaagctacaaggttcttacagaaaagaaagggaagaaaagcagctaaaacatttgctcattgaagtatatcatataattacttacgagtccagttcattgtcctggatagacctttcatctggtctttcctaagaatacggtttgattttgatctgttcgcgccagtctgtatgatttgacagttactctgatcatttgggcctcctaaataaattaggtagatcttcagaattatggcaatatatatgttatactaaaaaacgtaaggtttaacgtataagaagaaaattactcttggagtgtggctgtatatgatcaaattcgtagccacaacaaccatgtttgccatttagcgccttcaggacaggatttccgttggcatccagccgccaacgatcaccagatcgtccaatcaccttgggagcattattccagcaagcttctcttacatctgcgctgaatgaacgaggttttgcaggtgctgatgcacgtagagcacgggaaaacttggacacaagacgggaaaacagacccatgtcctgcagttaacatagcaatagcataaataatcccttgtggatcactccatagatttatcaatttagacaggtttgtaaaactgactcataatatttgataacacatctatcggtatctgtattgaatagccatagaattcatatcacaacatctaaaatacacatcaatacacaaacgtgcatcaccactgacccattagagatatgagtcgctaagtagaagatgtaatgtcaaattagctacatctgcagaaaaataagtgcaggtctaacaagccaatttagcagttaaattatgtgaactgtccattacaaacatatcaaacaacaggacatattggtatgccagtatcgcgcaccagcaagttaaacgtgccctcagcattaacatatcatcttccacaaacaaaaaacacaatccaggttgcagtgctgcactacactcactatctggaggaacccaactccgtgaaatacagcagaatgctacactaacataacatactgtaacacttacggcagacaaccgtaatttagaaaggaaaaaaaatcggacagagttcaggatccaatccgaatgggacaatatgcaatttccgtaacaactgatgcgagaaccccaataatgataatttcccggtactaggttgcaacattggtaaagtcagaagcgatcactagggaaatgcacaaaccctgtaaatccaactcccaaaccctataaaatctcgcacgatcaagggagacaaaacgcgcggaaacgttgcagcacacgggaatcgggaggccggtagcccagcaacttaccaaagtcgaacccaaatcggtgacaaagccttggacttcctggagctccgttcgcgttcgctcgcagcagcaggcctccggcgaaccgcggagaggaacccgcgcgcggggacgaatactctctccttctccgacgccgccgtgcgccgtcggagccaagctgatcagagaacaccacggatcaattagcaggtagcaatgaggagggggaggagagaaggggaggggacttgcctgatggggagaaaagttcgcccctcctgcgcggcggacggcggtgagatcgtctccccaatttcttttccccgccctagctcgagagtcgagagcaaatggggtcgcctaaattttgaaattcaaagtggtgggggtgggggccacatacaggcatactacgaggagaggcgcgtgaagctgaaagcagcccggcccaccgaacccaggttcattttttcgagtggagtaagttcactttgagtccctcaaatctctaataccgaattctgggaggattcgcgtgtaaaaaataccgaattctgggaggattcgcgtgtaaaaagccccgccacatggcaccgcgtggttccaacttcccccccccccccctccgacagtcgtacgatcaggttttattagcaaaatgttaaactccaccaatgataccgacccagacacccagtccggcttgcgcgctggataatctatcctgtgattttttcccatagggcacatgtattctttttagagtaattactttaatactaataaaatctatgtaaatatcatatattgaaaaatatcattcaatgtgtacttggttttatgtttgtataataccttcggagaattatagcatgacagtatacgcaaacaaacggtcactggtggagaaaccatctttcgtcggtcggccgaattccataatagtcccggatgcaataaaaaccggagctaaagatgatctttagtcccggttaaaaagggtaactggcatatttgatttttaatcctggttggtaacaccaatcgggactaaagatgatatttagtcccggttcaaatgctgttagggcctgtcaggcccccccggatctttagtcccggttggtaccaaccgggactaaagatcgtaacttaccaaccgggactaaagatctcggggatctttagccccggttggaaataccaactgggactaaagtcccacccctatatatatgtctttttcctcctccagctgcccgagcaagcttcaaaatttcttcaaaaaagaagggaggtcatgccaaaatttctagtgaatttattttggtgattacatacaaataggaggtgcctaaaaggtttgcaacttcatcctccaatgtttttctttgtcatattacatttggagctatgttttgcacacttttttgtctccaaaatttagttgtaagttgatgagagagaaaatttgtgtgggggaagaaagaacatatagaaatttagttgatttggtaaagaaggttttataaaatagttgagaaggaaaatatagtgaaagttagtcttaaataatagaaaacaaactaaaatgaaaattaaaagaagcaaaacacattaaaatttgtttaaaactttagaaatagtaaataagaattatttagtgtaatattttatgatttttgtatgaataaagatatgtcattattgtatgactgttgaaagagtttgtaattatcttataattattgtatgactgtcattattgtaagaataattatttatgtacgattttttttcgactcatgtagatggatcgtcaatggatgtacgatggccggcggtccaaagagtttattgacggcgtgcattatttttttgagagtggccgaagctaacaggcaaaagggttttatttgttgtccatgcaataagtgtaaaaatcagaaggagtattctgcatccaggactattaatttccacttgtttgagttggggttcatgccaagctataactgttggacatcccacggagagcaaggggttgaaatggaagaagatgaagtggaagacgacaatattccagactttgatcagtacagtggatttgaaggaaatcaaacgggcgagaagaaaatggatgctgatggtaacgacgttgcagatgatcttggtcagatgttgcaggacgccaaggaggactgcgaaagtgaaaagggggcccataaattggacaagatgttagaggaccacagaacgtcgttgtacccaggttgcgagcaggggcacaaaaagttggataccactctggagttcttgcaatggaaggcaaaaaatagtgttagtgacaaggcatttggcgatttattgactcgtcaagaacattcttccggagggaaacaaattgcccgagacaacgtacgaggctaagaagatagtctgccctttaggactggaagttcagaagattcacgcatgtccgaatgattgtatcctatatcgtggtgaggagtacaagaacctagaagcatgccctgtttgcaaagcactatggtacaagattagacgagatgatccaggagaagttgacgggcaattaacaaagaagagaattcctgctaaggtgatgtggtatttccctataataccacggctaaggcgtttgtttaggaacaaggggaatgtgtaacactctgaaaattcgaatgacaaaatcaaaactctaaaaatacagattttcaaaaactttttaaattaattgcatcatgtcgatcttattcgtctatttcatctggatttgatctcgaagattattaatcatgagtaaagaatagttaattaggaataaaccttaaaaacaaattggtaaaataaatacaaaataaatattaggtgggatagaaataaataaaatattatcgcgactatatttggatcaattaaatttgaatacgatggaataagaattaaccctaattaaaactcaaataaattacatgaaaataaaatatgagtaatattaatctagggtgaattcattagttgagataatacacatattgagtaaacttcatttatgcaagatttagaaattatagaatcaaattcatatagaaaataatataaaattgggaaaaataggaaaaagacactattcattagcttctaggtgttcgacgaggctccctagccccttcccctcccctgccatgcgcgcctcgcgccccgagccgtcgccgtcgccgcctgccgccgtgccgctgtcgcctgccgcgccgcgcgccgctcggccgtcaccgtcgcatccctcctcgtgccgcgcgccaccgctgccgccccgtcacctcccgtcccgtcgccgcgcgcgtcccatcgtcgctccgagccgcgcgccgccgctgccgagccgtccccatcgccatcccgctgccgcgccgctcgcccgtcgcgtcgccgtcgtcgccgcgccgagccccgtgccgagccgcgccgagccccgcgccgcgccgcccgctcgtcgccatcaccggccgccgcgcgcccgtctcgttgccgcgccatccgacgcatcgccgtcaccgcgcgtcgccgtcccgcgccgcgtcgcccgcccatcccatcgccgcgtgaccgtcccgtcgccgcgccgcgcgcctatcgtgttgccgctgccgccccgcgcgccgtctccttgcgccccgcgcgccgtctcgcgccccgcgccccgcgcgctactcgccatcgcgtcgccgcctcgcgccccgtacggatacaggatagtgtcataatagcgtcgcgatatctgtcacacagagttgttccatgatacgtgcgccgcagtgagatatgccgttcttcccctcttgacaaatccccccctctttatccattctccccaccccatatcacccttccttccctctcccctttccagtgcgccgtcgttcccgtgccgccgcgccgccgttcccgtgccgctgtgccgccgttcccgcgccgctgtaccgccgcttcggtgccgccgtacgccaccgtcgccaccgccgtcgttgccgctgccgccgtcggtgagcagccctccttctcctcctctcccccccccccccccccgcgtccaccgccgccgccgctcgggtaggagggagagccgagagagagagatagagccgagagagagagccgagagggagaggaagagagaaaaagaaagagaggaaagaaaagagaaggaaaagagagaaaaagagaaaagaaaagaaaaaggaaagggagaaaaaggaaaaggaaaaataaatagaaagatttggaagaaaattagggaggttaatagtttagaaaatttaaaataattagaatttaattatagaataatcatggtcctagaattgcaaaatttaattattcttggtaatttccaaaagaaatcaattcgcagtagtagtttagatataattaacaattagatgaatctttatagactactatagatcatttttggataatcttttaagtaatcgattcacggtagaaattcggacttaatcgctaggaattttagacgtatattatatttaatcatttagtcatagactaaattaaaacgtataatattataagataattttaggattccgtccgacatttagctcgcgatagaaatttctaacctattatatggatataatgctcgggtagattaaattaaaaacttatgacaacaaaatatttatacccgcaaaatagtttaaatcaaaattgggtttgccgtagcggatagtaaagttaataaaaaggaaacgactttcgcattcgactgtcatttggatttattcggattctcatttgaattctaaccgaattcaaatcaattcttgcacgtaactatagagcccgagggagttgcggatccaagcgaaggccaagacccgcaagaccttgagcaaggcaagtcatcactattccttgaacatgttgatcccaattgcgaaattgtttggtttacaaataaaattgcatgcaatgatgaacatcctacttgtgattatgccatgccttgattattgtttacccttaaatctttgtaaccatgtttacgtatgagtccctagtcaactatgacaattgcttagaaacgctatactagaatcatgcatactcatatttatcaaatgctatatgcttgggcaattacctttgggaaggtaattgagatgcggcatgtggagacatgtgcgccacattgccatgatgttgatgacatgatttgtgaaagaagaaataaaattaaacaattgttttcgactggggcggacggaggatttgggtggtatctgggaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctggtggagccacttcctgagaggcgggaatgtggacgtcctcagaaaaccataacgactcaatggcgggaagctatccttgggatcacaatggatggtggacagaaccgtcattgtttaatatgaacactggtattaaaactggatcagtttatgctaggtcttaggcttgtaaaaaaaattacaaaatttgctttgcgcaaaagaaccatagccatcctctgaattcctatgtcatgtgcatcattgctgtggtggcttgctgagtacggttggtactcatccttgcaaatataaaatttatcagaagcgggagatgaagcctcagaggatccctatgcctactatcaggagggagatgaagacgatggcgtctagtaggtcttagtacggtcgttgcctgtggcaatggcatgccgctgcctgaattccgctgccttatctatttctgcttttggatgtattccggaccgctcggtccgatgatttaagactatgtctgcgggcctatgatgtaataattcgtattagatactcgtgtatgtgcacttggtattccagctatgaattcgtgtgtaccaaactacttgatccagggaaatggtactgtttacacgattgattcctgttataaaaacgggggtcgacagaatgctagaatgatgcgatggcacgctgaagagcgtcaacaggatgggatgctgagacaccccgccgatggttcgcggtggcgaaacatcgacagaaaatttaaagactttggaaaggacgcacgaaacatacagtttggttttagtacggatggcatgaatccttttggagagatgagcagcggccatagcacttggcccgttacgatgtgtatctacaacctcaccccgtggctatgcatgaagaggaagtacataataatgccgattataattcaaggccccaagcaacctggtaacgacatcgatatgtacctaagaccactggtcaaagatcttaaactgttgtggaagaaggaaggtgtccccgtgtgggatgaggacaaacaggaggagtttaacctacgagcgctgttgttcgtaaccatcaacgattggcctgcacttagcaacctatccgggcagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggctgaacaccgtacgaagcctaaacatcgcaacgggaaaacagtgtttgctatggttaaagatcttaaagtagtgtttggaaagggtcctggaagccagccgatagagagcggagatggtcacgcggcgatgtggaaaaagaactctatattttgggagttaccctattggaaattcttggacgtccgccacgcaatcgacgtgatgcacctcactaagaacctttgcgtaaaccttcttggcttcctaggtgtatacggaaagtcgaaagatacactggaagcacgtaatgatctgaagcatatggaacaacgcagcgaccttcacccggaacctaaaggagaaaggaagccattacttgagtccagccagctacactcttagcaaggcagagaaggaaagtatgtttgattgcttggagagcataaaggtaccgtctggatactccacgaatatcaagcgaataataagcatgaaggagaagaagttcacaaacctaaagtctcatgactgtcacgtgttgatgacacaactgctactagttgtaataaggggtatccttccagacaatgtccgggcaacaataacgaagctatgtgcattcatgaacgcaatttcgcagaaggtcatcgatccggatagattagaagcccttcagaatgatgtggtgcaatgtcttgtcagttttgagttgatatttccaccttcatttttcaatataatgacgcatctgctttgtcaccttgtcaaagagatcagtattatcaggcctgtgtacctacacaacatgtttcctttcgagaggtacatgggcgttttgaagaagtatgttcgtaaccgtgctcgtccagaggcaagcatcgccaagggttatggaacagaggaggtcatcgaattttgcgtagaatttattgaagaccttcacccaatcggggtacctgaatcacgccatgaagggagactacggggaaagggaactctcggaaggaaagcaataatgacgatagacaacaatttattccgtaaagcccatttcacggttctgcaacaatcttcattggtagctccttacatcgaggagcacttggctctagttcgcgccaggaacatcgataagtccgatgcatggattacacggcatcacattgatactttccccgcgtggctacgacaacatctcatgggtaacgagtcgatcaaccaacaacttgccttcctggcgaggggaccgtctgggtcgatcgcaacattccagggatatgagatcaatgggtacacattctacacgagagcccaagacatgaagagcacgaaccaaaacagcgctgttcgtgtcgatgccatgggacacgatggaacaactagcacgtattacggtgccatcgaggccatatgggaacttgactatggtcctccgaaggtccctctgttccggtgccaatggattaggttgactggtggaggcgtaatgattgatgacagtgggatgacaacggttgaccttaagaaggttggatactcggacgaaccttttgtccttgccaatgatgtaacgcaaatcttttacgtgaaggacacgtctagcaaaggaaagaagggcagagggcctgacgagcctaagcgtcacgtggttctcccaggcaaaagaaaaatcgtcggagttgaggacaagactaacgaggattacgatcagttggatgggcaaccccctttcacggtgacgattgaccctagcatccttctatcaactgaagacaccccttactcacgtagcgatcacaaggagggaacaatagtgaggagaaagtacgtgcggtcaaccgtcagcgccgatgtattgccgtaattattgtgtacacaatgtaaactattttggatgtattgattaaatcaattgatgtatggcatatgttaattacgcacgattatttgaggttttaacaagtttaaatcatgtatatgctagttatatgcgataattacaatttttaaattttttaaatcatgcatgtggcatttatatatgttaattagagtttttaacaattaattcaatatcattcatatgctaattatatatgactattcgaatttttaaaattttcaaatcatgcatgtggcattcacatatgttaattagagttcttaacaattaatttaatatcctaattatatatgattattacaatttttattaattttaaatcatgccgtatgtatatacatatgttaattagagtttttaacaatttaatatcattcatatgctaagtatatatgattattagaatttttattaattttaaaacgtaatatttgcttattacgttttatccacttaatttattacagacagtactaattttccgtagtgattgtcattaatttttgtactttaaataaatttaatgcattattttctattttagaaacacatatgtaatggaaaataatactcagtgcgcttatcagtagtcccggttcttaaccctaaccgggtttaaaaaatttttggaaatagcgggaaaagatctttattcctggttga

SEQ ID NO: 79276 - DNA, 29339 bp, Oryza sativa
catgatggagttgggtcggtcggggtgtccggttgtccagctgccggattcaccacggtgcaagaggggaccgcccactgcctttttaggggtgggggtgaaaccttagcgtggtgtggatggttaagggagggttatgcggagggtcttgtcacgatttccccctttgcagtatcatggtgatacttcggggcatggcgacatgtgtggaatcgtgtcttgtgggtacagttgtacacctctggccagagtaaaactatttgaatagccgtgcccgcggttatgggcgatcaaccagattcaccgtgattagtctcaccctctagtttagcttaatgaactggtgtagttcaggtggttggttgagcctgttgcaacgtggtgtagcgttggacagtaattggttaatattgattaattactacaacagttttactgctttcaacttctgcttttaaatgctagctttgtgcaaatgaacccctagccttctttggttatatcctgcatcatacctcctcttccggtaagacttgctgagtacagtgggtagtactcagccatgctctcttttcccccacaccagagttgaagttcttcccagttggagctatctcgaagaagttggtctcgtcgctgccgtcaagggatgcctgtggagtggagtcggccgctgcagaagtcaagtgtccaagtctagctcgttttatctttccgctgcatttgtaatcttttctatttttgtaagacgtggatctgtatgtcaacaattgtcgtttgtgtaccctggctggtcctggacagggatttaatgcacatttagcttagaaattctggttcgtgagtttctgggcgtgacaatgatcttgtgctatattagttcatatgcatgtgggtgcatttggtgggcttgtctagccaagtgtggtgagttttctcaagtcccaaacaaagagagaagtgggcacatcttataggtttgggtagcctcatgtggttttgtccggtggagtatcctttggagtgtgagcccttttctcccttataaaagttgtgtttcttggatggattgttcatgtgttggataaccctttgactaagcttcccatagagtccaagaacgtcaaattccaagacctgagtcaagagatatcgccgttttactaacggtcggttgagctgaaaagtgacctgcggtctgactgcagcccttatagcggcctgaccgaggtatgctgtccggtctgactgcagcccccatggcggtctgactgttcatcctgatttagaaggaggcctcgtcttggcgatccagagccgccagagccgcaaccggtcataccgagcccctagcagtctgaccgggccgtggatggtctgaccggccactacactgcggtcagaccggccaggttgagtgggctcaatgattgccctgtaatggctagttaactagccattacaaagtagttcggcctgaccggccacactatggcggtctgaccagcggagcacagagttggggatttcgactccaacggctagttttggtggttcggggtatatatacccactccccagcagcaagggcaaagttttggcactccattgcattatcttgaacccttgcaagagctctcaaacccttgggcacttagtttatctagttaggtgttagagagtgagttaagccaatccaagtgcattgcttcattgttagagctagcatggcacttgatcatcctcggcaagcatcctagacttattacttttggaggttgccacctcctagacggcttgtggaggtgttgcttggtgacctctccgaggagattgtggaggaggcccggcaccggtgtgagtggtttggagttcaccaccttcggaacgaaggaagaattaccctagtgattgaggcttgggtagtcctctccgtgggccaactcccaccttgcccaccccttgacgaagggggcgtgcggtggcttcgtggttgagcggtggagttgggctcgcctgaagcatctaggcccccgttgttaattttggtaattaatgacaagcgctaattgtggactaaccgttgctattgagatatatattaagttaggttcacattatgtatgcgcatggatgtctactgatggattaaaattgacggcgcaaagcaaaaggaagagaagacggtaaactagtgttttcattttaaattgatcggggcgttgggcgatcaaaattgtgctagtttatttatagctttgttgtactattaagaggagtaatgacctagcaaagagatgattttaattgccacattaggtcattgcattttcacttgtgctcactttttcacaacatacacaacaccttgcattcactgagttcggcctgaccagggggcggtcagaccgaccacatagtggcggtctgaccggcgtgccctggccggtctaaccggccccaagcggacggtctgaccagcgcacaaggtcggtctgaccggcggcttatgggcggtctgaccagccccttggaggccgggatggtgttgctcggggtggctgatatagagccgacggagtcgtattcggtcagaccgagctgatggcggtctgaccgagccatggccggtttgaccggccactcaacgttggtctgaccggccaggccgatggggccctctgacagggctacaacggctagttttctagccgttgcagagtagcacggtctgaccgacaacatacctccggtcagaccggcagagcatagagttgggggatttcgcccccaacggctagttttggttggtgggagtataaatactccccctccagcagcaagggggctctcttggcacccaattcaattgcatacacccattgcacctctctcacacacctttgagcttagtgttcatccattgtagtgttgagggttgattagccaagagtcaagtgcattgcttcattgtagagctagtgtggcacttgatcatctccacaccgggtcatcgcttgttactcttgtaggttgccgcctcctagacggcttgtggagaagttgcccagtgacctctccgagaagattatggaggaggcccggcgccggttgtgagtgggttggagttcagcaccttcggagtgaaggaagaaccaccccgagtgatcgaggcttgggtagtcctctccatgggccggctcctgccttgcccaccccttgacgaagagggcgtgcggtggcttcgtggttgagcggtggaattgagctcacctcaacggggagtaggaaaccggcgagtttctgaacctcggtgaaaaatctcttgtctccttgtatcatttgattgtcgcatttacatttgtgcaatttacatttctaaagacatacttgagatcatatcaccctaggattgctaaacattgacataggagtgtgatttacttttctagagatataattgagccactatcaccctaggtttgcaaaacataacttagttgcttcgttagagttgaccatcaccgagcctagcaacttaggttggttttgattaggtgtaatttagttttaaatcgcctattcacccccctagtcgatatctcgatcctacatcgcctcaacggggattaggaaaccggcgagtttctgaatctcggtgaaaaattccttttctcttgtctcatttatttgttgcatttacatttgtgcaatttacattcatagagatatatttgagcttatatcaccgtaggtctgtaaaacttaacttaattgcttagttaaccttatatctcacattgcctagcaatttaggttagttttgtttaagtgccatttagttttaaattgcctattcaccccctctagtcgacatctcgatcctacacatccaaagcaaacgttgtttctactttttcagattgaccaaagcgcaggagcagagttttacatccctcttgcaatgctatacacacacaaaaaagaaacacagttcgctatcgttaattctttttttttctttgattgatgtgcccatcctacatcctgatatcagaaagggataatggatgtaatttcatttcctcatgaaatgcttcccgttataaaaaaaaccatctgatcaactatatgacatttatttacgatataatatctcaaatgcttagttaaagatatggtatgcgtacatttatcttggaaggtgctaccataatactatttccgtttcacaatgtaagactttctagtattgtccacattcatatagatgctaataaataaataaataaataaataaataaataaattaattaatatatatatatatatatatatatatatatatatatataatgtctagattcattaagatctatatgaatgtgggcaatgctaaaagtcttatattgtgaaacgtttcacaatgagctcattcaaataatagtataaaattaacgattaaaattctaaaattttcgatcatttattcaagatggaattcggttacgctgaacgttaaatattcgtggtcgaaaagggcgcgtacaaatccgagatcggtcacgcggcccagtatccacactgttaggaaacctccggcccacgaaggcccggcccggttacccactaattgggcccatcactaatatggaaagagagcatggcattgccctataaatagagggttggaggagagggttggaggagaggtctcgtacacttgagaatgcaatggatgaatgagaaaggatgtcacacccttatatcttgtgtctctacttgtgtagaattacgagatcctcttggactacttcgtgtagcaggagagttgcgtaatacgttatcagcacgacgttctaccggagaccgagaaggaaggagggtaagatctaatcgcgaaaacgaagtcctctcccacttctcatccatttttgcttttcccggagaaatccgcaacgccgacttgaagtcgccggtgaaaaccgttttgggatttttcggaattgttggccaagccgtgctcatttttcactgcgccacaccggccacggacgtcgcatcgcgctgaaacggcaagccggcgatcgcacgcgaagcctgagccaccgacgcacgaaccgccgtgcaccgacggcaccctgcaaggcgttgtagtacggcatactacgccactgtgccagggaggcgttggcaggagaggaagaaaaacaagaaaaatgaagaagaacaagaaaatgaaaaacgaagaagaggccatcgatggagacgacgtgccgtgctgggtttttcgagccgccgccgtgcgccgaccgcagcacggccacgcagccaggcaggaaggggaatagaaggaaagagagaagaaaaggaaagagaaggaggaaaaggaaagaagaaggaaaaatggaaagaattggtgattttgcacaaatgtccccgtgttttctgaaaatcatgcacatactcctctgcattggaaggtttgcattttaaacactgtattttccagaaaatacacaattaaccctcagcattgggctatttgtttgaatggccttcataatttgcaaatatctccaaaaatcatattttcgcacaaaagggaccacaggactctggacttcgaccctcaactttgcattccaggtaccccctttattactgacttatgtgattatgaaatttatttatcgcatttacgattattgattatttatgatgtttttattacttataattaatatcgttgcggtaaaattgtatagaatagcatagaatatattggaactatttgcgggaattttgtgtaccattatattgcaacacttgtgcattttaccagcgtttaatttgcgcatattgaataatggaagatgactggcatcgcgaattaaaaattcgctaaatctagaatatctctgacatatgcactcaatgtcgaaattatagtggaccttgcagctccattacataattaaacctagcgctttatttactgattcgacgagattgatcaagcacttcaatctctcgttggtgcctccaagctactctaggaatgagtatgctaaatggataagcgtgttggtactcttttgactgcacggaagaagcaacttacaagattatggcgcaaaccctatctctcgtagagcaaggactatgaacaagagtgggtatatttcgactatggttcactgagtagatgacccagagagtacggtaatacggtgcaccgaatttgcaccgaatactgcggaaactcttgatgttctacccgaacgcgacaaaagtcacacgcatgcatcactggtgcccatacgagaagtatgcctaactagttgataatagaattgcgtatcattcggcatagtgttcgtcagaagaacattgtcttcccaaatcacctagcacagttgataataaatttaacacgagcatctagcccggtgcacttacctcaatgaaagaagaggacaagggggagtagaacacatgtcaaggtgaacaatctaggaacatgaaaaggacaatcctaatagcacactcatcatgaattgagggggagaactcctagcctatttgcatggctatgaccgtagaatctcctatgctagataggatcggccgtaagatttatgccagaatagtaaagcattgccataggtgttgagcaagaaattcgctatgaagtaaattgaatccgatgtaccggaatacttcgttgaatcaatatacttcgtcatcacgtgttgcaattttttgaattgaacattgcatcaaagaaatggtccttgcccaagtagagcacacattttctctgcaataaagaattatttttagtataaaatagcatatttaaggcatttactattttatcactcctttctggcacatagttataatgctttcaattttgtgtagcgtccaaacataaaagaaaaatgaattgtggtccgcataaccacaaataacactttaagagaaagaggtatttccagacccatagaactggaaatattatgaccgttgctaacagcaacaactgaatttgtcgacctagaaagtgccatggtcatattacctatggaacaaatgatgcactttatagaagcatctattgttcgtcaaccccgttgaactttctaaaagtgtgatgatttgggctacaccttttagcaacggattttcaaccattccggtcttagaattataagaataaatattacaactcatatggtcatagcacatatatgcataattttcctaaatcatgaagatttgtgtgctagtatgcaccgataggagattaatgcataaacagcgtatagttctagcatccctgaactggattgcgaagaatatatgtggctcccatttggtactgtatggataaatgcgcttccgaagcagcaaacatccagtgtctcttagacaccgtgtctttgccaagactgattcaacaagatcacgtgaactccaatagaactcactaaatcatcttcagaagtccgcgaggacaatgctagcattgcatttgatgattggtgaattggtagcacgaagtaccaaatatccgcataagccgactaagtataagctatgaattgcaatatttactatatcattgttgtaatagccgcagtagaaaaggacatgtagtcttgaaagcagcggactctgaaagaaaactcagatcatcggcatgaacatccatcctgcgactagtgctattgcatctgtttggtttatgtgcatatctcactatcataatgcattgcaaaatgctctctccgaaagtcggaaaccttttacggagatagttatgaagcctaaattccttgacaaataagaattatttccagtcatttagggggagagaatgaacccctagataggaaatgtcaggaaatatgatagtagaaagggactaatgcatgttacaccgcactagtgaatgcagtttgcacaaagaattaaaactgccaaatcactttgtaaatacttttgtgactttgaagagtttgactaagttgcatgaatgcaccggaggagggtgaaataccgaagaaagtaaaggtatccctcatcttgtccagaggcctcgaacaaaaacaattggacaagaaacttcggctcctcacacccctaaagtaaccggagatgtctagtgaaaacagggcaagagggactatcatactcaaagtcacggaaagtaccccaccgaatagaggggagctagctgttggagtgcacactaacgctggtacatgcccatatcaagaagcattaagcaagaagaagaagaagaagaagaagaagaagaagaagaagaagaagcatatgaaaaatgcatctccttgtatatccatggatactcgcataaagaaattggcaatgagacctatcatcggcaatgtctcttttagacaacaaaactcattggcagtcaaccaggagttgaatggaattaatgaactagaagttgaaaagaactcaacctgaatattgataagcattgaagatagaatcaatggatgcatttcaggagcttggatcggacacttgcataatagtacatgaagaagtactaggttccgaaccaacatcaaaagaatagaataaatcataaaagaattgaagaaaagaaacttaatcgttttgaatttgagtttgatttgaaatatttggccgaatccaaatcatgcttacgcttgcaggtaaaggcatgcgacagatggaagtctagtacatcagtccaactgcacttagaaatgttcatggtgcatggcttttgaatagtcaattatcgtcaaaatgggatggaattcccaaacacaagtgtgtcatagcagcacatgaatatttggctaattgaactaaaccgaactaagcatcgttgaactgttcaaagcctcgatatggttttgagagatggttacccgcaacagcaatcgcgatttgaaaactatctcaacccccaccatttatgaaattaaagcagcatatatcacacatatgcaaatgagttatgtgagtagcaaactcactaagcatatgaacccccaagctcttctatgtacatgaattgcatagaagcgatgaactaagtcatgtgaaagtcttgcagattcatccgctaactcattattgacatcttcattgaataggtgtgtccgagaaatcggaataatgagacttagagaaatgcaaaatttagggggagaatttcgccgactcatttcagaatcttgatatagaaaatcaagtacccaaaatcaatctagaaagattgaacaaagaattgggtggattgtactctttttcccttgaataagttttcccagcagtttcttattaaggtttttaacgaggcaattcgtgcgacattgcaagtgtatgctatgtactctttctccaaatttttcccactgggtttttgtggagttttgatgaggcataggcatcacgcagcgagagcccaagggggagtgttaggaaaccgccggcccatgaaggcccggcccggttacccactaattgggcccatcactaatatggaaagtgggcaaggcattgctctataaatagagggttggaggagaggttttgtacacttgagaatgcaatggataaatgagaaaggatgccacaccctcatatcttgtgtctccacttgcgtagaattacgggaccctcttggactacttcatgtagcaggagggttgcgtaatacgttatcagcacgagagaaatactagtatgacttacattgtgaaacggaggaagtagattttataagctcattcaaatagtagtataaaattaacgattaaaattctaaaattttcgatcatttattcaagatggaattcggttacgctgaacgttaaatattcgtggtcggaaagggcgcgtacagttcctagatcggtcgcacggcccagtatccgcactacaaaggacaccagtgatccgaagtgtagcccacgaccacgatccaatgactactttagtgctctctacgctgccgccccaactctcagtgcatcccaccggcgaccacgtggaagtgaggaagagagatgcggcgagccaaggcgaaacaagaggatcttccatctgggtgacgatgcttccgacggcggcgacgaggaggacagctcgaacctgtgcttctacttccccgtgcaccactactccgacagcatcccccttcaccctatactgtacaaggtggatccccccatccctcgacaacgacgacgaccacgccgccgctactctttccaccgggtcgctgggctccttgatcgttggagttggatactgttccgatggttccggaggcgacgagaccatactgttcaacaccctagaccgagggagaaaattgcaattataggactccaaacaatgcgcttcgcagttataggaccccaatcgtcgacttcgctaaaacgacccttgaaacgttggcactttattttacatgacatttggtccttttaatcacttttctcaactaagatacatgtattttgccctaaagtgaccgtattgcccttctgccttctgtatacttgatcgatggtatcttttcatctcatccgactccgccgttgttcctccttccctccccacgccgccgttcctcctttcctcaccacgccgccgttcccttcccatcctcggctcccatggatagagtgtcgccgcccgaagatggagatggacgcccgatcgccatggaaggccaagcagtcgaagacctggcggcctctgccctagccgctcggggtctggtcacggcgcctggtggcctgggcgcgccggctgatgccttggctgtggcagccaatggccatgtatagtagaacgccaacgctagtgctgtagccgctgctagaacattgctgcccaatgctcctcttccagcaatggagttcaaccttcctgttcttcaagtgcaaatgtattggttgcactagatttctgttttttttaccacgatagtagtaggcagtagtaaaacttgatttcacttgtttaggtcccaagtagatcatgtggaaaatatggaaagagttgattggataacatacacatggtcgagacacatgatgatgaaggtcgtattgcacttatgagtcacagatttgtgagcttttaggtgtgatagaggaggacacaacaaatatacctgcacagggctttgattgtcgaatgtatgaacatgggcatgatagtgagcttgggcaaaataatgatggtgctgccattcctactagtgatgaggtaccgggtgagatgctcatttcatatgataagaacaacccatccatggctttaggaacaatgtacccaacaatggaggagttcaagttggcagtgcggcaatttgccattaaggaggagtttgatttaggagtagagaagtcatgtaagatgagatatagggcttattgcaagtccggtgatgaagattgcccttgcacttggaggataaatggcaccaaacaaaaaggccaaagcactgtggaggtaaataaatttattttttctttcattaattctactttttatgtaaattaacatgaatctctttgattttttgttttgcatgtaactgtcgtagtcgatgagcatacatgtgtgtctagcatgaggcagatagctacaactccaactctgaagtgggtagctagcaaggctgtgagtatccttagagatgatccaaatattggtgctaagagattgcaaaacaggttgcagacagatcacaagtgtgaaatttcatatgacactgtatggcggggtaaagaaagagctcttgaagaggtttatggcaaatgggaagagagtgttgagttgttgtttaggtggaaggccgaggtaatgaagcggtgccccgagagtgtcgtttaggtggatggtcaagtatatttccaccgttttttctgtgctcttaaaccatgcattgatggtttcttagaaggttgtaggcctcatttgagcatagatgctacaacacttaatggagggtggaatggtcacttggccgcagctgtagcagttgatggtcacaattggatgtatccactcgcttatggcttcatagcttctgaaacaacagacaactggcttccataagaaatattgcatacaggctacctgaaggcaggatacttccagctataatgcatcagctaaaggcaaatactagaggcttggggcatttgaaaattgtaccatgttctaattggagtgcagaggtgtgggacaagagcagcaacgttgagaggcatattgtcaagttacaccaaaggacctgtacatgtcttgaatggcagcacactggtaagccatgtcaacatgtattggcctatgtaacccgccaacggggagttaaccttgaacagtttgtgcataactactactcggtgaatagattcagggctgcttatggaagagagattgagccgatgacagtcaaaactcaatggccacaagttgacctaccatttttagttggtgcgcctcttgctaaattacctgttggaagacgaaggaaactaagaaggaagggatggatggaaggtggccacaagaaaaatggttccaaagatggtccatttaccaatgagagtgaaggtgagaagggaggtgacaatgatactgctccaacaaatggaaagggaaagaagatgatcagaggacctatgacttgccaaaaatgcggagaaaaaggccacaggcaagctagtgccaagtgcccactcaataggacagcaaaaaagaggtaaggactgattttatttatcaaaaaacttaaatgaaaatgccaatattaatttatttgattacttgtaggaagcgtaggcaacctaggaagaatgttacaaaagctgtggcagcagaacctaacactccacggaagccgactagagaagaaatcctacgggatagtcagaaatattaacatatttactgtatattaattttttccaaacatctaattgtcatatcctatttatgtgtagcaagcttgcgatgttactaggagaaggtatatcgtcacaaaccaacaccactagtcccgtgaggatacctaccgcggcggcaccaaaaaagatgactccaaagagaaagctatacattggttgaataattttagttgtgatgagatgtaaactcatactttatttcatatgacttagatttcgtttggaactaaattatggtcttctgagatgaacttgtttatgctagaatctcggttttatgagacaagcttgtttgtgcaaaattcatggttttatctattacttgtaattgagatctcgttgtaattgcgtatggatcatctttgatcatctttcatttattcattgggttagtgttgcaatttttgtgcatgattgaccatgtacagtacaattttggggcatatgcagctggcagctgcagcaagttcaagagcggctagcagcttaccagccatcccaggcgagccagtgctctagccatggacaggcggcggccggccagccatcccagtcccaggctgcggctagccagccagacgaccggctagcagcgtgggagcacgccaattgaagctgagggaaatacggtcacatcaaggtgaaatacatgtattttagtagggaaaagtgattaaaaggaccaaatgtcatgtaaaacaaagtgccaacattttaagggtcgttttagcgaagtcgtcaattggggtcctgtaactacgaagcttattgtttggagtcctataattgcaattttctcagaccgaggagctcatccgcgggctgacacactatgtcccattccgtccctgatttgaataggcaacatttaggctgtgtttagttcagcgcaaagtttagattttggttaaaattggagatgatgtgactgaaaagttgtgtgtgtatgacaggttaatgtgatggaaaagaactgaagtttggatccaaactttatatctaaacacagccttagtactctacaaacttgggaatcatccctttttctctgcgaagagagcagagcacagacatgtatttgaaagtaatctatgaaatttgggaaatgatcgatcacagacgcacaagcacaacacaagtatcatgccgccaaaacttggctgcatcacccaggatttagcagccacaaacttttgcaatacagatcacgagccacacagacatcacacaagaccacaacctggccacatcctgaaacagaactgagcaagatcagataaacaacaccagcagcggttcaagtcacctataaagatcaacagcagttcaagtaatggagaggtcaataattagcggtggcgccatggaacttccttgtttcagcgatgacgtcggtcatcaataatttgggcgacccgctgttgtatgatgtcgtgtttttttttttttggaacgggatgtgcaaaatgcagagggatgtaacacaggtcaccgggccggacaaattgtgtgggtcagacctaattataacatgcatgcacgtagatgaactgcacctctaaggctcttaacaccttccaatagtatctcgtctgaccttatagctagggatcggtgtaggccacctgtatagccaaagaaatgggttgaatgtaaaggagaacaaaattttatcaacaacaaacaaaatactcctacgtctacaggagtaaagaaaaaggaagtcacctgttatagttaaactcttctatcaaaccagcagatatagttttctctatagtgcttccatcattttctcgctttataacaatctagtagaaatttccataattgtgaaaacaagtttactgattattaacaagcacaacatatgacagataattctaacatgtagaacaatatgacatcatgagctacctcaactgttatccttttcgctgaaaaatcaccattggtttcttggtcatactcttccatagtttccttgcatttatccatcaacattgcaccgaactggtgccattacaaatatggttataaacaaaagcatgattctaatcaaaagttcacaacatatataaacaaaaaaagcagtagctgactctggaaattattaaaacaaattgtcacctcaggggcagtagagaggaatttcccaccacatttcatgagaatatcaccctgacatattccagcaatatcagcgggtgatccctcagccacctaattgtcatttttttattcagttcatctcgtatatacattgagcagagaaacattaagatggcaactatagctaaaagaataacactgctataaacattctgaagaccataaaatttagataatgttaaaagtaataattaggagaaaaagttgacgaattagcagcatgtattaaaaaatgcacttgaatataagctagaatggatatgtaaagttgtatacagttactacattgaaaaaaatagcagacacaacatgttaagaagcttgttaaaaatctaagtttttggtacccaaagtataaacaaatgttatagagttctcatccaaatgttaatgagcctctaaacataatttacaaggaatgacaatatataaattttaaatacctattctggaagtccacaaatctagggcaaagtatcgcaaaaataaacataggatagaggaggttcacacatttgaaatatataggccattatcaacatccgagaattttctgtatatgtgctctagatgactaagcggaaccatttgaatagaggtgaaccagaatccaatccaaggtcgaattattcttctgtaaaaagtaaagaagaatattactataatgcagcagtaaacataaactaggcaattgtataataatgtatagaaattaacaatcaagtttttgaccttcacaggtaataaagtaaaaataatatcaggataaaatattcatcaccaatcaccataaggactggacctacccaaatatctggtgatgttccaagcatttgaaaacaattgccatcgaaagaaatggcgtttggttctcttcaaagaagttaatacctacaacatggccattataatttacaaggggtcccccggtgccagcctagaaaaaaggaatcacaataaattgtcaagatatgtacacgaatagcaagaggtaaaaaagggaaaagtccatgtaaaatgcatcaaagaacatgcaaaaacacgcagagtagaggaggtcaacaaaagaaacattttaaacaaaaatatggattgcacctccacgaaatattaagtgttcacacaatttgctcagttaataaagttgtgttaccctggccctaattatcaactaatctcagtagctgagtttgcttcagtagatcaattcagtattaattcttagtgtccaaagaaaaacaaaacaagctttgacaaagcaacaacaaaattatcctgtctgaatggagaataggtattcaatttgaacaagaggaaaagaacagtacagaaactagatcacactgttggatgatgctcacatggaaaaacactggtgcatccggcaagagtgagattctctagcaagttaactagagaatagtgaattctagctacctttgaaaaaagaaaaacattgcatacagaaacctttgacaaaatgatattcatctatggaacaatctagctataggatgtttggttttttaaaaaaaagatgtcaaaggatccactcaatcctactctctacttaacgagttgtttggtcttggaaatgccatgggtcaatcaccaaacatgcctcaaaaccagatgtgaaaaacaatgaattggtgggttgtcccaccaaaatcatgggatcatcctatgatcaagcaatctcatccaccagcacagaaatgatttgattcctcaaaacaaacatcacactagtaactgctggtaaaatgatcttaagagacacaggtcaatcatgcttagaaactattcacacagattgatgtgatggacgatgcttcaagttccaagtgtttcaactacttaaaagaagacgataattaaacattcacatagaccaacctgctctatgatggacacatcagcaaaaatgaaacctgaattgttcagtactgaaagacacagagaagcatataacatcatctcagtattgacagaatctataaattgagaacaaaaactatttcacagaataaaaccacagaaacagctgacaatttctgtttggctcttctatatgtgattaaattagttcaggtagtttttggatgccctatgcatattctgatgttcattcaagtttgcatacatgagttgtgtgaagattgtgtgtgctttagtagtaaaatctgaacagagaaggaattaaaagagtctcagttaatttgaatcagtagtttgcataaccaactaatgaattaagcaaggaaaaaaaggcatgtatcatatcggcaacaaagagcaaattgtgttcagatattatttaccattgttatctcgcaacttgatactaacagttctgaacactcaaatatgctggctctgttgcttatttctccccttgagcacatcagaagaccaccttcataagaacggccaagggctaaaacatctcccttgtcgataatatatttaaggataacagcctcttgaagcttgaaattggatgtgacttcaactaaggctatgttatgatggaaatctaccatggaaatctggcaaatagatatatccccactaggtagaaagacctccacctaagtaagtaataaaaaatcaggacaaaaataaattgtgggtggtaacatatttcaacaaaaaaggaagagtaaatttcataaacgccatgtctggggcccattggtaacaagaaaatagtgcaattttgtgatttttatcactaaaccacatgttttgtggcggttgtttcacaaaacccagggtccatcctagtcagctgttgcaacatattaggcccacctgcaggtgccacctcaatagccagcctggcaatctctggaaaggaaccacctggctggccaccactccacacctcccaccgcagtgccatttgctatcaacgacgattgctgtggctcagccttgccgccgcagtgttgtactgcctgttggttgacaacttcttcccctaaaccaccagcacaagctcaagctctgcttgtttgctttgttgatgatctttcctgtccgatgatggttaatgcttttcaagactcttgggagtgtggactcggggatgttaagaacaatgcctctgccaggccggaggactgcataattcaattggttttaacatctgttattccaaaggaaaatggtagtccagtttgagatggttcaattgcttttgctactgcttgattacacggtaaggatatgcatggttcatggcaggaggttgcaacgattgagctgggttctgtgattttgtgaaagactgcctcaaaatatgtggtggttatatgttaccagtgcccccaaacctggtattttgtgaaatttacaccccctccccacaaaaaaaatagaaaaaaagaaacttattacttaccctgacatcatctccgcatggaggtctaacaagtgctgctgaggttaatattgtaccaatgctggtactatcgttccaccgtatcacaaatcctgagcaaacccgtatcctttttcgacctgaattacataacaaagttagtggaggtctaagatgtatgttatgaagaggtttgtttctagaaacaaaaatacctgcaaaggaagataaactgacaattgactgtgaaacacccaaagcaacctttcgagcaacttggcttttagcactaccatcatcaatatcacaaaatgtatcctccagagtgagaattggaccctcagcctgaactccaactagaataaaacattattaccgttagttactcagacagaattagaatatcaatagctttacttgcatataattttcatgcacaaattgcattccagtagaaacatgagttcaattgtgcctccctctatacataaaaatatgcatatgcttccatggtacttgaaatcatgaaaagcttcaaaggcactgcaagtaatacatacagaaatgatcttccatgtctagcatataagcaagaaaatcctagcaatatattcatcgataagctgaaaatcctgaattagagaacatatagaacaataagaggagcaagctggttaatctgtctagccgatactccattatatgaagagtaaattaatttgacaaggcacattcatatgccccggtatttgtgcaagcaatgatttccctataggctttgttcatcaaaatccaaatttcttgggcattttatcacagtttttagtgatgactatatatctggagttcgacgacaaatcctaataacatttaaaagtagagcaggataggcagagatgtcatacatacttcgttcagcgattcggccccttctctctgcctcgacagcaagcatacggcgaatgtttatggccagctgagccctggcctccgccccagcggcggtggcggcgggctcctctgcagtggcgggggtggcggggggagggcgcggtctggtctccggctcggatgaggcgccctcctcctcctcctcctcctgctgcagcctcgtctcacgggcgacgacgcgccggcgcttcccccgccccggctcctcctcggcatgcgcctggggaggcggcgttgcttctcccgtgcgcagcgtcatctggggaggacgcggattctctggcgacgatttggaggcggcgaccggcggcggcgagcgtgagcacgcgttgttcggccggcgagagcagaaccgcggggtggcgatcggaattctggtcggaggacaggtcggtgcgtttgggctagtcgtaggcgtttcttttttttttctttttcttttttttttgacctttaaaccgtgtgctcagcgatatcacgagccacccagtcgcttacaaactctgggaggggtccaaccaatgaaccaaacagcagattgagctaaattatgaccacacacattacaagatcttggaataaaagaaatatcagccttgacaaactctaagggcctgtttatattataggcaaaataaattttatcaaattttagtaaaattgtcaaatatgtgcatctatttagtttttaaacaaactctggtaaatacataaaaaattctgccaaaacttagcaatattgccaaattgacaaaattttggtattgccaaaatttggtaaggttcattttagctacaatctgaacatgtcctaattggatgaggagctttattactcggaaaataggattgctcgcagctggctcatagtcctgcgtttttagcgccgctactagcattgccgaatcagattcgattccaatatcaactattcactgcactacaagggctcgcagtgcagcattcgtccagctccagcaagtatcaaggttcaccttaccgtttttggcgtggttaccgcacccccgcggttaccgcgaaaaccgcgtggtaaccacgagacaaaccataatttcaaaaactgaaatagttaccgtctatggtaaccgtgataaccgcatggttaccacgcggttttgtaaaccctagcaagtatacagcatccactatgatcacgtaccacaaaaccccatcctccatctttggttgcttccaggtaggaaccatcaaagttgagcttcagatttccctccagagctggtgaccagcttttgacagcatgactgccagtgttgctcttctctggccatagaaaataacaagggcattctgtttatttgatttgattttgaagtgattaattaagaaaagttgaaagaggcaagcgctgggctacatgcattggctattattgatttatggtgtgcatgcattagcaagtattagtatcattctacagcacaaggctgcaagtatgcagtctctattgtcttcttgctttgcccgctgtgtttttttagataatggattaaaccagcttctacactcaaagaatgtacacagcctgctttgcctgctgtgttgagggtacacttaactgaactgaggggattgataaacataggattactatagataaaatgatctttggaaccgagtgcctaggaaccccattctcaatgtagctccacccctgggggttctagcttgttcacccacatttatcttatttcggttatcccaccagttccagaggagcaagattatcttcaatttaatctgaccaccagtttcttttttctagttgaatccgtacaattcacaacaatattattactattcgggtgaaactgcttctacgttaatctatgctccctctatccgtgaatataagggattttactatataataaaaggatattatgtgattggacaaaaagtgatgagtgaaagaataaagtggtaataaaagttagggttaattagatccatgccattacaaatatgtcaatttagaaaaataccactacatttcgtctattcgtagtcgtgtcactaaaattttacaaaattgaaaccgtgccactgccgtcacgttttccatccatctcttcttttttgttcccatttgcttcttcctctttccttttcttcctttcactttctcccctctcatgcctagtgaagcccaggcctccactggagctcctcctcctcctccgacctctagcctcccttcaggcgctcctgcgcccgcccactcgctgaggacgagcagaggatgtgatgcgaggaggacaagcaagcaacggcggcgcgaggatggcaagtggactacggcgatgacgcgagcaggacggatgggctcccaccagcggcttgaggatggagagtggacggcagtggcggcgacgcatggaggacgaccggacgacgccaacgacgcgagaaggaccagcgaacactggacgacatgagggtgacgttgttaggtctcgaatctggccgacgatggagcttgagcaggtgacggaactctagagggatggcctcgacagatccatgcgggaaggctcgggaatagctacttcggcagcccacgaaggaactctggcgtagcgacctactccgatgggcgggcgtttgctcgtccgcgtcctcctcggtggacaggcgggcgagcaaaggagcgcttgaaggacgttgacttgctcggctggagtagtagttggtggcggctaggctttggagtgatactcgtaaagcggatgattagggtattggggtacgttggaacgaggatctatgtaatacgatatcaagcaaatagaagacagagattatactggttcaggctccttatcaggtaatagccctactccagtttatataggattgatgatggaaaaccacatattacaatagaagtagacgaaatcaatgataccgataagatcgtagtcgtggtattcgacgagatctcccggcgacttgacttcgtgtactccagcttcataagctatggtgggtgtgttggcgatgagattcgatgccttccacccctccctaggggtccttgttataccgtggatcatcttgatctccaagtaagactcggagacatcggatcttgtataatataacaaaaactctatcccctccgagcaggactttggaaatcgcttgattcgtagagatattttccataatttgtaacagattcctacggcgtacacgggaacaatctgtgtacgtgaaggtatgccatatccgtatatttcataagtcgtaggataggaggttgttaacaccaaaattttgtaaagcccgaagtcaccatagacctggagtcagtgtcagcttcagagtcctaggatcggccgatgagagttatcaagtcgccagttgtcgaattcttactatattcggttaagaaaattaatctattaaaggaaacttatctagaagtgaccgagttcaaggaggatacagcatgacaagttatctattaattaggaatagtttgttagtttccttttatctttgggaaagtgtgtttagtgtccaataagaactttatgttttccttttatctttaggaaagtttctttcttgttaaggactagtatctacccatgggtataaatatgtacacccagggtcattgtaagaatctctcgatcaatacaactactcggcgcatcgccaccctctttaccgtggtttttacttaccatccggtggaatttggcacctgatgcggggctgcatcggttcagttcgttctccggcgaaggggtaagtcctacgttccgccgaccctggtgaatctgtcggctgtattggtgttgttcaaggctgcatcgcttcgatcttttggatcactctagtttggttgatatatttgcctacctgatatcttagtgctatctctaattgcattgtgtttagagacgcatcggtttagttggaactgtcttggttaggtctgatcttctatcttagctgatatatttctacaatcacaatgctgttataaatagatttgttatatccatcacattagacagatctatcggctcatcaagtattagattaccacatataatgtcgtgctgcatcggttaggtccgacctactagattattgttgataatataaatcttgttaagccgataggttcatgctaatgttttatcaggttgctagccgataagttatctggacattgcatcggcttataaggattgcatatacatataagttggatttagccgatcgcaacaaaggtttcattgatctatctaatcttgtggattttatgacatcagacctccaaccgatgtatgctttaatcttcggatcgatgcttatctatcatatcattattagccaattggtttctactggattatattgttatattttattatatcagccgattgccttcatatcatcatctacattgaacatatagccgatagctcaaaaccctatcgacatcggctgatatcggcatcggctgggattactccatcggcttgtcagccgatcggctgtttgatctgttgtttacatattttgtcagttgcaggatgaaactgactggcacactcgcatcccaccaacctttggacctgcactggagctaaacagatatatgccagtgtgtgtttttcgcatcaacagatatatgccttatctgtaaccatgacagcggggggaatgagacgaccgtcgacgcggtgcagctcgggctcgggctccatggctatcgccccactcgtgctcgtgcggagcggatacgcgccctactcgccgatgcccttgccgaggagctcccctcccgcatcgccccttccccatccgccgtcatgccttcctcctcctcaaaggcaaactttggtggtgttctttttcttttaaagatgaagatgaaaatgaagattaagttttttacgcaaaacgaggtggtattaacgtatgattgattgagttttaattattacaaacttgaaaaatagattaatatgatattttagagcaactttcgtatacaaagttttcgcacgaaacgtaccgcttagcagtttaaaaagcgtgccacaaaaattttaatcttcatccaattcttgttggagaaaaaaaggaaccaaagccgttggtttcatcgggtctgtccgttgttcatcaaagcgctgcatggcttggtccacttcaagaactaattaacaactaattaactcatcataattagctctgctaaatcgcttaacgaccgattgattgatagtactccctctctcccaaattatctcctatatatttttttacacggtcttcaataatatattttgatcggtattttattttattctgatcccaataaatatgaaattagcatcacataaaagtatattaaaaatatgaatacagtgatataacatgcataatgttttgtctagatatagtaataattatcagtcaaaagttaccgagtttaattttccttaaagttaccgagtttaattttccttaaaagagggagtatagctagtcctatcttactataaagttataaagctatagcccactaattctaaaactcaatatgcagacatgccacctcatcatccattagcaataattaaatacaaaacttatgcaagtatacaacatcatttataattcattgaattctacaaatcaacatccaatcatcttccttcacattatttttcacaatatttaacacacacacatatatatccatcatttttgtaatatttaacatatatttatccatataatcaaagtgcgtgatatcatatttcatctataatcttatactgagcctactaaatttatctctcttaatattaatatagtttgacaaattagttttatttgttattaagaactaatataattttttacttttagctcgattattaatttttttaaaagtcacatagtaatttctacaacaaagcgcggagaatcacgtagtgaactaaatgtgccagtttgttctttaattattgacataaacaaatagctcttcttgtacaataaaatgtactgctaattattactacctatattttgtaagctaatcgatctcttgaacaccggtgacataattttgaatgtctcattttttataattaccctttctaactaactgttacgaaaatttaaaaccataagacaatgttttgacgatatatctaccaacatcatcttcacttcacagttcaaattatatatatatatatatatatatatatatatatatatattttacatctatcaataatctagggattctaaatttttttaatatttgattagacaagtgttgggacattatctattttgcagatcaatccatgttttcaggatagataatggttagctataggaagggtaattacagaaaatgtaaaaaaataaagacaatgcggatgaaaacagataaacaaaagttgatgacgtatagatgcaacggatagaccagatgaagccaacggtaaaatttgcctttagcctcaaaggcagttaggcagacgatgcagacccaccccgacctcccaagcgcacgcctccgatcctctcgccttagacctagccgccgccgccgccgccgcctccgccggaaagtgagccctccccccgtcgcgcacacacaccccctcccgattccggtgggcgcgcgcgggggagacaaccaaggtatacttgggctggcctcctccccccctcccgatcgctcccttcgggaaggtttggggtgggggaggccgacgccgtcatccgttccgggcgttggttgccgctggcgattcgccggcgggcggcgttgatcgggccccgggcgggggctccgggcgccttcgctgtgggggttttaggatcggaataccgtggaattgtcgtggattggttgctcgtggatggtgtgtgtgtgtgtgtgtggggtgggggggggggggttagggggatcttgcggtggcgctctgctcgtcggatctctcgacggtgttgggtttggtttgtggggcgctttggtggtgggtagacggtagcttggtttggttcgcgggttgttgttggatcttgtgcttgctgcctgatgtgcgtttgcgtgcctacatccttggaggggtggttgcgatagggcgatttcgctgtacggatgcttttgctgcgcaatcggattggtgattaggggtttggaactccgtgtgatgcttctgctgatgtgcatgcatgcggatagcatgtttatgttgtttttgcggtaggattgcgtgacaaatgtggcatgtattttcttcttacatgattgtcctttttcatcttgtcttcgcgtgctacacttccggcccagatgtaatataggtgcatgtttgcgcgcgctttagtatgaaacagcttaccaaatgtagcacgaagctttttgttactctcgaatgcttccgttacctgtgctgtaactgttgcatatgtttgtgttagtgctcatttaagcgtgttatgaactagaaatgcttagtcaattccaacaaaaagttcttcttagatgattattctgccattgtgctgctttagctgtcactgagtttggcatttccactcttgcagataactctacccaggctgagttgtggctggtattggcgatataagcttgttagctgttttctcttgtgtctttggtcttcatctttgattacgcgtcattgaaaagactgtacatgagaaaactcttttgttgaaacatttctcttgtaatatgaatgtattgagtttgtgactatccttctcctgtgctagaatcatatatttcagcttcaaagctcttgtggtacttttcaagtttcctgttgaaccgaatacctagtgcattaactctaagcttgtgacaaacattcatgcaaattcgtggatattaacattggatacttggtctactggaaaattggagctccttattcatgtcatcaatggagagcctagcacagttagagctgttatgtgaaaagctttacaattctagagactccgctgagcgagcacatgcagaaagcaccctcaagtgcttctcggagaacagtgactacatttcacagtgccaatatatattggacaatgcctcaacaccatatgccctgatgctggccagttcaagcttgttgaaccaagtcaacgaccgcagtctttcattgcaattgcgtcttgatatctgtaatgttccttaccaaaaatttatcatgaaatcagttgttcacctgtttttgcttttctattgcatctgcatggcatgttttcatttacgtctctaccaatttattcagttatgattatttctgcattgcaagttaccacagaaagcagtaagcactcgtttgtactgctatttagtataagtggccatatttaaatctttgttgttccttccttgactcaacttatttctgttgcctttgatgtcttatgcttatttaatatggctcgagttgaacaaacaaatatttattctttgcattctatccttgaattcatttatgcctctgcagcatgttagaatggccaaatatttatttccatttacccactgttgttttatgcatcggtaatgtagataaattgcaaaaatacatgtctataaacaatgcttaaatctattttgtgtacttttgtgcccttgtctactgctaattttaaaccaatatattgtgatctgtttgaagtgaattatgtcataaactatcttgctatgaggggacctaaactgcagacgtttgtgattaaatccctaattcagcttgtctgtcgaattacaaaatttggatggttcgatgatgataaattcagagatattgtcaaggaggcagctgatttcttatctcttgtaagtttgttgtctgttttgttggcatttagttgagagctttttaaccgttgataacatatttaaggactatgtaccttcgatttgagtggagctatacaccttggtacataaatccttggcaatttctatgaccaatgcccgttctttagaactaagtaatatgaaaaaggataaccggcctaccagataaatctacataagaacctgatttctattaaagaatccatatgaggaacagttataggttttattccatgctctattgcgagttaattgatgcatactaaagttgctgcttatgcttttcatttcaggcatcccaggatcattatttcataggattgaagatactatatcatcttgtaggagaaatgaaccaggtgccacctagaaacttctctattattataattgttcaataactattgattctaatcaataagataagggtacccataagataatgcaatttggcaatacgtagattaatttaaaagttgaaaaaaaaatatttcaacagtattttttttgtgtttagaactgcacaacgtgcatggtgttgttggcacttataaaacatcggatgaaacacagaaggtcaaacgtacatgaaacactacatatgcactaacttgtgcatgaatcaattaatatcataagtaaaagttgttctttattttcctttgcgacacttaacaaagagttataaacatgcagatagacatatataggcatagtattattgaaaaaatattaatggttaatccaaccaatgttaacaagacaaagttaaacattgacactgatggttactgtattaatttccatttattttaaagagtattggcggcaatatgatactccttccttccctaaatgtttgacgccgttgactttt

SEQ ID NO: 79277 - DNA, 53718 bp, Oryza sativa
gaagggcttcgcggcggacaaggcggagggcgcgcggcgcgcgctcgcgggatccgcggcggcgaggaagggcgagacggacgagtccgcgtggcagcacggggaggacgtgcggcggcgcgccgcggagaaggccgaggaggcgcggcggcggagcgagcctcagccgtcgtcggaggagaagtagccgtcgcctcggctcgccgccatttctctctgttcttgaaagcttcttcctactcggctcacctgaccggagtccgggacgtgtcgtgctcgtgcgcagggggaggtcggcgacggagaacatctacgggtcggcggcgagcgcggcggaggcgttcaggcagaagatgacgatgccggaggacgtggtggagcagaagcgcgccgaggctgccgccggcgggaacaagggaacagccgccgcgacggcgacggcgacgaacaccggcggggaggcggcggcggaggaggtgatgatgcgggtgaaggcggcggaccagatgacggggcaggcgttcaacgacgtgggcaagatgggggaggagggcaccggcatggcggccggagatggtgggcgccgccgctgagatcgccggagccgaccgcgcggcgccacgccacggtgtttttgctcgtcgcgttttgtactaatctcagtataatctgtaatgtaaatatgtaatgcggcagttaaaagtaataaaatatcccctaatcacttgtccaaagcagagaacagtttgctatcccctcactctccctccttacggacggtctagtatcttaattaatctctcgtctaattcacaatgcacgaaactatttaaaacccaaaacatgaatctatttaaaactcaaaaacatatgacgaatctatttaaagcctaaaacccaaaacatatgaataacagatgaaaaataacatatgaagtacgaaaatacttgtcttttgtttttaatttttatcattcgtcttatttaaaaaattataaaaaatattatagaattattatttattttgtttgtgacttactatattattaaatttctaattttttaaataagacgaatggtaaaacgtttacaagaaaaatcgaaatcgaccactatttttttttggacggaagtagtaacaattatcggaaaaccactcacattcatttcttcgttatgcatgctaggaagtccaccatagttcatgatagccatgtaaatgttatacagcacacaagatgtcagaatcaatcagccaatcgagtttgaaaagagggactgtgcaaatgcaacactgcaaagaattggagaggtgcatcaagattcaaggcacatctgcacacagcctacacaaggcctcaattcagctacacaaaaacatcctgaaatttgatcgatgttacttacacctgatcggcggccaagcaatttatttacccattcatcggtgacaggacctgcgttaattttgtcaacagtgaaagaaacatcatctccacgattatgtaccacaatgtcacgtatcaacatatccgttgaagaaaaaaagactaaccaaaagcacgaagcagttttgctacgatgtaggagtactattattatcctcttgcgaacaaacacaaacctcccagcagcagaggtgtaattcagttttgacaaaacggtgtgcaggcaaacacatactacaatgcaaggaaaggaaccgtatgcaacactaaaactgctatcaagaaacaatcggcagatctcatttctgaacttctctttagcttcactatttcctcatgagctccaaaagtttctagtttgtgaagatataagctccaagatgtaaaaatgccactgccataccttcccctgaaagtatcaaaatatgctcatacaactcaggattttcattaatgaatgatgaatcttctcagccgttctgtacatgtactgattaattctgttagagattagagaagcttaaaaaatgcattttccacaagtcaaacttgccaaaggctaagcactgaagtatgaagttgtcaaaatgcttaggctcacctgcacagaaatatgttgggttctgaaatcaaatacacatgaaacatcaggtttctgattatttttgcttcaaaaatcacaaattgggtgtactaaaagaacaactaaagaatggcgaagtggcaaatcctagagcaacatctactaaaggatggcaaattcaattagtcctgaacagtgccaaatccaatagtttccatttagtgtatctgcaatactgaagagtactaagaataatagaaagttctgatcttaagtttagctccaattcactaaattaagcttatgggaggaataagaatattaatttgacttcaggttggtaaaaagtatgatgaataagtgattacttgacctctgatcttagtgagagcaacccaaaatatcagtcaaagagtaatcaagagaacatgaaacgaaaatctttcttctcaaatgtcatgtcatgttgatagaaccatacaacaaggcatgtaactagtcgatccctgagactaccttaagagcctaaggtcttgaacttgtaacaacatttcctaatgataaatacatatgactgctctacgaagtgaccaacaaaaataccagtcactgaaaaaaaatgccaatcatttcctctttcttgtttcacatatgtaaaatggcaatagcagattaatcagaacatcaccaagttggttgaagagccaacgacgaacggctccatcagcaaccgagtcaagaagtagaatgtgacacccagcaagatggagatcgggagtgcaggcaatgcatgcttgcatattgacagcaagataagggtgcagccaagcccagcaatgatggcaaggtagcacgcatacaccgtcatcagatcatacatcgcagccctccccacaagcacgctgtagaagataaaatcaccaagtcccagcttgatgcccctggtggactcgaacatctcgaactccataccagagtctgaagaagagttttctctgtgctcctcattaggggctgcattgttggcagatgccgctgataccaatggcactgtctctccttcctcgtgctgctcaatctgaatcacagcatgctgtgaactcccaccctgattcgatgaatgccctgataccgataccgccatcggcgcctccctttcgaggttcctctcacgaatgcttgatcggctaccaccaacatccctcatttccaccacggcgcggctcgaatcatcctcctgctctactctgtcatactgatttccacccgatcgaccgggatcggccaccggctgcatctcaactgatcccatggctgaagcgtaggaggaagaaccggaggccggcccaaccgtcggtctcgactcgtagacgagcgcagggagctcatcgtccctggatgaggcgagctccacaagcatcctgagaggaccccgcggcgcgagcacggcgacgaggtcatacagggcgagcgcgatgagcatgacccaggtggtccactcgggcagcctggagagccaggcggcgacgatgacggcgagggcgaccatgtagccctggcgcacgacgatggggaccgcggaggcgaagacggagaggacgccgacggcggaggcgttgaagaggagcacgagcgcggtggcggcgtcgagcggggcgccgaggcggcggaggacggcggcggcgatggcgccgcccatggagaagaggacgaagaaggcggagaagcgcatgtagttcttgaggaagcccgtgcagcggtagtagtagagcgcgacgaggacgaaggtgacgacggcgacgagggcgacgaagacggcggcgtcgaggagcgcgccgacgagcttctgccccggggtgtcggtggggctctcgaggtagacgagcgtcgcggcggtgaccggcggcggcggctgcgcggcggccgcggcggaccccggagcggagggcggcgcgaggagggagatgaggagcacgaccagcgccatgcagatggagaccggcgacatcaccgcgagcacctccgcgccgaggccgtcgaggacggtcgccgccgtggaggtggtcgcccccggcgccggcgccggatccggcgagccggcggcgggatccatgcggcggcggcggcggaggaggaggagacgtggggatttggggatttctctgtctcgtctcggagtcgggagtccgaccggggtcagagttctcggggtattttcgggcggctcacgcgtttgtgtaaattcgcgcgaaatttctcaaatttacgggcattttctttcttatggaactgactgctcgattttttttttaatctattgcagggaatttgtttgcacgctgttttttatttttgtccttttcctttaatttgctactacttggctgtgaacatctcagaggcgatgtaacaaattcgttgaatttcaaatgaaattcagcgcaaaccgatctgcttaggagagcttcagatttcggatgacaaaattcgaacaaatttgtgaaccctgcttaactaatacagttaataaaagtgtagtatactaacgacttgtatgtgtagcattttccccagattcctgttgagattgaactttgcacggcgttgaaataagagcagcggtttcacaacatagctaaaaaaagatcatcaaatcaggaagatgctttacttatgagctgattttattattttattggcgacagcaagaacagcactgcaaattccagacatgtatttgctcagtgtcttattggagaacaattaaagcataatcacaattcacaaccttcggtctaattaagaagaccaaactactcaatggtacacacttggcaccaatgccgatacgacataagcaaactggtaaacccatccactctgtgagtaatatcctaagatttgttgcgactggccttctcctcaataccagactgcgagaatcgcttcctgaggacctccaagacctgttccatcctcacgcccttgaccctaagcagcaccatcgcgtggtatagcaaatcacccatctcactgattgtgcggctctcgtcctcgttctcaagcagtgtttggtttagctctccagcttcttcgctggaaaatatgaaaaaccaaatcagtatgtatgtcaaatatatgggcattcacattgagagagggatagggaaaaggcgaaagaacgacggcaatataatacaaggaacacaatatgtatgtcaattgctttcacaacgcacatcgatcatcatattgtacatgctaacagataaactctgaaagagaggccaaatgattaacaacatatggtgcatgagacgcattaatggctataagagtatgttcttttgctatatgatgattaagaggattcctttaccttgatcaaatgctgaatacttcaaacaggttgacgatgatgaattttattatctagtcgagcccggaaccgtatcctctgacattacacactaatgtcacggtgtgacattcttgaatccagaccatccaaactaaatcaatggctatagattaattggcatacaagtaatcaaattaattagcagattatgtagttaaacattaccatacttaatgagtaggaaatttttttagcactaaagtagtcccttcatgttcagtaacatgagcccaccaacttgtagattatgagaattgtctttttctgatggaagatgtggcaacacaaagaaaattgatgcacgagatttattccttaacaggttcatatgctaatcattgcgtctaacaggtaagagcaagtttaatagtatagccaactactagctccaattcatctatagccaatctaataactcatttatacaatagttacatactacactattaatatttggtcccgcctgtcatacacacactgcatcttggaatccgtgatatagctggctacaaatctgtagcccactacccttctctctcctcatttatcttcttgaaatatgtttgcagctggcttatagcctgctattgtacctgctctaagttaaacctaattatcgacatgtgcttgttacttgcctgaatttgcctgaatttgtttaactacataatctactaattagtttgattaattgcatgccaaaaaatctatgacctttgatttagaatggatggtgtggatcaaaggaatgtcacacggtgacattagtgtgtaatgttagaggatacggttccgtcgagcccacccccaagatgccttttaaacctttgttgatccatattaacgaaatcttaaaatggtatcccctgaatggtgttcaagcctaaggctatatcaaaagttcaaaactgaggtattaggatctaattttatatccaacagtcataccctaagaacaagttaagtgtattaggctcccatttgaccatttccaaatgctgatgaaaaagtccgagaaaaaatgttgcaaccagtaataattttatcaacttcagttgtttgcaagattatgtttttttttttcttgacaggtgaatagggagaatatacaagggaccagaagaatatgcaagacctcaccaagggcagaaaaggaagaaatctaacccagcaagttgtgtcctaaaattatttcccgttcgatatgatgtagaatgacaccttccctaaacaggatttcattgcaataacattttgaatggttctattttcatgttgtgctattgtaaaaaggtagattcttctagtagaccaccataaaaatgcttgtcaatttgtcactgtagcgcatggtatcaaaacttttgctccagaactaacagtgtcttcttcaacatctgtgaccaagtaaagatcacatgtgtactatgttcaccatagaaactacttccagtatgttttatgttgataacttgaaagtatatcacagaaactgacatggttttatctcaaaagacaagaagctaaaaacgaggttaagaccagagggagtacacaatattaatagtatcacataatgtcctgcaagctcataatgtttaacaaaaaccatggataaagaataactgtgaactgtcttggatattgaacaagcatacataacagcacatcaattaactaaccaatcggcatacccaatagtgatgactgaactagaatatgagaattaatgacagggaataatgcaatgttttgtcctgagccatgcataatatgcttatttatttaatgtttggaccattagttttatagacgaattttgaaatataacatcacataccttatttttgagcaaagcagccggttatcaagtattagtttttttgtccatgatggcttgccacttccttcagtaactatctcttccttccgtctactaattgtatcttcaagtgagtacagagttgagacaacctgcctatcttgattgggctgtgaaggagtctcatagttaaattatatgtaaaggttcatttacagaaagggcaacccaagaacagataccttcgaaccttgtagagcatcatagactgaagtatagtaacaagtctctgcccctgtatggcaagtaggcccatctggcttcccaaggtatattatctatgtttcaggaaaaaaaaacaaacaacccaattagcagttagtatccactgaagcaaaagtaagcatcgtgacaagcaaggcttacagaatcacggtcacagtccaagaaaatgtcatgcacattgatgaaattcattgatgtctccccttttgtccacaatgaagaccgtgaacggctatagaatgtagctttcctggttgatatagttgttgcaagggcttctttgttggcaaaaccctgcatgagaatggctccagtatccacattttgggcaatagcaacagccaagcctttactgtcccacttcacactgtctagtattgcttcgacctaaaattcgtccagaatgaaaataaaatttaggtaagatatgatataactaagcaaaccagtcacatacagtacatgatgattaaaattgtattgcatcttaagaaagtttatttgtgaaaaatgtttcttcagatccatgcaaaaactggcagtctcatattctgtcttagttcctctagaacctagaacaaactagctccatagcactgtgaaagttatagttcagcgaaagtctatggaaggcaaatctgctaaaatacccaatagtcatcaaacagtcacggaatggaaaacactgcatctatgtcaattcatttagaagctagtttaaattcatgagaccatggcaaatatttgctttactaaagtaaatgcctcccatcaagagcaaccaagatatgtataagaacatagttaagaaactagggtgtattaatattaaaatacagaacaaacatgcactgcaaactaagaaacacgtcatcatattcccccaaaatacaaaagtatatttaacacatagaaggtactgaagtagtcatctgataattgtgcattttagaataatccctgctaaaaaacagttaattgagattctgatagaatgggtaggacagtaggtgacatgacagggccattcgatgtttcatatctacaagttgataaacgggcccaggatgatgaattgcatgcccttcagtggctgaatacttgttagtgcataaatcaacgtagctacgcatcactccaaaaatgaactgccattgtgcctctaatcagcttgcccacgggtcttatactaacagcatcgttctatcaataactagcgtgatgtactaccatctgcaaagatttgcagcaacaaaataagcttagctcaaagcaagaaatccccaactctgcggcacaagaaatccagcatactcttctatctctacatgaacaacaataaaagcctcacgctacacagcactacagaggtgaaccctcatctaggaattccgacgaacatgtggcggttgtcattctcgtctgtctttagagcaccaaaggagaggcacatccaccctgaaacgcttccggcaacctctcgccgagaaccgatagggatagtggtgcagagaccaaccttaggatcgacggcgacctctcccggcgtggtaccagccgagcgcgccgcgacggaggcagccgggaacggccgccgccaacccggtgccgccgccgccgccacgccagcgcatcttccggaacctcctccgccgacgcggaggaggaggagagcgcggccccccggcgacgcggcggcggcggaggaggagacgggggcgcggggaagcggaggcgccgccatcggaagcagcagcagcagcgcagagagggtgacgggggcgatgtcgtgcgcgatggacgcgtcagcgtcacctcgcgatattccggcccactatatctggaccaactcaggcccagcctaaaccggcccgtaatacggcccacgttagcctgctttaggcccgttattaaggttgggtacgtagatggaactattagcgtatgattaattaagttttaattaaaataaaccgaaaatagatttatttatattttaaagtaagttatatatgcctttttttaaccaaaagtcgagataaaatatgtgtcttatttatagtacattaatgcaacaactagtggtagtatgcttttgacgaaaaccgatcgaaaacagtgaaaaaattttaggttcaaagcgggacgaaagcaaattggaagtgaaaattttaatggtttttaagaattcataatacgtttgatcgaaatttggtaaatatcgctgtacttcaattaaaaaggtgaaccggctcggagcgcgcgcattgctttttttaaggaatcataataatgtcatcagcacatgattaaatctattagagaataaatgggaaataatcttttagaaaaaaaagcatatttcttttcgtcgcttttatgttccttttcatgatctatttctgggttggatgaaagcgaaatggcaccaccactgaaacttttttcacgggagaaaagagcatagagaaaaatcaacaagaaattgttggggagtttaaaattaggatgacagagcatcctaggcaataattaagcaggcaaaagccctctttaataactgcctaaaaaatgtgttggattaggaggtcatcactgtaataataaagaggaggctggtggagagcccctccctctctggccctgatctcctccccctctcacttgccctgcccaaggtgaccatctctttttttttttgattgattgactgatttggttgatgatttcctctgattttgtgttctttctccttcgatcggttctgtcaagagcgtgttcagaggaatttagggttgcagttgttctgtttggtgcaaagatttgtggttgctcggttggtttcttgatcgtatcctaatttcgtttgcggccttgttgaacatgttgttagaatcttctgttcttggtgttaatttgtggttgccgttcttgttttttttttgttcctggttggatctgagtggttcttgtttcttgttgatggaactttgttcttgatttggggatctgagtgcctttcgatgatggaaaggaaaaggaaaaagaaatcgtgcattgggttttgatctctcggtttgttgaatccttcgtcgcagcccaagagaggaatccaagctgctgcattgacggcggcggcggcggcggcggcgaggagatcgggagcaatggcggaggaggcggcggcaggcgggctgtactactgccacatgtgcgcttcgacggtgagcgccgtggcggcggcggagggggaggtggagatcaagtgcccgtactgccacagcggcttcgtcgaggagatcgagtccgcgcgcggcgtcgccaccggcggcggcggcgcgatctcctccgtctgggcccccatcatcgacggcatggttggcggcggcggcggcgactccgtccgccgccaccgccgcagccgtcgcctcgcggacgccgccggcgcggacgacggctactaccgcgacctggccctcctcgacttctccgagagccggcggcgcaccgccgcgctgctgctgctcatgcaggagtttcgggagcgccagctccagcgcctcgagtccgccaccgccacgatctccgccgccgcggccgaggccggcgccgtcgtcgggacctcgagagacgcggagggcgtggcgctggccgactacttcctcggccccggcctggacgccctgatgcagcgggtgggcgacggcgacgcggggcggcagggcacgctcccggccaagaaggaggccgtggagtccatgccgacggtggaggtggccgccgggggcgactgcgactccgcctgcgccgtctgcctcgaggactacgccgccggcgagcgcgccacggaaatgccgtgccggcacaggttccacgccaagtgcatcgtgccgtggctcaagatgcacagctcctgccccgtctgccgcttccagctccccaccgacgacgacgacgactcctccaagtccgcacgcggcggcgccgcccactccggcggcggccggcggttgtcccagccggcgccgcgggtcgacgggggaggcctgggcaggttgccggccgtgatgcaggagctcaggagcatcctctcccagccgtcgccggcgtcgacttccggcagcagctcgcacgcgcagcagcacagcgacgagtgatgacgactcaggatggtcgccggtcaccggcggtgctgctgctccggcgaccggcggaggagctcatggttttgcaactttgacaatgtacataatccggggttcgtcgtcgctgtggtgactggctttggtgccaatggaacttcatttttcctcgtctcccctttctttagcaatcatcttgtgatatatcccatgattttaatatacaatttgcgttcggcggaaaatggagtatattagtggcgtgtatatgaactctgcatgatgctaatcaagttcaaggttgcaccggtgtcctgaacacaaatactagtaccgttcaaaaaaaaaaaaacaaaccaacctcgtgttaaagatgtgatgcatcatatatccatatgtcacatcgtattatgagatttgccttttttatttggagtactccctccattctattttaagggtgtttacaacgcaccgaggtggtgttcagcctcgcacccaagaaccgaatattcggtgccacatcggcaattcgcgtggaatcctcgagaacgcggagcacagccggcgggacccacacgtgccaaaggagagagggagagaggagcgaggaggggagggcggggccgaccgggagaaaggagcggcggctccggccgcaccgcccccccgatctgtgccggccagggctcgccagccgcgctgcccctcgatctgtgccggctggggctcgtcgacgcggcgccgctccagcgcttcgctcggctccgcgcgaggacgagctcgctgcttgggccgcccagccgtcgctccggtcgccgccttgctgattccgtcggtggggaggagttcatggttcagtgactttctttggtgggaacgaagactagaggatagagagagggtagatgaaaagtaaaagggaataaagattggtggccccacttaaaaaaatctgcactgtggagtattgttcttgggcgttctcctgcacaggtggcatgcgaggctcctcaaattttgacgacgcactgctactgccctaagtgcaactataaatttccacgctaaattttgatcgtccgtcttatttgaaatttttttataattaatatttttgttgttatgagatgataaaacatgaatagtattttatgttttcaattttttttaaaatttttttaaataagatggacggttaaggtcagacgcggaaaaccatagctacacttaaaataggacggatggctacacttaaaataagacggagggagtacaagtttcagcttacgagtaagaatgttgtttgaaatgctcatttgatgctgtgcaatgctatactgtagtaattcagttagaaatatgaaaatgttactaacttcaacaaactcattctgttccgataaaaattcaattctaaagatatccaaattcatcctcggaattggattttttttttcaggactacatccatatacagaggatggcagacaaaaaaaaagacaaatcagtggtagcagctaaagtaatctaaaagcaacttgctagcataaggctacgtttctttcagattgagattattataatccagataattaggagtaagctgaaagaaatagacaacttattgaagtagacttattgaagtagcttattataatctagagcacagcttattataatccgataagctcatttaggtgagctttttttagattattgggtgaaaaaatacccaccatgccacctcactccctctttagacttgcaaacccaataatctaggctctaataatctagaaaaaaacaactaaccgcttattctactacagattataacaatatagcttatagtaatctaactcaataatctaaattataataatcctaaactgaaagaaagagggcctaagtattcaactccatatactggttcagtttgtcaagaacgcaattcatcctatgaggcatgcattcaacttcccagttgcctcacttttctttggagatctttaactccccagttcattctgattgcagtagcttcccagtttttttttttggcggggagcagtagcttcccagttgccccacttttctttggagatttttaactccccaattcattctgattgcagtagctagggataaaaatggagctgaggataaaaacaggatgaatacagatggataatgtttataccatattcgtttttatcgtacacaaatatcaaaacaaaaatttctcaaaacatgaaaaccacctaaacttctaatagaaacaaataccatcacataaacacaaaataagcttgttttatataaaaaagtttgatcataaattataaacaatgcctaattaagtccaacatgtaaaaaatgagatgtttcacgccttcaacagatatccaaataacattgttcaatccatttggagcagtttctactccgaacggatgaaactatccactccattttatatccctacaagtagtggacggaaactatcaactccatttcatatccctagcagtaaccagttacgcagaaccccgaaccatattcatcataacgaaacgaattcaagaaatgcatttcagccaagaaaacagaacagaatagaactaacaaattacgtaacggctgtcaagtttaatactagtagcagcagaggcagcgaaataagctgcggtagcaataacgaatttaactgtttcaatggttaacccatgaacagcaaacaccgaaggtgcacctgaatgcaaatgccactatcatggcaacaaaagctatagatatgcgtggtaagtaagaatcccccagcaaaaattttcctccgagcaaaatggtgtggattaactgccgtctgccactagttcgctgtcaggagcttgatgacagatgcagttccgatccggtggagggcgacgacggactcaccggagttgcagagccccatcgccttggcgttgctgatggcgaacccgagagcttcttcagtggcttcgttgtcgaaggccttggcagtggctgcactcagcatcgggatcactcccctgacgatgaggctgtgccgcgcaggagcttcgtcgctgcaggtccagtcgaaggagtcggtctgtttcagctcaggaaccacgacggacagaatcggcatggatggcctgtacttggccaccagcctagcagttgttcctcccctagtcaggaccaagatgagcgccgccttggcagagttcgctgtacgcacagctgatgatgcaaggctctccaatgggctcatgggaattggagctgatgcggtaatggacttgaaaacagcggcatggtcgacgcatgactccgcttgcaggcagatcttggccatggtccgtacagccagttccgggtaagccccagcagctgtctcaccactgagcatgacacagtcagtgccatcaagaactgcattggcaacatcagtcgcttctgctctagtagggcggggagacttgatcatagattccaacatctgggttgcagtcacaactggcttgccctgaatattgcacttgaaaatcatcaccttctgtgcataaaagatcttctctatcggaatttccattcccaaatcaccccttgcaaccataaaagcatcagattgtgccaggatatcatcaaagttagccactccctcttgattctcaacctgaaaattcaatagattaaaatctttgcaaagtgcagcttagaagtgcaatactcaaaagagaatgttatacctttgacatcagcattattgactttgcatgcttcccaagcaccttcctgacctctacaaggtctgagcctttacgaacaaaagacagagcaatcatgtcaatcttgtttgggacaccccatttaagaatatcctccttgtccttctcagtaagtgtcgggagatcaacaataactcctggaaggttaacattcttcctctcaccaagcatagcagtgttctcacaacggcagcgaaccaagccttgctctttatcacagtgaaggacagtaagagtgatggtgccatcagcacataatattacactgcctggcttcagatccaccgctagcttcttgtagctcattgatatcatgttgtcatcaccctttatgctataatcagttgaaactgtgatttcttgacccttcttcaactgtacgggttttccatctttcagaaatccagttcggatctctggcccctgtattttaagcaaatccaatatctgataagtacacatttttatacaacaatagttatacattaaacaagcaatttcaacaatacttctctagaaaaggaattcaggagattgaatgttgtttcataatttcattagtcacaggactcatggagaaataaataattgctgttaccctcgtgaaattatatatattaaaggcaggggatgctacgattcatgcagatagaaacaaaaacattttgcgtgtacttgtagtatctgcacaaagcacagcgtgttcaaggtatttatttgtaaacaccaactaacgttgttacaacatcttaacccctcaagtacaagtccacataaccaaatgtacgtattcatagaagaacactacatcttaaagaaaaaaaaaccaaagcaaaggcagataatggcaaaacaaccaaaatattgaaatatgccctaataatgcatcccataaattcagactcatgttttaacttcaactaatagttcatactcttcagagtcgatcaactgaagattataccattagcattgtatttttactttacattctttttagactaatacccatataacaggaagacaggaaaccgctgctgcaaaaagaatgggagcacaaatcaagccagtagtcatagtcaaaataaatggaattcctgagggtagttacaggaaggaataagaatttcttaagggctatactatgcagcataattgacagtatactgacagaagagaagatgctcaaatgaaataacccaatatccacaaaataaatgctgttcactaaacgcaattaacacggcttttcttttttcattgtgagagcgactgtctcaaatgcaacatgcatttccatcgcaaatattaacgctgcgtagaaaccaggatgaaaagaaaattttccctacaagtatctatgaagaaaaaatgtaagatgatttgacaattgacatcctgtctattttacaagcactagtctccaccctattgttcactagggtggacagaatctcttattattggtatatatacagataaaactgaaaggaaacttgtcccatctcaaactctggacagaaataagaactacaaattcaactagacaagaacaagggaaaaatatgttatcatgcagatctggagttctggacagctacaacctacaagagttcctcgaatccaagaacaaatacgattatcgttgtcagtgcaggtccatgggacaagcttgtttggtggtggatggaagacagcatatgaggttgttcttcagttggtcacccaaggtaatgcagaatcagttctgatgcttctaatttaaacaataagctacttctaccaatctcaaatgccaagctcatgatcatctatatcagtgaaaaatggtgtgggtcggatgggtgaggagctggaggtgcgtggatcacatcacgtgctatgtgatatagatagtgtacaatatcacatctctattcctaagcacaagacacttgctaggtttggcactccctgagttaataaaaggaggccatcatttcgaatttccaaacatacgtacaatacataaaatcagaaactctccatggagtagggttaaccttttaagcttctagattctaagagacctcaagcctctgatagtctgatactacaaagatgctgaagtcatttttcatcagctactgagagaagaccaacttttccaaatatggccttgaagataaacctaacttgatatagcataataacagaaatatttatacataataacgacagcaagcccataagaagcagttcctttcccagcagattagcagggatcaaatcacttaatttgcatctcctaaataaactgaaccaactctggaaaagttgggaagcgtgtactggcccgcaactgcgtgttcgggaatatatgaataatatggaaaataacgtacaggtttaatgccattgagaaatcctgaacaaagtctttcagaaaattggtcatgtaccacacaaatcttatcatcgtctaagctaaagattggaagtcctcaaaacaacataactaattctccctttacgaccattttccagagttataacatacagtccaaattaatccagagcgctaaactccgctaattgaaaaactggccacttagagcaagtttaatagtatagccaactactggctctaaaccatctataaccaatttaatagccaattcatataatagttacctataaacatatactacaatattaatacatggtcccacctatcatacacacattgtgtcttggagctggctacatatctgtagcccggtgctcctctctctcctattttatcttctcaatatgtgtttatagctagcttatagcctactattttacctgctcttagcaccaggtgaaaatacagatcaaaacaaaaataaacttcactaacaatggaccagccaaatgaagaaagacgagaagaacagaggaccacagccaacagtgggaggaaatggacaaacaacacgctaagcgagcaccaattcgtaccagttcaggagctaattcaacgttaatgttccatccaatccacagaatccgcacgcggaatgacgcaatccaactaactatccaatctactacaagccaaaaacgcggacaaatcgaatacccagatcttcagaaactcgtatgcatcgctcatccatcgtcagcgtttcttgccgcttctaacgcgtcggtggcgggcaaatcaatccatccacagtacgaaaagtactactaccaacatccacaaacagccaaacgtacctgattttgagccaacaaaacatgactgatattgtcttttgaccagcagaatagtcagggggtgagaacccaagaatcagggacgagcaacggcctactgtgaaaacgaccgcacaaaagtcttgaagaaaataaaaggtggccaaaattaacaccccaagaacgaaatcacgcgcctgaaaagttggcaagaacagatagatagatagatcgatcgatcgttcgtctaaaatgcaccggaatcatcggatcgaacatggaccaaatctctttctaccctaatctccctctacatatttcaaaggatgttcccaagcgcatagatgaaacttctctctcttttttgaaaaccttaaattgcggatcaagaacaatagatcaagaagaggaaaaattaaaccgagagatcgaggagggaggcagggaggggattggagacacgaatgggaccttggtgtcgagcatgacggcgcagaggatgccggtgctctccatggcggcgcggaggttgtcgagcgtctcctggtggtactcgtgggatccgtgggagaagttgaagcgcgcgacgcacatcccggcgcggagcagccgcccgatcatctccaccgacctcgacgccggccccagcgtgcacacgatcttcgtcttgggcctccgccgcatcacccccgcggctccctcctgctgctcctccatcaccgccatcctcctcctcctcctcgctctcgctggatctccccctcgacttggtcggcggcggcggcggcggaggcggagatggaggtgggtgtggtttcctctttcttcttcttggtctccaagaatggaggcgagatgggggaagggttaaataaataaataaatagggttgggcgaggtgaaattggaaagggaaccaatgggtggggagatgcggatgcagcggtgcggtgggttgggttgggtccaacgggaaaggcctccacaatgtcggtcaaaactgtggggaggtgtgggccgggggactgacaggtggggcccaccccgggtgtgggtgggggctggtaaaaagatctccaggaataggatgtttcttgactggagggcatatttgcccagttgtccatccatgctgatgctggggggcggtggatacaaccaaggttgtctctcaggatcgagataggaagtatcattttgctcaaagtaatatcgtatcgtagtatcgggatactatgagattttctttttttaagtttaattaacatttatattaattatatatatagccattctatataaaaaaagtagtaatgatatatgtcatgcaaatagagagacatttatcaagagaaaccatgttggttttgatatatttaactgattttcatataaatttgagcatatttagttacattattttcaaaccatgttattttaaataatattttgtagtatcctagggattgtacgtttcggcttggtaggatcgtagtatcgtaagatactgggatacgaatcgggatactgacaaccttggatacaacttgctgccgttcgatctcctcttttggagatattttcagcgcatgtaaaacgagaaaaataattaatatataattaattaattattaataattataaatttaaaaagtatttatttaaattttttaaagcaatatatatatatatatatatatatatatatatatatatatatatatatatatatatatatatatatatatatatatatatataatttttttaaaaaatatcatttaacagtttgaaaagcgtgcaaaccaaaaacaagaaaattaaagtttgaagttgaagaaaacttggctttgtgttattttgtttgatagaatgtttaaatatattttgcattaatttcaaaatattaaaatgaaccaggatatgatgtttctaatcacgtaggttagtagtatattttaaaacagagggagtaataccttttatgtccgttcgagcacgtaaaatgagaaagccatttgtgtataattagttaaactttaatcattttaaacttatgagactatatttatatgatattttacaataacttatatataaaaagttttcacgtaaattatactgtttaacagtttaaaaagcacactaccgagtgccaaaataaaatatatatctttattaggggcatttaacatatcccatccacagaaatggtgttctcaaggaaaggaaagaaaatccactgaaatggtagtacatctatcatatctggtggtttgccctgctggtttccgttggctgtctcctgcaaaccgtgcacgcgcgccttgggagcgaagccgagtcgcacgcagaaattgaccgggcgcgtcgtacgacacacacgcagaaattaaatgcgtctcgttctagaagagttggagtcacgggggaatttctcgtcctctttttttgttggaaactttgaacgtctttgaacccaaaaaaaaaaaaaaggtcggtgggagaacaaaatcgcaaatggcttatgcatttcggatatgattaaaagaactcttttgatttcaatctccatcgtacaaatatcaagtttggcaccatgatgttacaaccgtttttgtatttttgcaaatgtatagtgcttcagttgtcagttcgataaaaatagcccttttttaaaaaaaaaaatcggtggagcatttcgttttctctcgtgtttaatagtggtatagacgtatagctgtttaaagttaatataataaataatatgtccccacagccagcaatagcgccccacctgctggtcgagatcaattagtacttattctattaaactaaaccatatgttcagattctcttctcgagcattctctctttaatctatgctctttccaccgaatcaacttaagtcctgtttggttacatgggctaatgtttaaccctcatcttttagtctcaaattagtcctcaaggatttaaacaggtgggctaattttgagctaatgtaaattagcccctcctcgaaacattagcccctccaaggggtgctaatggggctaattttgtgtggggaacatcaaaaagcagctctctctctccttctctctcctctctttctactctctccaccttttagccttaaattataccatggatccaaacataccaccctaggctaatgtttagcctaccaattcataactaaacattagctctcaaaattagccctgagctaatcttccaaacagggctctatacatatgccacgcgtatcgtgcatccgttctggcgaacattcccaacaactatatataaaaaaagaaaagacaaaatatttaaccatcagcgttcactaatttaacacctaacctacatatggcttacacatatggtaaatatctaaaatgataaatagttaaaatgccataaaaatgaactagtactagtacacttggtccaaattggtatccgtctctttacgaaacaatgagcttcaacttcttttagaatatccagctatcaaaagctcgtcagacaatttagatttttcacctaaaatctaactaaaagccagagattaggtttcctagcttgtccagattcttaccagctgtttttaagaattttaagttccacaaataaacccttatattcatccctaattggagtaatccaaagcgattttatcaaatttcacagtttcacttttcaaagatttttccatttgtcctattagcaaccatgaaaacgaccaaaaagcacctaaaaatctaaatttaaattcggcgttgaattttataattcaacaacgagccaagcatacaacagcgcagtgcaataaccacaaactaactagctccacctactagacattctggagcagtgtaaaaaaaaaaaaacaggcttgaatttgatcagaaacagcagccggcagatgctacatccagagtgatgaatatccaggatgtagttcataaatatactattcataactcagaaacactcagattgttacaaacaacagtctagcatctttggggtggcatagaaaaattgagcaaatacgtttacagggaagagtggtaaaagaaaatctaccgacaaatcagggtgaggaatttcgcgatatcctacagcttttgttcaaaaatttttcttgccaaactaatgctgcttcggtggcaatccgagtgctgaactccaagaattccagtttcatatgctattctattcatataataaacctgttaaacctctcttgtgagtatggctgtatggtgagagttgttttccttgtagcaagttcattattgtctcaccccataatttagagttcatcatggtcacgctggttcgaagatgccttgagcttctgttccaattcctgttacattagcacaattccgtaagcttcaacctatattgggaaaaagaaagaacagaacaaattagccagagggtgagaaagaaccttcagtttttgttcatcgcaaagcgctggagtcgataatacagccacatacctgtcacatgaagtaggcatgtaagttaaagagtaatgtgcattttcaggaaaaggtggaaggtgtatgtagagaaatcaacatactcgcatctactaggctcatcgacaccattaagttcattgttcagcccgcatcgaagcctaacctgtatcataaggcaagccatattttattaagtttcaagacctgcaaacagaaacagacaatccatcttaagataacgggcacgaaggcatgaaaaggagaagcacctttagacttcggtcagggccattccagcatctgtctccatttgaaaattgcattactctgtaggattcttcaaatttgtcccagcgcctgacagcagaaaaaaattatgttatcgcacaaaacaactgcaaaatcactattctgagagtaataaagtattgcttaacataatggttctgtacttgtatgatgcatgcacagagttggaattttggagccataaagcaaacaagaaaacaaaacattgcattcaatcagctcatatacaaccttttgcagtatgtaaagctaggtggcctgctagctaaaactgagcaggagagttattctgaactctacgactctttgcaaagtggtataacccattattaggaaaaactgaactagacatctgcagagcaataataatgaaaacttagtacacctgaaaggaggctaacaaacataccccaggctggtggtactatgtccttcaacctgcgaagctttcttgaatggacataccttgtaaacatacctatcaataagaataacaataaacgaggaattaacaaaatatagaatggtaataaagtaaaccatggaaatatttacgagagagagagagagagagcgcatgtgaggttggatgactaatatacgtacttgccctccttgctctcaaagcactgatcataaaagtaatagaactccttctccttacctaataagaatgtattccttcaattaatttcaatattataggcctatcaaataatatatgaactagacataactctgatgaagtcaacatctagaatacctatcaactcatataattcttaaaaatgcatttttccacagtaatgaagctcaatggtaaaaatataatcaagcttttctttacagctattaatgaaacacactgctgtctagtgtccaccacaaaggcgttactgctgaaattggatatggtaacgatagaaaaataggagaaaggaagaacaccctcaacatgccttgcctgcatgagaggtgacttgaaagtgcacattcctgcaaatgctcctacgacttgagtatttattttccagtttgaagacaggtttttcaatgcacaagttaccattctgggacaagtcaaatcatgctaactgggtgatttttgctaagaaccatcaatattaaaagtaaaaaaaactggatggcttaggcagtaattcaatggtggcaagcgctgccatatataaacttgcaaggccattatatagctaacaagaatatacgagtgacttgtgcattcaatcaccaagtaaacaaactttcaactgacttaccaaagtcgtgttttagcttatctgtcagagtggatatcctagactgaatcttggacagctttgagcttgcatcatcatactccttccgaacacgagaagcctctaaaaaggagatcaataagtgacacagcatctcacatgatttttgaaggatcatagcaggtagaatacacaacctaccagataaatccacaggggtcttgaaaaagttgaatgttcgtaaaacattctgtacagtttgctgaattttatccagccatgatgcttgcccagaggcagtgaaatctgacagaacaaaagaaaaaagaaaaatcgataaccaaatacagaaaggagtcaaagaagagagatagtgggcaggttacatgaaccatatacctgaatggtcatcacctttctgatcatcatcagacttgtatgacgcaacatgctcatcatgatcatcgacatattcatcatctgattcatgtgagaagtcttcatcatcatatttatgtctgtcatcctcaacttctgaatggtaaccagcatagctgtcttcagcagattctggtacatctgattcatcttcatgtgtttcttctgaatgttctggcatatcatgctcagcttcatgctcatttttatcatctttactgacctcatcaaccttttctccagtccatctggaagctaccagacgacctaactcctctcttgataaaccttctgagtcagcaggagtggattcctacaaaatttatcaatacaagttcacattgcttcaacccttgcagtgcattaggaaaaccatgaaaattactgcttgtactgatatttgtaatgtaacaacccctggaaaaagttttaactgtattcaaccaagtacaattgaacataagggcaggaaagatgtgcaagtgttgtacaagtagcaagtgctggtgttggcatggcttatggggcattagacatctagctacgaatgttggtttattacacactgcagagatcatcagttggactaatccaaagagagagtcataaatgggttgttatgacataatcagacttgaaaacatttaaagggatttgaatccataaattcataaggcttattcagtttggaggaatttgaatccataggaataggaaaggtgaaggaataggaatgtttgcacacatcaatccatatgaatttttccaagaggtttgagtggatggaaaaattcctatatgtttcctctatacaacttgtacgaaagggaattttcctttggttttcctacttcaatcctataaactgaatgacactcataggaattaatccttaggaatccaaatcctttgttttttcctccaaaacgaactattagaagggaaatggcttggtgcacagggaaacaggggaacctgcatatccctgttagtgaaaatacgatggatccagcacattttgatgtttcaaaagttccaaaaacaaacatgaatgcagtgcacataaaattatctaaacctgcaaaatttcaatttcaaaatccattgtattaagatccaaatttcattcttgtttaccgatgccattgaggacgagtatgaaactgatatttttgtatatttacttaattttcagagcgcaacatactacacacatggtttgcttgaatgtttcaaacacaataacatggcaaatttgcaacggaagtaccggttcttgggacaccaaaacagtcacataccaaagattaggtaaacaacattacaaatttagatttcagtaactatcattaatatgcatatgagtggctcatattccatcatgtagctcaactcacaacagcaaattagatttgagggctgttagattggcctattggagggatgtttacaaggagggcactaaacggtatagagttatatatatttaaagagggtatgcaggatatcagtttttgagttataatagagagaaatgcacaatacttttttgaaacaggttcaatccctggaaggaatatgctattattaatataatcaaatttatctctactattgcctccaaagaacagggaaaaacatatatcaaaagggcccaaagaatgactcagatgcaaagcagttattaagtcacctgctctttagtaggtgctgcagatgtctcctctggtggtgattcatcagcaggtgcggcttttatgctaatgtcatcttggctttcaggatcatgctgacatacaaacccaatatatatatggaaaaatccctcaatgtgatactccctccttccaaaagtctaagacctatttcattctttggtttttccaaaagtctaactcctatttgtagtcattatgtgctaaattaaattgttgaggaacccaagaagccattttaatgcttattggttgcatgttcattggttttgtcatatggtgaatgaattaattgcttcttggtcttggtgcaaaaagaaataggactcagatttttggaaggagggagtatgtagcagtagaattgttagtattttataataacgaagttaaattatacctgctcaacagatgactcgctttctggtgtgtgattgtcatggctcgtggcatgtccatcatgatgttcagctacctgtattcatcatcaaaaacaaaataatataaatatctctttatggcattgagctacctagttgtgcagtaagttcctacaattcataagtgaggaactgaggattagtacagcatagtatcatatgttaccacagtgatgatcatttttatgttctttatgactaaccattactggtaaattgtggggaaaaaggttataaatagcattgatggaacatccagttgctaggatacatggggactatccgttcttgatgtatgtatgtatgcatatggtatctctgttaagaaggcagtttaatggttcagatcatctagcccaaaacctaaaatgaagccaacaatttgaggctttaagtgccaccaagaaacttaaggttctgcacaattatgacataaatcctgtacttttcgataaaccattgttacaaaactctgtagaacattgatttatcttcttatgtgaatcattttgcgataaaaatgcactgaaaccattggaaggatggtagttctctcccaaagcatagtaatttcatgagtatacaacacatagctgcaccctattagacgtgtcaacatgctaacaccagcttaactcgattcaagatattaatggtgaggatgaagagttcatcagacaaaggtatatatggcaatctaacagatatatagaaagaatgctaaccttgctctcatcttcttgcacagtttcatgattttcctgagaatctacctcctgagaggcatctgacgctttcttttcatcagcagcttgcttttcggcttcttccttcatcctcttttcttccttttcttttcttaagcgttcctcttcctctgccttctctatcaatttcttttgttctgcacaacatgagaagtcatagtttaacacaaaataaactatccattgaaaattagcagcgccaacagcatttcccaacataacattctttggtaaatgactcaagacaaaccgccacgaagagcacacctgtgagcttgtcaacaaggccttgtagtattttctcttcacccttcagtttcgctagctctgcctcgtctttagcaaatgccacttttgccttttgaatttcctgatttcgaataacaactccgcttttatatgtagctacttttttcttcaatttatcccttgccgctttaccagcctcccagcacgtattcttgcaagtgacattgctatcatactcatcactcccgtcgcagcaatctaagaggcagcgacaaacacatatgggtaattagaaaaaaatatagcgggaattccctcaagcactatgtttacggaacaaaagcaccctaatctctagccttacaattgattttgtgtacatttactgtgtttacatttgaatgatacagagaatggccaccgattataatcctcttaccacagataccatcattcactcgcgacgagaagatcgtgatgggagaatgcccagcattctggcagtagaacttcccctccgggcacgccgatgtccctgcgccaaggcaaaaagtaaacacaattcgattaaacagctctcttagattgcctacagtaagtagattcgagctactagcacaaacacgagaacctaaaaccagaacacctccgcaaaaagctaaggcaaaaaaaaagggataatctttttcaggcgagagcaaggaagcaacctggctcgtcggtgccgtcggggcagtcgcagaagtcgtcgttgagcttgtccctggcgaacctccccgatccgtccctgcacctgatcacgccgcccctgaagtacgcctcgtctgcagtgcagtgcagccagccacccccgcccccacaggcaccaaatcaagaaccgcatcaagcaccaagaaagagagatacaggcagatccggggggggagaaaaagaacaagatggaaccttgcggcgggatgccgagggtgtcgagcggcggcctggaggcggctgcggaggcggagatccggaggaggaggaggaggaggatcgcgtggagccccatggccgcgcggcgcggcggcagggggtggtgggcgacggcgtcggcgtgcgtgtgtctctcccctcctcctccgcctcccagggaaacgggaagtgtagcaggggagggcgagaggagcagtggtgccccgtcttcaattcaacacggggttgctgaaatttcttgatatgcagtttacagagcatgagattttaatggctgattgattgcagtttacagagcatgagattgtactgtaatccttccgtcccgaaatataagcattggattatacgattatagcttattcgattgttttatggttggtatggcgcgagattatccctcttatacatgcaggatatctaggttttctcgatcatcacattttattactgaaattgagatttatttgtttctgtaaagtaggcgattggctatttggaacttatttagattcactcaaattatacttatgtgctggattcactttatagttttcaaaaaaaaaagtcttaagttgatctatctaagggacagagcaggagcgccacgagtagtgtccaaggcggatgcacgagggggggggggacaagcgagctccatagttggcaatctttcctgctgccatgacaaaaagatatagacggcatatggactaaaaggatgagggagagaggatagagaggaatgaaaaaaatgattatatttactgtaactgacatgcaggtcctacttttttttcctacttattatgtcaagtaggcgtcacgtagacgtcatgtcaaatgaaaaccaaatcaaacatcacgtggatgtcacgtcagctaaaaatcaccgtctaaagcatcttggaactatatttgtactggttttgaaagataaaagatactcctatattggctttgttcggacggcttagctacagcagcattgtggctacgctgcagccaaccagccagtagctacaggagttataactatccagcagcaagcaacaacttcctgtaactatgtgtttgtgtagccgaacggctacgttgtacaacacaacttaaaacgctacagcaaagtcttaccgaacatgctaattgtatccagttttgcggttgagagatatgatttaaactcaacctataatgaggaaccaaatttgaactttctccacccgtaaacccacgtagggcatatgccatttaggtgggccttccccaaatccatgatgagcccagtagttggctgggccttcaatatgcatcatcagcccatcggtgcagttaggaacaaggtcactgtgtaaaaggatgtttggtttgctcccaaagtttaccaaagattgccaacttgccacacctcatgttagtcaagtttgaccaagttagtctattgtttagttcatagccacacttgtggcaagattccttctcatctgtttgggtcccacatgtcatcaactcaccaaagcgtggcacaatccaattttgctagctaagttgtggctcactttttgtaagccacaatttaggcaagtgtggcataaaaaatatggtgaatggtggcaaacttagtatagcatccaaacaacccctaagtacccctggttttgactggcctatcttttcgcttattcttatcagccaaaatttaaaattttaaacttaaattcaaagttgattttaagattttgttttcatttgcaaatatgttgtttcgcttatgcttaaaaacaaccaaccaatggatccggacatctttgtgtttgaggaaaagggaaaagagaagaatggagaggtatacaaaataaggtgagtcattagtgcatgattaaattagtattaacaattttaaattttaaaaaaatatttatatgattttttaaagcaattttcctatatttttttaagaaaaacaccgtttaatagttcgggaagcgtgcgcatgaaaaacgagataaatcttcaatctttcacctgctgaggaacgcagtcatattgagattcatatataaaagtagacttactttgagatgaaatggagggtgtatttttttgttgaaaaaaaagttaaatagcatccctttgcatgcccttgacaatttttgagcaggatcacattaagataatgtttaatttgatatgtatacgagtgttacatgtaatactactagttatacatgcggtactactaatactgtgtgcaaaattaattaattgtgtgataaactcaacacacgcgtttgctgcatgtgtagtattgtacaagtaggcgtatgcatctccaccccatgaatcaacggtagatagatagcttccctgcacgaatctcaatgcgggttcctcggatcgtggcggctgttggcgccggagctcgggtagtcctgcgtcgtctgcatgtccatccgcctcgccgccgccgccgccgcctcgtcggcgacgaccggcagctctccctctactccggccatccccaccaccgccgcgtcctccgccgtcgacgtcgtcggcatcaccaccgccgccgcctccctgggaagcagcgccctccggtagccgacgacgctggtggtggttgtggtcaccgccgccgccgccgccgccgccgccgctgcaaggaggagaaaacacagggcaaagatgaggagcatggcctccggcgagagttccggcgagccgaagagctcgatcaagccgtacaaaccgtggacgaggaagacgcaggagagggcggccagcgccgccaggatgaaaggcaccgagcaccgcgccttcgccgccgccgtcctcatcgccggccagccaccaatccaatccaatccaagctagaggaagaagaagaagctagctagctaagccagagtactatgggcagtgacgacgagctacacagattaattcagattggttgctcgcccctttatatagcggaagaagtacaaggaatgtgtgggttgctgtggccaggaagcagccatgggtgaggtagatatatatgtatgcaaagatcgatagatgagaggtcgcgaggtagaagaagggtcacatcaaatggaggtcaaacgagcacacaatcactagatcccactgacactaccaatgtgtacttagagtaattgtttagggtttattaccagcaagcaatatgtagggatgcggattttcaatctctacgtagggatgtggattttcattccttgagagagaggatatctccatgttctatgtatgccgcgttatccagaattttttctaaaaaaagaagatagaataaatcaatatgtaatatatttattgtacaaacatgttatcagggctatggataccacatacctaatagtagttggctaaatctcgacaggactcaccacataccatgttttatacggaaacaaccttcgggtatagaaggagttccggataaggaaagataaatagagttctacatagaaacgacaaggattactcggattgtatccatattggtttccctagttctacttggaaaagggaacacgtatgggtataaatacaagaccccctaggaggagaggggggacgaaacaatagatcaagacacaagatcaacatataagctaacatgcaccaagacaagacgccggatatcgacttcagagataagcatggctagtcccctacgatgtctacggatactgtcaggagagacatagcgctgtctttgatctcgctggatgcggattcgaggaggaaggctaccctggcgtcgactacgagtcagcacttcataccgccaagtcgacaacagttagataggctaccccaaatattgtactggtgtgattatggtgaataaaagcaacgaccggcttcggccaacaggagtagggttattacctgacaattcaggggcccgaacctgtataaaaatcctcgttcccatctcatttacctcaatcttgcatatatcctaataccaacgatccccatactatgcaaataccgtagtcgtgacatcaaacgtcgacacatgtaaattcaacttggacaaaaaaaagttgatatttctcatttatattgatctaccatgttatgtttaaaataaaaaattatttatgacaattggatttaccttaaaaatgagagcgaaatctccttaatgaataaagagttttccgctattgtctatctagtacgaatatgggacatatcgagaatcatagttctatcatatacttcatccattctaaaaaaaaccaattccgtatttagggatataggatgtgacaacgaatctgaatattcgttatactatatatgttatatcatagtatgaggttggttttttatttttggcggagggagtattagctaggatatttttagttagagagagtactatagctggtagtagactactagctaggttaggcttaggtgtagaatcattggtctttttggcgcgaaaaggtggggtcgtgggcgtgcactccactaacacacacaagggtcgatcacgcgcactagaaatgggcgggattacggccacgtatatacgaccatgcacatacatgcgtcgttgcgtttcactggcatccactacgatccaactgtttaattgcgccgtgattatctatcaatctatctaatcttggctggaatttcatcgatcgaaaagccaacgagctttaattagtttggccatggagatcgatcagaaataatggaattagtcagaaaataattaatggttaattatccagtggatgatcacacgttttcaacgtcgaaccatctcgatcgatctgacatgcatgtatgatgtattggtggcagtggatctgtatgtttgtgtgtgatacattaggcatgttgagatctccatgagagataaagcatggtgatctgatgacacagacataagcattgacctgcacatgatcacccttagctttatgctggattgattgacgggcaagtacagaaaaagggaaaaccttataagtaatttacgaccaagatctagctgtttggcaatttggcatacattttctttaagaaacacgaacgcctcgtcgcccaaagatacatcgtttatatcattaaaaaaataattagacataaatacgatcactcgtgtcaagtctaaaacttgaatccatgtgggctgagatttcaccaaacctaatcagttgagctatactcacctcgcaacaatttggcatacataattttagttctcttcatcgtaaaccgtaagtatttttagagctgaacgcatgagtattaataagaaactacataaaaatgatcgtaggaaatcacgattagttgagaagataaattagctaaagaaattaaataaagaataattataattgattgagatgagacgataactagagaaatagcttcatttcaaaacaaagtttaagtggtagaaatagcaacttctgactatatatgtatctagacattcccttacaaatacaaaacagaagaatattatattttggtacggactgtacaacttcagagtgagttttttttttcttttgaagaaatctctgaaagatatcgtctcttcgatcttgtctgaaagatatcgtctcgcagctgcaaagaaagttttctgacggctgtttcgtcgatatatccgggctagctccatgaaaattcaaggagacgcacccctgccgtgtgtgaagtgtcggtcggtatatcacatcatatatatcagtcttcaaaagaaaaaaaaactccctttaccccctaagggattttgacattttactggtattgtttgaccatttgccttattaaaaaatagaattattatttattttatttgtgacttattatccaaagtactttaagtacaactttttattttttatatttgtacaaattttttgaataagacaagtgattaaacgtcacaagaaatagtgaatatcccttatattacgatacggaggtggtatatcacatcattaattggacatgacctaatttctttcggccacggaatttatccaagccgttcatactgctaaacacgtgtggcaattagctgtatagctagctggagtagtactagctagaaccgttactaccaaacacagatctacctttaatacagatcaggcatgatcgagatcgagatggttaaattaatctctcacttgagagtcaaaccacttgcaaaaagtcagcatggaaagaaaagacgataaagctagatcgacacagtacatatatcatgttcagattgagatgatcgatcgaagagacggcgacgatatatatgtatccaatctagaattaattagtactcccttccgcttcagattataaaacattttaactttagtaaaagttaaactattataaatttaactaattttataaaagaaagtagtgctgctattgtaaatattactatttttttctataaaattagttaaacttagagtagtttgactttaacaaaatttaaaacatcttataacctgaaacggaggaagtggtaagttgcaaccggattaattattctgcaacacacttttaaagatacgatttttatttaaaaagaactttcttctgttatatacatgcatcatgcatcacttaaacgacagattatatttaattagattgctagattgattactgatcgaataagatgcatctcttttcttttattttagtgtgtgttccaaacttaacttttcgttagtgcccaagacccttacttgtaatacgagacactatatatagcttctgttaaagatcagatatcttatttcattacagaaagaaaaatattttctatataattaagtagatatatatgatagaacttttcataaaaagcgctagcttagacatgcagataaaattaaacatacatagtccatgcttagtccacacagtgagaatccgtgatacaagtacagagcatccgtagaaatgggcaacttgcaagtcgtgtcgtcaattcgaacagatttatgcgaggattcgggtatttggcaagagagagagagagagaggcgccacctttgatttttgctgctgctaattgtcacacacacacatacacatatatatatcgacatagtgtgggcccggatcctctgcaataatacagtgaacaatgtgagaagcaagataaatcaatgcagtgaacaatgtcgatctattgtagcaacagtaacagttgagtaccacaacagatttactgtagcacactatctgattcttggtttttgatcgaacggtctccatttcctctaataccaggtacttcctctgtattgtattttaatgtatgacgctgttgactttttaactaacgttcgaccattcgtcttatttaaattttttatgcaaatataaaaatacttatgtcatgcttaaagaatatttgatgataaattaagtcacaataaaataaattataagaataagatgaaaggtcaaacgtttgtcaaaaaaatcaacggtgtcatacaggatgcagtactatagattctctacattacaacttgcaattcagataatcccgattcacacagtatacgtacgtacgtacatatcgatcgcggtggcagtgatgaagctatagtgactgtagtggtggtggtgcatgcgtgagctaatcactcgcactgttagccacacgcatatgcccaacccccacacacaaattaaagtgcctctcgatcgatcgatcagtctctcaccacatcatgcatctcttggaaagttaattagttttgatacacgcaatagtccactactcccactgcttgtacatcccagcgctgcagctaataggttgcctaaaataaatcaactgttacgttctaaaataaatcacttttcaatgttgtctgccgattccctcgtcttaaaataaataaaattttatatattaatttaaacattgttaatcttctgtctcaaataaatcatttttttacatgaatctacatagaacgaaagaagtactccctactaattaattatcccattccttactaggttatcgtattttgggacggaagagtagcttgtattgcagattctaatatgaactagtataatctagttactacgagtatactctttctgttttaaaataaacgacctaaaatatgattggaaattacatattataacgaatagtattagataaagtatgttgtcacatcttattcgaagttgatttattttgagactaaaaaaagtatggtgtgtgatctttcgtggaatcatcccataaaatttaaggaatgatgattctgtcattcatctaacaagttagcatgtgcttttgaagaataagacagtgatggatcgacaaactcattctaatcctcaaatcaaccaacttgtcgatttaaagtggtgaatttatcatcccactactcgaatcaaataggccatatagaaagacgacatgcacgatataactgagctagctagcttgaaccaggacggaaatgctatatgtatattagtatatacagtataattaatgcgacctacctaggaggataacgaacttggatgacgtgtacatatgttgcatgctgagatacgtacgctacaagatcgctatatatattactatggctgtgtgtttagttactttcaaacttttgacttttctatcacatcaaatgttttggacacatctatagagtattaaatgtggacaaaaaaaataattgcgcaatttacatgtaaattgcgagacgaatcttttgagcctaactacgccatgatttgacaatatggtgttctagtgaacatttactaatgacggattaattaggcttaatagatttatctcgcagtttaatttacaggcggaatatgtaatttgttttgttattagtctacgtttaatattttaaatatgtgtctatatacattaattttttttaccaaaatagctaaacacggcctatatggaatggatggacacagaaaaaaggtttcttacgtctccttcacttttcttacctcgatcttgggaacttattactccgcacctataaaaaaattactgtgttcggttgtactacttgggaacttatttctccgcacctataaaaaaaataagtagctcattagcatataattattaataattagcttagatgatatagaaataaattaatatgacttttaaagcaacttttatatagttttttttaaaaaaaagggtatcgtttaatagtttgggaagcatgcctatacttttattcttctatttgtgtcaaaagttttagttttttaagcaagcagcatattattgtctctcttgtgctttaacaaatccgattaaatctgaatagtgcaagccgcataatatgtatatggagcatgcatgagatgaaatgaaggcccacctgccaccataaaaaaccatagaaaaggacaatgccttgagccgggtgctcgatgaatgatctaaaaatcgggcgtccacctcgcctcccccatacactactatccatgcacacgcatgttatatcatggctataaatgcatgtccacgcaagtttttatatctcatttgcacatttttgtgtcttcttcaaatgtattttcttctaaaataattgttcattctacaattcgattacatctttatattccttataattaaacctttataacaagatatcacacgattatattttgataaaaaattgaacgttgtttcaccccttgaaaaaaattgttttagtttaccgcataaagtgtttcagagaaatggtattaaaaaataccaactacaacaccagtaaccacctagtatatgaaaacactaagtcccaacaagcaaaacaagaaaagtcatatgaaagatacaatatatttgaaaaaacatgatattgttaaaatatttttatatcacatatgaatattaagttgtaactatcgaaacactacaaaatacttggtgaaacattccaagaatatcatgtgtaacatttgcaaataaactagtaaaacatcatacaatactagttgagactgtcacatctataaaacatgtgcaacatttaaaaaatccatgaaaaaaatctaaatattctttttatcgaaatataaccatgtagtcgtgtcctaaagatttaattgcaacgaatttagcgatgcaatcggatagattggagaagtaatttaagtggaaaaatagtttaaaaattgctaaagaaaaacttatagcaacccaaatactaaaacttatactgacttgtttctagtaggctctgtaggatgcatctatgccaagtctctgacggagtgatggagactcaggcgggcgtccgattcttagctacaaattggacgctcaatccggagtcacgtcccataaaaaaggctggtgtggttgatgtagcacgcaaattcggatcaaatggttttgattggcaaatcgggggttggtttaattacctacaactttttttttaaaacacagtacagcacactcatctttatgaacgcacacacgcataccctacccctatgaacacctctagaagacgggatgagcatatgttgagattcatgaagtcacctcagacgcctcgttatcaacaggtacatcgcttagcactgtaaaaataattagctataaatatgaacacccgagtaggctggttctaccacttggaaccaaaccagttgagttacgcacaccttgcaatgacctgcaaattttgatctattaggccctcaataatccctcaataatgccaaaatattagtatgaagcatatgggtatgcaactctgtatatattcaaacaacaatttagaattcctagagctccatgtaagatttgttggaaagctcgggccgtcgcgattcagtcatctttctaatttcaaaattatgttaccgtgagataaacatgtagattggggtcaaatataatctcatagactagtatttcaacattaagtgactgtatagcttctgttaaatgcaaagactagattttatcagttttcttaaaaatatatactgcgatagttaataaattacgtttaatttagcacttattttttatattactaaatattttagtatggtagcgaaacaaacaaactagccccacatgacctaatcgaacaaaccatgcataccagccaagggaaaatgcaaataaatgggggcttatgtgagatcaacctcaaaaccccggtagtggtttcttttgtaccatgatgtcatcatcagtattcatgtatattcctccctacatgcactctattgtatgtgttgggcacaatgaaatgtggctacaacctagctgatgtgcatctcacaggtgtcgccacaaaattaaatgctgtggcttcaatctgtttatgctcttaccaaacaattagagcaagtttaatagtatagtcaatttaataaccaatttatacaatagttaccaatttaataaccaatagagtactacacaattaatatctggtcccacctatcatacacacatgtattttagagtccatgctatagctggttacaaatctgtagcccgctgttcttttctcttattttttatctctttgaaatatctttatagctggtttatagtccactgttgtagctgctcttaacagtgcctattttttcggtcacacagggaaaatgctctcttaattatgagtgtgtactactactctaccagtacacatgcatgtttgttagtgaccgaaatattccatgtactagctagctagtgggttttggtgatgcacagagccagaggtgcatggggtcatatatgtgtgagattgtgaagtgaggatgagaggaagcttccaggtttgttggaccatatcaatgatggatcacacatactccctctgttgctcagaaactctaacactaacttctcgaggttgagatatataaggagaaagataaatgatcaaaatactcctattgaatggaacatttactagtacctgttcagatttagagtactaggaaatatcttatccaatactatgttcttatattttggacgaaggtagcaataaagttataatcaatgatgtgtacgtgagggttatataagagatagaatttttttttaatttacagaccaatagcagataataatatagaagttggtttattttaggacaaagttcaatctttagaaattacttcatccgtttcacaatgtaagtcaatctagcattttccacattcatattgctaatatgaatgtggaaaatactagaatgacttacattgtgaaacggatggagtagtttatttaggacggagagagtatttcattatttacaacaatgttaatagacgtcagattaaggtattgttgcaattgattatagtacagttggttagttttttaggctggaaccaatctatcttggtcaagggtagattcagtgtgggtgcggcagaaagagagaatgatgaggaagaagacgtaaggtggtgttggagtaagaagcaaccccacaactgatttcagcttaagcttttaattcagatgcttaaatttatagctaactatttacttttaaacgctggatgatatattaaaaatgaacagcaaactaataaatattatttggatgataaattaacaacaaactaaatactgttgcctgaaccgtaaaatcacttcctccacatatcctccctctttcccttacgcattgggctatgttgggcccaaatgcttgcagagctttttaattccgaagagactttcaggttggaaataacttatgcagcattttggttggaaataaatccaggccaatttatattgctaattaaattatgtggcaccattaaggcctcatttggtccagaccaaatttctggaccaaagttattatacaatgaataatcggtgcgtacgctgcatccacatcatacaatgacagatcaaattgatggaatcaaattgatggccacaaatccatttttttagataatggaatgaaatagcatcccggcttttaatcaaaagagctacagccaattattacaaactagcactctgtaagagtgaagtccaaatagaagcaaacacaccaaccaaactagacaaaataacattattccagtctattggtaaatctccatccatgattggcaaacagttgcataaccgtcacttcaagcttacgacatgcaacaattaagaaatctgcatctttatcacacttttgtaactgtgcccacagacgaagccaatatgttgccttgaaaatgacctgcatataagtaacagtaggtgatttgtcaaaaaccctatcattcctactcagccacagagcccaacacaaggcagaagctccaacaagtattagtttgctctttttgtttacaactccctgaagccaatcataaaaaatatgagatatgctagtaggaatatataaaacaaaagaaaactgaactgctctccaaataaacttggccacaaatccatagatcaatcgcattattggcttattgcaccttatacaagtacagaaaactataggcaccgaattcatcatcatctctcgatggactaactcatttagtatttgagcaaattgtcgcataaaaaatatcttgaataatgggcagtgcaaatcagcaaataagaagcaaagatcaccgttgaggcatgcactagagacactccatttgttcagcttgttgcatttgttacatcaagcttataccaaaagaaaaattcgtacatatttattcacttcttattaatttcaggctttcagcaaagatttatgttgtccagagaaaattctgctcatatgcagttctatgcaacttatcatgtcagtcattttctctttctgttttttttttgttctttttgaagtatcattatgtatttatgttagtttgggttacaaagaattctgaattcctgaatctgacgacaacttcagaactgacaagtgtacactgttgtttcttttttctagtggaagttggagtaattatgagttctgtccatcatcttctcctctatccggatgatgcatcaattaagtcaactgctacaagactcgttcttcgtgaaaacactggaagataatagagaaatctcgtcttgttggcattaaaggaaaagccaaaaatgtgggttgccgaggctcgttcaggtttcagaacttgcttcgtcagagtaggataaaatggctgctcctctccattttcataatagaaaatcactagtacattgataaagtattcatcatgtcaattgtccaaagaaaatctgctaatatgtacttagttcctgaaagctcatcctacttgttttgtcagtcaagggtctgaatgcctgaatctgatggacaagttcagaactacaccctgcaggtgttcattgatgggattcattgcttaaactgtttatgccttcagatatttcagaagttttactagcatctagttggagctaaatcttggcttctcttgccctgtttccggacgatgcatctatcaattgccaggatgaattgtgggttatgaaaacatgctgtctctacgcgttcttttggttctcagagacagtctgtctcctgattttgcattatttaggattattgtctggtttgctaacatgttaaaaacaaaagcaatgcagcctctgaatatctagctgagtggtcacatgctgaaaattcttttcttctgtgaactgtgatggttctgacaaaatttctttatgatctagctgagaaggaagttaacatggcggcctaacatgttcaacaggtgattgagaagttctgcccttgcatcaagattctctctgcacaagtaaatgcttcacatggcaacataacatttttcagacggtgctttcaatcctcatcttcccagtcattcaaattcccatggcctactgaatgcttccattaggataagaactggactagcttagccactgaacccatggttaattatgaatgctttggtaactactatggtctagtagggcatgtggacagcaggtgaagggctcaaagattcagcctcttgaatgggcattgcaaaccagatgcaaatcaaacataaattcagagtcgccgccaaggcacagagcaactagattactcacctgaaaaatctgaaatcttggtctactccaccacagtttcagacacttgacagacaggttacacttaaaaactcaaatccatataaacaccacaaatctttatcatacgtcagtaccagaacctcagagatggaaatttatcaaatcatctaatggtagccatcctgaaattgtacttattttttcactgtgccaagttgagtaaaggcttgcacaacctttaatttcccctgcatcaactttacttagctgagctgcaaagcttcttgagaaaaggccacatcttgcaaaatctcaaggccaaagtacagagcttaaatgcagatccatgcatgcaccaatgacctatgtaaagtaaaggacccggcttagcaaagagaaaaaggccagggttgggtagggccacacatcacatgatcattctgtactaattactcagaccatttcctgtacaaattactcagagcatctgctgtgtaattctgtacaacactatatagatcaatagatgcacttgagagaacttctaatccagtgtgtttattaattctgccgatctactccccccatttaaaattatgtcattctagatttatatgtatcatcaatttatagaaattcatataatttaacgtcataagatttatatttttatattcaccatgaaaagtaatttcgtaatatatactacatacatcccaaaatataacaactttcaagtacaaatctagataaaagtatgtctagattatcaccaaaagttagtatattctaggatggagggattaattaatatgttgttaaacataaaaacatcctgttaaaccacacaaatttaaaaaaatggttgttaaacttaggataaaactaaaacaataagtaattcgaaacggacggagtaattaaaatgaaggagcatcataggataggcatgctcgttattcagccgtgacttctgagaggttcttcaattcgctctaatttcattcatgcatgaccgaatggctattttctttttaaactaagtttcagatcatggaaaatagaattgtttttcttgtggatgaaaggtgcaaccagctttgtgtctttttctggatctaggtggcccatttgttggaggatcatttcgatcggctttggcttgtggtggtgaagagctgtagatcgatgcggatgtgtactggttactgatgtgaagttctcctattaatgacgtgacatttaagagataaacttatcgctttggcttatttatgctgagcattgaacacttctcgttaataaatttcctggggcattttctatttttcttgatctgtaatactccacccattttaaaatgtagctatttctaaaatttaaacatgtctaaaaaaatatagctattcctaggtcaatgctattatgtcaattataatcctatgaatccaaaaagccttattcgcgaacgtgcacacaattgctagcgaacacttcctgcctgtataacaacaataggttagggttaaggggtggaggggggctaagggggctgggctgtcggaacgtgcctacggcttgcgaacacgctcgcccattagacccaccctatgaaccacctcgcacccactaacctacatattccttcatgtcttttgtgttttaaagaaggcattgtggtatttttacctttattccttactccctcgaaaaacctagaaatagacattttgggatagaaggattatgcactacaccctccatcttttaattgtagttttagtcttagaattcgtccttaaaaatgtgtggttttagagtggtccactatacctctttaatgctactactaatagtaatctttttttctcatttgtagttattgaatcactacaaatcatttatttcggttttagagtagttgtttggaagaaagggatttgctctgtgcatttgattggagaagtacagaatcaccacttgttttctctcttgtccatacgggaaaatttccatgaagttttgatgtagcttcgttttcgatgaaatggtaggaaaagaagagaaaataaatataaaccttaggaatactattcacgaattcctttgttccaaacggcgcaacagtaaactcctccaagaggttgccctttctccatctcctccatcttcccatatgagcttttacttgttgaataaattaagagcttacataagctgattgtcaaataattaaaacaaatcatgagtatattaagaattgatgcactagaccttggattaaaaccacatgactcttgacagttgccttagcactgtcaagtactccatccgtattagaataaatttattttttggcacatcacatttattctaaaataagttaatttttaagtaaccattataccggagcttataaaaatacaagataaatacataagggtatcctaatatatttttgtattgatatatatatatatatatatatatatatatatatatatatatatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgatggattaaaaaataaatttattttagtacggaaatcgtactttactagcatccataacatcatcttgtctcaccattaaaagaaaacagcattatgctgtccccgggcctcgcataattgcgttgctcctcccctcctccctcgaaaaccaaaaaaaaaaaataccaccacgaaattatttctccttttcgttttcggaaaaagtacgaattaccccctgaaccacaaaaccgaacattttacaccttcaactatttttaccgagcaaataaccccctgaatcaatccggagtagttttacgcctacgtgtcagtcagtctagtcagtaattatttattaaaaaagtcggtggggaccacctgccagattctctctcctctctatctctttcccctctctctatctcgccgcgttgtgccgaagaactcctacatgcgctcgcccgtcggccatcggtggagctcaggggatgctgctgaagcacgcggcggcggccagcccgtcgagctcgccagccgggcctccacctccttgtcggcataacatcgcagcaagtcgctacgcggtagcggaagtactcccgcacggcggagctcgggcggcggcggcaagcccgtcaagctcgccggccgggcgtcctcctcctcgtcggcacagcagcacgttgtcggccgaagcactcctgcatgcgctcgcctggcggccaacggtggaactcgggcgaaagaggatgcaacgacggcggagccggagctcgcgcgcaggcagtgacgagcccgctgccgctgtcgtgctttctcacactttgtcagccacgcccggaaaatcctaacaacctacttctagctgccaacaaacactcagaagattggatcaaatcagtacacggaggaagacgagattttggtgccgcgtactgctgctgctacttttctggtttgttatcaacataaataggaaaactacatgcagactcgccatcttcttgtgggtgtcgttccaagacgatgagtccggccgccgcgctcgccattttctcgcgcaagtccggcgccggctgccgctcatcgaccatcgccatcttcttgcacaagtccggcgctgaggcccagctcgtgagcttgactggccagcgtccaccggcgcgcgcctcatactcggcctctgccgccaggaggctcgcagccgccggcgcgccgctcgtcctcggcctccgtcggcgcgtgggattcctcgtcggccttcggcgtgagagagatagagagcggtgggagaggaaagagatagagaggagatagaatctggcaggtgggccccactgacttttttaataaaaagtattgctgactagactgccacgtaggcgtaaaatcacttcggattaatttagaaggttatttgtccggtaaaactagttgagagtgtaaaatgtccgattttgtgatttaggggttaattcgatcgcacgatagttcaagtgggtaattcttattttttcctttcgttctcccccgcgatcgagcgacggcgaatccaatccaggacaaaggcacacccacgtgcggatgcctcgccatgccatgccggcgtggggcccactccgccagcgactgcgggtgggcccggataaaggtggggcccacgggtgggggcccgggggtggcacgtgggcgtgctggtgtggtggtggtggtggggccgaaaagctgacggcggcgaggcgactttcccgggctctccgttggccgtcgctgtcgctttatcctcgcttttgggtgtgggccccactcgctgaacgtgaaatggacgcgcagatcagatgtgggcaacgccaaaatatgccacggccacacgtaacccttacacaaatctcctgctctttttttaaaattttttttgaaaggttggttttttcaaaaacttattacgaaactagattgtaagaaaagcttcattaaatactatttttcggttgaagttttttttttgcacaatctagtttcacagtaagttttttttaaaaataaccaatttgtcaaaaagagggggggacacaactctaagcatagtagtggcggagctaaaacgaaatataggtattactatgcttgaagtgcacatatggtgaaaataaataaataaataaaattagcttgggttgttcgacatcccctagatacatatagctccgctcccgatattaggctcttgctccaaatattaggtgtagcataaaaagaaaaagaatactccaaatataggtgaggagtatatgcagaaattggaagacacgggcaaggttcacagtaccaacgaaaaccgatcgaattccgcaaaattttgacgtttcgacacggctcggaatcaagtttcgatttcgaaggttaaacagtagatttagtcaaaattcatcaaaaaccgtgataccgatggagctcaaaatttagtggtcaaccggtaatgtaaaccatggacacgggaaaatatgtcgcagtcgcatacggcaattttccgtattggtgtatttttatgtttgtcgctactactactatattatccatttgcactgcatttcaaagttgggcatcgctttaccacaagcgctcagattgtatacatactaatatatgctactcttagaaaattaagggcttatttagttggtgaaatgaaaatttttgggtgtcacgtcggatgtttgaccagatgtcgaaaggggtcttcggacacgaatgaaaaaactaatttcataacttgtctggaaaccacgagacgaatcttttgagcctaattaaaccatcattagcacatgtaggttactgtagcacttatggctaatcatggactaattaggctcataatattcgtctcgcgatttacatgtaaactgtgcaattagttttttctttttatctatatttaatgctccatacatgtgtctaaagattcgatgtgatgtttttacgaaaagtttttggagaactaaacagggcttaagtaaaactagtcatgtagtctctccttttgcaggacttttgatctagtttaagaacttttgtatatgatttgttagttagcttagcttttaagaaggttttgatatgagttaatgtatttacaaaatattgattggtctaatcaactatagatttagctaaattatgctatatttcttttaaaaaaaggattcactagaagcctcctgtgttttttccctcatagtctttgcccgtatcatgtaattcccatatgtttagccttaccgtttaatccaatgaacattgtttattaaaattctttatccaacagttttcgatgacatgaagtatttaggggctgttcagattgatgtcattttcaaccgtaccatttattgtaaaattatcaaaaaattaactacatttagtttattgtcaggctttgagaaatatataagaaattctgccaaaattttgataatattatcaacttgtcaaaattttaacattgccaaaatttggtaagatttattttagctataatctgaacaaccttagagtatcataatttaaagtgcaatatgaattgaaaaatggaaccccattgaattttgaaagtagcacaattttttttaattgctagagaggctggaagggcaagtcgaggagcaacgcaaacgcaagtgttctcaaaaaattaaaaacgcaaacgcaattagttcgagtagggcccacctacctgccaaaaagttcatgctctgaaattgcctcgtcaaaagcatccccgtgacgtggatccgccagcggctcacgtgaccggctgcagcaggtcgctgcccgttgtcaattcgggcctggttttcgaaaggacaacacaaaattcgggaaaattcgagttcataaatttataatatgattttataatttataacaaattggtattgtaaaattgtaagttcacgacacctataattacgtgtcagatcccttatgatttcatatacttagagcaagtttaacagtttagccaacttctagctctaaatcatttataaccaatgcaatagctaattcatacaatactccctctggttctatattaattgacgttttggacaagattgaggttaaacttttataactttgaccatcaataactttaaaaatatttagtttaaagaaactagaaaaacatatatagatttgtctttcaaaacactataataaaaataaacatgcatttatttattgtatatattataatagaaaaataaggtcaaagttatatcttatagaacgtgtcattgtccaaagcgtcaattaaaataaaactggagggagtagatgcttactacactattaataactggtcacacctatcatacatgtattacgtcttggagtccgtgctacagctgattataaatctgtaacccactgctcttctctctattcatttatctctttaaaatatgtttatagctagcttataatctgctactatacctgctctaatataacacctaatggttaagatttattgtctccatttaaaaatataaacgcttttagctgtgcagtgagtactgagggagtaacatttccctattacctggaaaagaccctcatgcatacacataatcacgcgcctacatcacacacacattaaaccttatgatttgaatgcaaggcatcctataattctatccactagtagtattcaaacttctaaattagactaaagcgaaatctgttttactattcatctgtcagaaaatgtattttataggttgtttagtatatattaaggttaagggaaaatatttctttactcgtctcagtggttaaaatttaggtaaattttgtaacaagatattgtggctgcgcggttttagatccgcgcaaagtgatttttaaagaaaggtaatctttaaagttagatatttgctggtgaacaccgtatccattaaaacaataattttcaggtgaggaagagagagtaatcacgtgaaacgtcaaaaattctcatgggcccacatgtcagctctcctatcactcttcctaaagaacttaacggaaagccgctaacgaaatctgttaggtgatggcatttctatgacaaattaccttgtacgataatattttataaaattcacgcttatcgatgatattttgtgaaatcgggtgtttgtcaatgacattatttgtattttctcaaaagagaaaaaaaatctttttagagttgaccggtgcagccggtctccctcccataccctgcaggctgcagcagcaatcaatcagaaagcgcgactcagctagtactacttagagcaaggataatggtgagctataaactagctaaatgcttatgtggaagagagagataaataaaagtggagagtgttgactcttacgcaagagttagctacacacaagctccaagaaatatacattaaatttatagagagataaagagagaggatgaaaaaaataaagctaaccttacagctaacattatatatgttagctttaacattaacttataataagtagtgggctgtactactaaacttgctcttagggtggatagtgagccagctcggctcggtaaagctcgttaggataacgagttggctcggctcgttaggaccggctcgttatcctaacgagctaaaaacccggctcggctcgtttaaaagctctagctagctcgttaagctcgcgagccaaaccatacaaaaactgcctctagccctcagcaacagccaacagcaagcatgcataatgatagtacgataaattgttacatgaaaatatcaaaggaggaggccgagcacgaggagcagcttcgacgccgacgagagggagccgaaggtcgacgtcgtggcgacgccgtgggagcggcatggggagaggaaggcgctgcagaggcctgggttaccggcgaatgacgtggcgttgaagtaggcgaactggccggtcgctgggacctcgccggagagattgttgtcggagaaatcgacggccgttaggctctgcattccggcgcgttgtgggacagattgagatagttgaggattcgtagcccggcggcaccgatggccatggggttggcggcgttgagttccttcggtggacggtggctgaggagtggccggatgcggcggcggcgccgctccttcggtggcgtggcggcggcgcttggcggtggtggctggctggcggcggcggcgcttggcggtggcgggcagcgagctggcggctggcgggtggtggtggtggctggcggcggggaggatgagaacgagagaaggggatggatcgggaatcggccacgccagatcgggatcgaggtgtcattagggttttcttggctgccgagttgggctcttgggcctccattctctaccaaaatccaattccaaaggcccatagctcatatgccctggctcgtgagcggctcgcgagtcagctcgattcgttaggaaaatcaaacgagccgaaccgagccgagcttggtcacgagcagagctagctaacgagccacgagcttcctccatccccgagcttcct

SEQ ID NO: 79278 - DNA, 9266 bp, Oryza sativa
gcgtcggatgtttcattatgcttgtttgatgacttgaattattcacttcatctctcaaatataatggaaggtctggagagcctatgacagcatggtatcagagcaaataccgactacaggagcccccttaagttgtcacttagaattgcttcttaaaaattattttgagtgctatgctctcagttacaaattatttgcaaaaatcatgttcaatcttatatctcatccttctttagagattattttactttatgtctcatgttttgattttaaaactcttatcttgctctataggaccgaaacattttggaaatactatttttgttgaattttatttgaaatcacttaataatcacagcaaaacagtaacatagtgttttgaaaagttttgaaatccatttgcaaactactcctatgtattagcacggatttctaaaatatcgggttaaacatagcccctagtaaatgggttttgaaaatgagtcgataaaacttaaaacttgctagacaatattggaattccatctccctatgttatctctgaaccaaaaatgaatttggtgggattttgtactttcctctcccgatatttcaaaatttcaccggtatggcctaaaatgtgtagttgggtatagaatagaatttgctgtgcttaaccctctagattgtttgcttagatggaccacccaaaattcatctagcctctggaccaccctaacataatacgactaaaaggtgataaaatttatacaacctaaaacttgattaaagtttcattttgtgccggttgttcttttttttttctggaatcttgagtcagtctgcttgttatttttgtctagactaaaccgtaggtgataaacctgagaattttttacatgcatcatgtagactaacccagtaagcatcatgaattttggcataatttttagacccgtgcatcatagtgaaacaatctagatagttagcataatcatattgtggaaatttgtagtagctgcattcattttttttcatgtagcccaaaccataattgattaaatatgcatctttttacagtagttttcatacataacctgtaggctccacgaattttggttgaatttttgagtcattgcatcatggcataaaaattcatataattctgtatagttctgtcctgaaatctgtaggttgtcagtttcacaaatttgtgtagcctaaactacaaatgataaagtcatgattccttcagggtagctcctaatctaacccatctatctctctgatttttgtcaaaatttttgtatctttagagctagacctaaaaatttgattaagacagtaaagtgatgaattccagcacctagcactcatgtcagattagctcctaccttctgaaatttgttaaaaaaaaaaaaacctagtgcaaaaaaaaattattttattttaagggggatagtaagccatatttgtatcaaaaccaaagataaaatttttaaccttgcataattcttcttagacctaaaatagaaatcccattctagtaagccctgtaccgttaatatgaccagaattaatgattagaggtctatataaccataggttgttaaaaaaatgtgtgtcgaccttaataataacagtaaggaaaacctttaatttgtaagtgttaattttagaggtttttggctaatccgtgttctaaattttattcttatagatgcctaccatgtacacaccgtactgctattgccgtgggttcacctggaactcaactcagcatgtgctatggcttatgcttcagtacgcccgattcacctatccacctgagtatcatatcctcaagaaacccattggaacatcccaaaccgcagtcatggttcgtgtaagcattcggggtagaactccactagagaaagaccttcaatatactggttatgggtgggatattaagtccgctttgcaaaactgtgcttatgttgctatcatccgccttcgctatgagctacctgagatagaagaattttactgctacgttccatccttaactgagggagctcaacacactacctacccagggttagctgaaataggtgtaggactacataccccataccttcaacttgcaaactttgtgcgctcactagatatgctttatcgctcaacctttgctgagctgcaacgcgtccgcaccagggtagccagtttagaaagaatcattatgccaaggtatcgccagggacattatacaccggagttcatgtttggtgaggatgccatgcttgcaccagcagaagatataccaccacctgttggaatgtatattgaaagaagcccaccttcgcgcgtcgatgttaggactgcttatcctccacttggaaccactggaccgtatggaccgccagagtatgttcaatggtatggtcgagtcttcaagctgaggatgagagattaatcaatagtcctatctaacctctactgccacggtagtatgacttaaggacaagcttaaggaatagtctaggtatgtggtggcccattttggaagaaaatcgtggtatgtaatatatgtaatatggctgccatgtactccatttatgtaagaacttgttggatggatgtaatagtaactaagaactcgtttgtccttaatttagaaacctctgtgcttgctgtccagaactttggaaaatctgtaaacataagttcatctaagttagaaatctggttataagctcctgttaatatgaaccaacatttatcttgttggaactaacttctctagtgtcaatttaactaactatctaagcttccataaacccacaactgagtagaacttgccactcacccgcgaaataaaagtttccaaatgttttatggtagcaagtctgtcatacaacttaaaagaaattattatctgctgtcaatgtcaatcctctggagatagtcataacttaagccaaccctacccaaatctcggggacgagatttattttaagggggatagactgtaacatacccgaaattttaggacttaaaatttcttgtcaaaatagttagaggttaacttctccaaatttcgagagccaaaaatttccgttttaatttaggtgatgatcaacttaaaccattgcatgattaaaatttgagaacaaaataaaatcttttcattcccaacattagactagaaatgtcaccaagcatacatgtacataatgcatgcctaggctcgagttctttgtgcatttggagttttggacttgtattccataatagctcccatgagcataatctaaaagaattatttcactaaacaaacctatagttaatcttgagtgataacatgtggacttaatattaaactcaaatatcatcttctcagtctaaaagaagtttaatgtaatccctataataatattagatgcaattatgaagtgggaacacatatacaaacaaaggtcatcttaattctctaaaatattttgtgcaagataaaatcatggaaaaatttatgtggacaatgattagcacaaacttatcctccgtaatttggtaacgtgttaacactcaagttgatatctcaaattaatcggtcgaagcagacaactaaaagaaatcaaattaaattttaatcggctaaaaccatatttcatccaaaagtacatttaactgcacataagtgaacatggaaaataatttattcaaatactagattagttatcatgaataaatgtaatttttctagaatttttcttctctgtttaagcctcctaaaaattcaatctagctttctaatagcccatctttgtttaatttctgtgagcagtccacccattatttttgagtgcaaccaaagaaaatggaatctaggtgtaatcatttacctccagtaaaatcaacactaattaatttggtccacacattgaattatgtagtttcaaagttagaggagaaaataattccgaaaattaatctaaaaatcaagtttacccagaatcttacccaaccctctcaccctagcctagtttgccacgacctggacccacctgacagcctcttaagcttgccttgactctgtccatcacttcctccactgttccagccgagagagggagagattgagcgagccgacgcgtggccgcaacgtgtcgtcgatctcggtttcccttttctcgctctctactcctcccagacgcgtcgccattctccacacatcactttggagctgaagaagccgagggagaggttctctgcctctccgtcatcctcaacctcgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcaagccacgtcgacaacgccctggagcacgcaccggagcgccgccgcttcaaccatcatcgtcgtccggccattctcattcacctcagagaaagctgctgcgccattgtcattgcctcaacctcctcttcaaaacgcctcaagaaccccagccggaaacatcaagaacacggagaacacatccttttcttcaccggcgccaatctaggatcgcctccgccgtcatcgtcgattaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagaccacatgcatgcatccttttcgttcgtaatcgacttccatgcgcacatgcactttcaccccaaaaccaccgccgctcacactcgccatcggcgctactccgatgtcctctaaccaagaaaactagaggaatggaatcgcgagagcttgctcttcattttatcttttgacctcaacctcaagcgagccaccgtttgccgccggcgagctccagatcgagctcagccatggctagctctgctatgtctagagcagagggatgacttccgtgaattagattaagtgcagggatccgtttacaattatagaaacacactgacatatgggcctaggactgcgggttgattcctagaaaactcaagggcctttgtgcatattggtccctcacagccatgtggacccatcctttaaaatctgaagaaaaattaggaaaatgcccaaacaattatatgtttagcagaaaaatgcacaagttgtaaaatctatataaaatcaaatatagctcattttgaagtgattccagtttctgtagattcttgaagttatgaactttattccaggaatataaaacttgacactcactgtacaaataatgtctctaagatttatctaagataagtcatgcataaaacatgtacaaacttataaaatacaaagaaaattcatttcaactcattttgaaacaaactcaaaaacttcagattcatcatcagacactctctgattaggtaaaataaaagtaatgacttactttgcatcaaaagcctctaaaactattatctttaaaatgactagttttagataagctaaactttagaaattcatgtagaacccaatttagcttcaatttgaataaacttaagttatgtaggatcactaacacatgtatttccaagttatgaaataatattatatacttgctgtgtagtaaaagtctctaaatattcatataaggatttactaacatagagcagccattaatttgtaaaacttgtagaaaattcatttttagtccaaatgaaatgaacaaagtttctatagaaccagcaaatagttatcttcaacatagtaaaataaaatttggcaccttctgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatcctcatccactaaacttagaagaacttggctcatataacaatttctaggttaatataatatattgctagtttagattaaagcgtctctactttataaaatatgaaccatagtagtaaagaccataaacatgtgagataaaaatgttttagttaaccaaattattccttttattcaacttaaacatgaagtagcatgttctgaacctataactcaggagtcatacatatataaaacactatatgcctaaaacacgttgtaacttgtaaaatgcataaagaattcattataaatccaaaaattgtgaaaccaaatgtgttagtcttagaaaacacatctccacacccctgtgaagtctaatctagtaaaaatcactttacaaaagtattccataacactacctaagactatactactataaaccgataaaacttctaaaaattcataactccctaatggaataagataaagataaaataaaaattctttcacctaaatttattttagatcagtaccaacccactgtgcataaatcatgcattttagagcattttggattttcaactctttcggtgtttaattgcatatcgtgtcctttatctagataattgcgtaatcggtgaagaagtggattaggtgctaacaattctctgatcaaggaaagttttctcctcccatcctttgaacacattgaatcccatgatttgaggaatgaaaatatttgtttacaaagttgcatgtgaacttagactatatcggtatttgaaattgggttaaggtagttatgacctatttgctacatattccaccttgaataattgatcctcttgctgtttgaacccctagaaatggttagagtacactctttgtgctcaaatgggtttatatatgctctatgtgcaactacttgcttagccatgcttagaaatatgcaaatgctcattccatctataattaaaatgtggtttgatacttgaacctttgctggaataaaatgaatatgatgagtatttgcgaactaaaatgtgtaaaatgtgattttacacttgggcagcaagtggtgtgcatatagtgttagttgcataccgatagggggagtgtttgcccaagtccataaggaccgaacttgtgtcacccatttaaagttattcgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtgggttcccgttgtgtccgccaccacggcgttaagtttaaggcgtgggcccgccacttaacggttctagacatatttccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaattgattagccgtgctcacggtcatgagtgctttggtgatgtgtcatgagtatagactatgttttaaaaatgtaatcatgtgacattggtttgaaattgataaatgtgttgagttgtgtatgtggtgatacattatgacttattattaagtatggcaataagagattgtttatgacggaattatgaagaagctaataatgaaacttaaaacttgtctttgttaattgaagcatcaactcctttacaaaagaattgcgaaacaaaacttgctttatgctgaaaatgaactacatattgccttcctttgaatatatgccttacatgtagtatggtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtatacccctagtcggtgtgcttgtgtttgggtagtcaagcttccgctgttctctaataagtctatttggccggttggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgggaggttgcagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggcgtcggatgtttcattatgcttgtttgatgacttgaattattcacttcatctctcaaatataatggaaggtctggagagcctatgacagcatggtatcagagcaaataccgactacaggagccccttaagttgtcacttagaattgcttcttaaaaattattttgagtgctatgctctcagttacaaattatttgcaaaaatcatgttcaatcttatatctcatccttctttagagattattttactttatgtctcatgttttgattttaaaactcttatcttgctctataggaccgaaacattttggaaatactatttttgttgaattttatttgaaatcacttaataatcacagcaaaacagtaacatagtgttttgaaaagttttgaaatccatttgcaaactactcctatgtattagcacggatttctaaaatatcgggttaaacatagcccctagtaaatgggttttgaaaatgagtcgataaaacttaaaacttgctagacaatattggaattccatctccctatgttatctttgaaccaaaaatgaatttggtgggattttgtactttcctctcccgatatttcaaaaattcaaccggtatggcctaaaatgtgtagttgggtataagaatagaattgctgtgcttaaccctctagattggttgcttagatgg

SEQ ID NO: 79279 - DNA, 34375 bp, Oryza sativa
  unsure (1)..(34375): unsure at all n locations
ctatccaacccggccccgccccgccctgttgccatccctaatcaaaactcttatgaatgcaaactcttatgaccagtttgcagttgaccgctactacgtacctcctgcagccgctgtgaaccgcgtcgaagccacggaggtcatgccaacgagcacatccgttagttgaagtttactaccgtagatgttggtatattattttaatataaactcgaccaaaatgtgagaagtttatatacagaagatttttcccggcgaggacccatgtagattgcagacggaccgtaaaggcaggcctcttaacatgttcgcttgtgaaaataagactattttcacatgcgggcctcttaaataatccgcatacgaaaatattcatctgttcccactctttttttatttctcacctcctttctcccttcactaaggcccgttcgatccctaccaatgttgtcaggacacccgaaaatcatattgtccagtgtttattgtgatcaccacataatttcgggagagtgggatccatacatgtataatagccactcaagcctcaatgtgcccgatgatcacaattaaacaccattcaatataatctgcagagtgtcgaatattgaacaaaagagagactgctgggacttagcgtgccagtcaacttcagcatgagatatgtccgtcaaaccacacgaaggcggtgaccggatgtttacacatcccagaagacttgacaaattgctaagctctacagcatctcgtttgttcaacactcatactcatgtctagctagtcctcaacaaaagactaactaaacactttcattaaagcattggcatagagtaataaggcactcaaaagattaactttagattacaactaaaattggatatacgtaggccaaccggctaaataaatagtggtttgcacggaagcttatctacccaaaacccttaagcaatccgactaagggtagactcttattgaaccatcctgagaagaacaacggaactcgtggcacacaactaatcctgcaaaacaacacgcgaaacaagaaaaatcattagtacatgattaattaaggattaactagtataaaattgaaaaatagaattatttgattctttaaacaacttttacataaaaactttttaccaaaaatatatcatttagcagtttgaaaagcgtgctaacgaaaaacgaggaagttgaagtttgaagttgagaaaaggaactaggcctaagtcctcatctcccctctcctccctcgctctcccggtccccactgctctcccatctcctctactcctctgccctctcctccgacggcgggttttggcgacgggggtagcggcgaagggtggaagcgttaggcgagggctcgggcgacggtggtggagcatgagggcagcgggcgtggactctggcagtggcggacgagtgggacggcgacgacgggtgagggccacggcggggcgagcgtgggcgacagcagtgacgatggccctcccccgcacgggatctgtcagtcgccgccctccttcatcctcatccggcggaagccgcccttcccacccctatccggtggcggcagcacctcccgcgtggacccgtcggcggtggcaatggcgatggtaggacgacactgacggcgacggcggcggcggttggagaacgaggaggatggcagcggtgactggaggacgaggatgacagtggcggcggcgacaagatgattctagggatagggtttcagttattcaatttttgaaatttttatttttttcgtgttattttcttcacatgcggttgcgctagctaaatataaaaatctgattttcgtatacctttggatgcatgtgagccacctgtccgtatgtaaaattcgcttttaaccatatggaaaaattgaatctgtatatatatgtgctaggtagtactctctacattccaaattaatctacatatattttttttatgttatttctaattgatttacatatctgtgttcatcattaagtctattcgttatttgtgcattggagtaaatggatattgatgcatgcatccatgcacacaagtatttatacccatatgcaatatcttgatttgctattggctactccctccggttttattttaattgacgctttggacaatgacacgctttactagatatacctttgaccttatttctctattataatatatacaataaataaataaatgtatgtttacttttattatagtgttttgaaagacaaatctataaatttttttatagtttctttaaactaaatacttttaaagttatcgatggtcaaggttataaaagtttaacgtcaaccttgtccaaaacgtcaattaatatagacccagagggagtaggaaatagtagggatgatgcatgcatcgagtttattgctagagtaaatatagtatgagagagttattagttttttttagtcttggtgtacatatgaaatatgtaaattaatttggaatggagggagtagtactgtacccgttcgtctcatagaaattcaatcctaaccatgaaacttcacaatacatctacgggatcatcggaaggcagccatgggcatagtgacacgtggagcacatccagtggcatatatggcacatccagtacgtacttcgcgtcagcaaactaagagaataatagtataactcacttcctactattagcttattttaaagccaacatatataatagattagttatatggttggctataattttcatcttctctctgtatctctcacttatacatttaatgtatttgtcttagattttgtgataagctagctcttacatgagaaccaacacccttgatttttcactacctctctcctccacctaagtttatagtaggcttatagctcactattagagcaaggataatagtagagctcacttcttactattagcccatcttaaagccaacatatataatggattagctataaggttggctataattttctcctcctctctctatctctcacctatataattaatgtatttacctaggagcttgtgttaagctagctcttgcgtgagaactaatatccttgattttttttgttatctctctcctccatataagcttatagtaagcttatagctcactattatagttgctcttatacttgctctaatcgaacgtggggcccaccaccatgccacacacctaacatgcggcctagtaggcccatactcccagcacgtgtaaccggccaatctcctcacggacctcaccgttgcactttctccggacaaaaaaaaacctaataagagatgatatctccaaatacaacaaatctaaataattctttattttttacgacctttctaagttaagttttttttaacggaatgagtatgtttgtgttggacgatgtctagggctgtaaagaaaaatataaataattaagctcgagacttgcaatctgcttgagctcaactcgtcataggcttaattcgaacttagctcgagcctatatcaaaactcgcgagtttttattaaggtgagctcctatcaaacctaatagtatatattttttattacttattttataaattagtagatcaaatatactatttatatgtatcatgcacaaaatagctcgcattagggtcatataatcttactagaaaaaatacccgtgcgttgcaacaggtaaaggctattttagtcttattattgttatacgtacggtttagctagggtgaaatttactctggaaattcgctttaatttttttttagaaaaccatgggctgcaattaggagtccgattttcgtctcaagttagcatgagagttttttaaaagatatttcttatatgactccttttctatttccaaaaacaaacaaacataaaaactgactcaaacacgaatctatatttccaaaagtgaacgaaattaaaaactgacaaacagggatgacgtaccaaaataccggcaaaaacatcttcgatttttataatagtagagatatagaaaaaatgcctatgcgttgcaacggatgaatattattttaatattattattattattgttattattattaggtttagttaaggtggaattcattgtaggaattcgcttggatttttttttcataaaatcatgagttgtatttaggagtccgatcatttcaagttagcatgcaagtttttttaaagagattttttatatgatttcttctatatttttaaaaacgaacgaacttaaaacccgactcaaatacatatacatatttccaaaagcgaacgaaaattaaaaaccgactcatatacgaatgacgtaccaaaataccagaaaattaaaacaccttcaatttttatagtagttgatatttcattttctcatttattaatatgattaaatagaaattagttactctctttgtcccaaaatatatgaatctaggacaggatggaatattttttttacgaatctggatagttagctcgtccagattcgtggtagtagaaaatgttccatctgattataaattattatattttgggacggatagagtattttaattgggagattatattcttaaaatgttagtatactatttatgagtcagctcgagcatgtgtcaacctcgtcggcacaccctaacaaacgtccctggtgcatgcgcgccatcgctctatataagccaagctcctgtactagttcatcagtgtagttcagtcagttccacacctctccttcctttaatttctctctgctcgccggagacagactagcttagctagtaggagagggaggaactaatggccgccggagacaaggccggcggcgacgacgctgcggcggcggcggcggcgccattgctggtgtcggcggcggggaggcggcggcggtgccccgggtgcctgacggaggagaggtgcaaggccgacgccggcatcccctacctcaacttcttctacatctgggtcgtctgcctctgctcctgtaagaacccaagcttgagctagctactatacctcttctttctttttttattttttttgtcatggtttcatccattttgccatgcatacgatcagacacaactcttaattactccttaatccgctcttattatcttttgaaaaaaacattttgattaatttacttgcgttttgttttagatctattagttgttggagagtacgtacgttcaaagtggcaccttctaggcgcacgctcacttggccttcgatagggttcaatttttacccacatctcatatgtaatcaatacaaaatcaaaatctaaaatacttagactttatcaaatcctaaatttccttttttttacattttcaatatatttatcttatatttttataaacttcaatgtaatggttgtttaaagtaaatttactttaaggtaaataggatgagtcaaagttaaacttacttggagactccacgtgctatcttcacttggactaaaatatcaagtatactagtactttccactagtataactacctgatcttattcccttcactttgcctggctaaagcatctgtttattagtctcttgttcttcttctttcatgctgatgcaccatgcatccagaacgagcagttgaaaagtcatttaactggaggactaatttcttaagttaatcgcccaatttactgtgcagtaaaaacgtgccattgctttaaccatgggggttcaaagaagttaaagcagacgtaactacccagacgctcagtgaataaattaagtaattaaccgtggttaatcaggtcacaagaaaacgtactactagtagtagtgccactggccggaaaggaatcattttcacttgtcacggttccagacaacggggctcattttttcgcttatgttcctacttattagccaaaatttaaaattttaaccttaaatttagaattgattttagggttttttttaatcgaagtttatttttcaacctttatttttatttttagatcgctaagaacacgtatataaagttttattcacaaattattttttatttgcaaatataccgaaatgatgggtctatctaatggggccccatggtcagtacagtatacagtactccctctgtaagaaaaacccaatctaaagttgtgatctaaatctagataaatgctagcttatctagatttattattctaaaatatatctttaattttttttctggacgaagagaatagtcctaaaggacatgagaagagtatttattgcacggagatgtttcagcagatgtagaatgtcagcatgtgagggcagcaggtgcggtgttgagagtccattcaaacttaagccaccaaagcgtatgcatccaattcccgctccaaattaaggcaaagttctttccagacgataagagagagaatatcggcttttgtgaaaatatttgaagagtacagacgaatgataaattagttattctaaatttaaaaggtaatttaaactattaaaaacgttaattgaatatatatgaaaaaaatatagaaaattgcatggtttagaatcttgtgagatgcatatatacgtgataatctataatctgtaagagaaaaaatacagagatttggcttgtttgtttcataggaaatatggaagaaaaaccattcctacaggaaaaatcactgtttatccattcgttttgtaggattatagcaaaggaaaagcataggaagaattcctttgtatgtgattcctatggaattttgtaggaaaattaacatccacttggacctcttttttctattcctacgcataggatcaaggcaaatcactcgtttcattatgtatttgaatctaagttacacaaattagagtattcaaatcttggttgtggtaacttaatacaaagattcctgtatttttctatctaagagttattcctatgattttcctatcctaagttttgcacatacattcctatgttattcctacgtttttccttttcctgtgatttgaaaatatgaaccgaataggcccttaataagtccaccatgggaatggaacagttccacttggtcgctcattctcccacccttttccttggaccatggttgcgatgctagcataaaggttgaaagaaacacatctatatcaatatcagattgacgtgacattttgatatgatcagtttgctctactactctgtcgaaactctcttatgaccgtaaatccagtgttaaatttttagtgatattgcatctacttattttgcatcggtcatataataaacactacggagtatatgctagatacaaacacatcttttccatttgtaaaaatggaaaaaaaattgagtgccaaaactcaggcattgtacggaaatttgctagagcaatagagcatcactaaaaaaaaacagaaatatgctgctcttgggaagggggaaataacagaattttacacagtgctgtatatgtgctgcacaacacaaatacacaaattctatgcaagttgagataaggtgattccagtcgagggaaatgcaaagcattgcacctcatccacacgtgaatacgtacgttttctgggagctatatctggcacacagcagggctaagctttccctaccgtgcgaagcttcctggaagtttacctgcctgtggccctggcagtccctcgtcgctaccgccctgcaaaaaagatctgcgatttttcagtgaaagcgatggctcatggccatcgacggtagtactatttcgttgcatactcaacacccccccccctctctctctctctctcttaaaaaaaccaacctataacctaaaaccaagtatgacacattctattactacgaatctagacatacctctgtccagattcatcgtactagaatatgtcatattcggttctaaatttgttttttcgggatggagggagtttgcatgaaattctcgtaccagataacttgactacttgaggtctattccctcccttaaaaaaaacatattctgatatttctaacaatacatctgaaagcatagtacaccatgtcacatcgaacgtttgaataattacatgaagtattaaatatagtttaaaaaaataactatttgcacatattacgactaagttacgagacgaatcttttcaacctaattgctccataatttgaaaatgtggtgctacaataaacatgtgctaatgacgaattaattaggcttcgtcacgcggtttactgacggattctgtaattagttttttattagtgcccgaacactctatgcgacaccttatataatatccgatgtgatacgccaaaactttacacccctgaatctaaacaccccctaatttagaatggaatatgatgttttctaatataataaattgttagaaaacgtcacgtctcattttatgggatggatgcagtgtgttcagattaatcggcaggattgtattttttaatgacataatgtgtaatgtgtagatatctactttcaaaacacggtattttcattttatttgcatggggaattaattaaaccattggataccgtttgtaaaagccttgtgaaatttccctgttttttaactaagttttctgtgatgaaccatataatttctcacattttaggataaattttaaatacaatatataggttgttccatcctccagattgataacacttgtttttttagaaggatacgatctctaaaaataattttgatcactatttttttttattataatacatatacaaatatcaataaatatatgattttattgaagtacttttagactaatctatatatacacatggcctccatatttctaagacaaatattttaaacattattcataatcatatatttcaaaacttaacattagcgttgcacaaaaccacaagtaatattaaactggatgaagtatatttagtacggagcgtgcctcggatttaacatagacccacgtagttgctaactccgtcggtaaaggtccattactagtctattaggcaagagaaggcaagggaattgagagtttggacaagggaattggtggaagaattggtcacccaagttttttttttactctgtctcttgtttgatagtaaagatgatagttatgtgagtacggatgggaattgaattttaactaataatgtacaccttagatttatctgtcgtgcctagaagaaaattccccttccgattatcacttatccttattcagatactagtaatcgtgcacgtgcaatgcatgtttccaacatataaaaacactcaaaatttattgcattttcctgcaatatatgtcacccaaaacacacaaacatactaaaagtttaagaactatttctactataatgtaatttgacatactacgttaaacatccatttaaacacaaaaaatgcaaagcagctaacaatacaaaatatataatttgtcataccttaataaacacttgaaaaatatcaaagcaagatatttatctttatggcattgaaatgaactccaccatctacaatatggctatatgggatattgtttgaccatttttttttactccttgcctcttgtttggtagtaaagatgacagttatgtgagtattgatgggaattgaattttaagcaataatgtacatcttagatttatctgtcatacctagaagaaaattgccctttccgattatcacttatccttatttagatattgaaaatgtaaaagtttgctcctaaactcctctttccgaattccgatcctttttaaaactttcacgtctaccaactaaacaatatattttaacagccctatctctctttaacaatttccccaattaaacgtgcctttgattcaaaatacgttttacataaacggacacgtattcagcaagtacggtttttaattagcgagatcacgggaccaggtgcttgcagaaagtcccacaagtagacgtggctgtcagtgtgtcacccatgcggaggtccatggggtccctactccccaaggatggctcactgggctttaattaagagtgctcctagtcctatagcacattcgacacattatatggaaaaagaaattcactctaactacaatgcttgtaatgtaaatacaattacagtataagtatggtgtaaatttgttttgatatcaaaacttgtgctacctcagtggtccaaaaattgttttttttcttccaaaggctatattgtaagttttctagcaattccattaattaatagtagaatgaaataatatagctattagaaaatgtattatgtcccaaaaaccattataagttttctagcaattccattaatcaatggtactatatactatataattagaaaatatattgtggatgatatatggtatgttgaggggtgcgtctcacaatatgatggagacttgacctcagagtttacaatacgtaccgttctgttgttgtggtaaccacctgaggtaatcttcttagttttttaaaacatcagtttttaaactgttgtaaccataatattagggcccatttgatttggatgaaaaatatagaaattttagaggattttaatcctacaggaaaaattcctatgaatgcctttaaatcaaaggattgaatcctatccaatcctttaaaacttctatcgaatggacaatcctatagagattttagaggaaacttagcaaaagctcaaagctcttggaaaatttcctttgagtctatctctctcatcttattcctatgtttttcctacggtccaatcaaatggtcattcctgtgtttttgcagtcctctattttacacttccatcccttattagaatctggtgtttttcatatttctttattttctttttcattcatgcgattcaaaagagacttattggacaacgataacctcaccgaaacggtaagaaaaaccacgcatactatgagcggaggaagtaattgtctacagacatctatggctctaggcccacatgcacattactgtctgtgcagtacagctgcaggtgacagtcccgtccatcaacaggtcccgaacttctaaggccatgtacaacgcgtgaccttggcatgtggtttcaaacctccacgtcggacgcccgcacccatggcagtggggaccgtggctctgcaggccgaatccgcgcttgcagaggaaccactcgaagcgccgcgcctgggctcgggagccgcgaagccacaacccgaggccacgcgttggcggagccagagccccatgcgtcgcctcgtctggtcggtcaccgtggtagtcgtcgccgctcaccgtcgccaccgtcgccaccgccgctccccgtcaccgccagatgcgaagaggagcaccgccgacgccaccgttgctcctcgcttcctccccgccgccagatgcgaagaggagcaccgccaccggatccggcgagcccgtgcccggatctggcgaccttgggcgtggggcggcggtggaagaagtgggatgcggcggaggagggtgtgggcgtggcggaggaggaggagaggatggcgcggggaagagcgcggcagttgagaggaggaggaggcggcgttgtcgtggcgcacaagaggaggagcggcgcacgagaggaggagcggcgctgcggcggctttgagaggaggagcggaggcgacgagagaggaggcgttagagaggaagaggataaggcagagccggttggtagaagagaaaataaaggggagaggattggagagactgacggtgggtccatatatagattaggggtatctatacatttctttttgttgttagaaggactaaaatagttaattttataataacaaatattatagggactaacacatgaatagataggggctgaaacacaaaatatactctacagtggtctccattgtagacattgtggtttttgtgtggccttatcctatgtggcaacctgagaccacagttgcttgtggctaccattgtacatgccctaaggtgtctgcatccagcatcctatgtgatcttatttctttctcattatgctctcatgaaatgacattcattacgaagcgtgatatttgaccttagtgcccctttaaatcacaagactaagaaaacatagaaatagaaaaaaaaaatgtaaaattttgatataaatgtaagtgtaaaacagaggattgcaaaacacaggaaaaacacaggaaaaactgtttgattagaccgcaggaaaaatacaggcattaaaggagagataaagactcagcagaaagtttccatgaggtagatcatcatggtttacctccaaaccttgcatggcattagacatttcatagtaattgagacgttttctaatactactaatttggacatgctgcctgtctagattcgtagtactgggaaacgtctcatccagttctagattcttatatattgagatggagggagtaataaattaggccgaaaaaaataccgcaatgaccggctattttctttcttttttttagtccaaagtcgaaaacaaatcagagtcgaattggcagtcgtttaaatagcctaacggttcgtacataatttcacaaactacaaatatattgatcaaactaccttaaaactacatatttaaggtgatgtatcacaaaactacaaatttaacactaaatttttatagtgttcctcagccaattgttggtgttttttatttttaatatcattattaccatgtatgccacaagctagaataatcaagaataatatttttctctctttacgttcttaatataactataattgtgtgtgtgagagagagagagagaggagcaatatgcacacttgtacttggcagagaagccgtttcaaaggagagatttaagccgaccctctaatgccactgcctaaacttagccggacaaaattaattaagacaaaacacccaaaaaaagtgatctcaacgctttagcagatcaatgcttgcaattaaacccccattgcttacttcttggcgaaagagaggagaatgcccggacattctcacaaaccaagcatcatcttgatgtggattcagacaactaaacctgcaaggagaagaggagcaaacgtccttgcccgccattgcggcgatgaccggaggcggcgatgccgatcgcaatgcgccgttgctcgccggcggcaggaaggtgtaccatgaacgctgccccgggtgcaggcagcagaggaaggtgcaggccaatgacaggcttccctacctgggtttcctctacacttggatcgcttgcttgtgtgccggtatggtatgcaccatctttgagaggatagatgtttggttaggatgcaggtgttgatctgattttcatcttgtggatcagctatttggttgtcacttgtcacaagttgtggaatgtagaaatggcctttgcaattgttaagattgtgatagtggtgttttgatgatttatataatatttaggagtagacgatgaatcgatgatcttcatgatattgcgtgtttcgacaaactggtagatcttatcagattcagtagtctcattcttttgtcaaaaatagacatacttttatttgtttcggttcagttgtatcaaatattattttatctctattcctgaaaaaagaaatcccattttagctatagttgactaataccatggtcttttgcctttccagcgttgccaattcagtcgttgtttccgtatctgtacttcatggtaagaagatatgctttgaagttgaactattatcatgataaacatatagagagatcaaatatgtgaatttccatgtagtacatggtgattgacatgtattcaattttgttatgatgccacagatcagggacttgaaagtcgcaaaggaagagcaagatattgggttctatgccggttttgtcggtgagcactgtctcctctcatggttttgacaacaccactgagaacattatatgggcaagagttgaaccagatgtcttgtgttgattaatctaccattatcatagaatacttaatagttttggtgttcatttttagtccactatgattattgtggattacttgttaccgactaaacggtaatttctctgtttaaggggctacttatttccttggaagaactatcagtgcagtgccatggggcatttttgctgacaaatatgggaggaagccctgcattgtgatcagtatcctctcagtgtatgaaacactcagttagactatttaaatcatacttgatcccattcgactggactgaagtaaatcttgttttaccatttccaggattgtgtttaacacactctttggcctcagcacgacttactggatggcaattgttaccaggggattacttggattactctgtggtatactaggaccaatcaaggtaaatttacagtttgatggctgatgctaagaacatgacactggattgttgcgtactcatgttcagcatcatgtattgtccaggcctatgcttcagaggtctgcaggaaggagcaccaagctcttggaatttcccttgtaagaagagttatactcttgttttgcatttcaagcttcttgtttatctctataggatgaggatttaaaatttttactgattatattttagtactggctacttattggtcgtattatatgttataggtcacatcctcgcgagcaatagctctggttgttggaccagctattggaggatttctttcgcaggtgagcttaagtacactttgatgatgaaaccaagttaaactttgtatagttactaaaatgccgttcgccatgccttacttcatcagagctgacttcttgtgcgagtggaagagaaaaagaaacataaatctgacaatttttttcctaaaaactatttagtttcatccttttaatgaaaacagtgctaatggaatcaagtttaactaaattcgcaacctatgaagattgctctgaatctgttggctaatattgtgcattttctatcttgtatcagcctgcaaagaaatacccaaatcttttctctgaagaatcggtatttgggaggtaaattattaatcatcattcattctgttcctcagaaataaatctttgtttatatacttgaagaacagaagataagcctatccaatgtacttctaatttcaggtttccctactttctcccttgcttcgtcatatcggtactagcagcaggagcatgtgttgcgtgtatttggcttccggtacgccactctctccccctaccattctttctttgaaatgctgaaatgcatgtaaaaaaatatactacctcctttctcaaaaggtcgacatcctagaaagtgtgcaataaaatctcaaactcttaaatcactaatatattaaaaaaatattaagatttgatccgtgaaaatggcattaagatttggcattaaaaatatggttatatttttttaataatttttataagtttataattagaaaaaacaataatgaggcatgtgtattggagattatgttgatgaccaaaacgacaagtaaaaacaatagaggtagtattaataaagtatctactgtaatatgtggagaaaagttacttaacattagccccttgttcttaggaaaccctgcacatgcaccatgatgacaaagaagtcattgatgcactagaggcacaagatgcgacttcagacttaggagaaacaactaaagaatcaggatcagggagaatgggccatacaaagagtttgctgaagaactggcagctgatgtcagcaattaccctctactgtgtcttctctctccatgatacagcttatcttgaggtaatccctatattctgaattatagattatcgcagtaataagaagggcgaaggtaggaagtaaaatgagtggaggtcagggtgctaggcaaggccccaactcaataatactctagattcacccctgggttaatacattgagaaacagtctagtttgttaagatgttgatatgccattgtattcctcctatagagaagttacattagcacaaacagcgaacttaggatgttaatgtactatgtaacttatattttcagatattttcactctgggctgtgagcagcagaaaataccggggcctgagttttacatcccaggatgttggtatcgtgctagctatttccggtatgtgatgttttttcaagtttttatgcatgatcaatacatacaagaaaccatatctcaaaaacattttttttaaagtaatcttcaaaataaattaaatcagcagcatacttagtatacctgtttaccactaatgtgtagctatcattgccttcaaaattcctttagctaatgacaatttcgtctgaatttgcaggttttggtgttttggtgtaccaacttgcgatttatccgcttcttgctaaatatgttgggccaatcaagccattccgttatgcagcggtagggagatgcatgttttgtcttaagatgattcttctgaaaattgaatctttttttttagtaccaatgcatgtttgatttgcaggtcttgtctatacttctcctttcaacatatccattcatggctaacctgtatggtctggagctcaaagtactcatcaacattgcttcgcttttgaaaaatatgttcgctgtaagcaattcctctttgcgatatatatcctgccctataatagggaaaattgcatttttatttgtaccaacataaaaatccatgtttttgattcaagcttcccaaattcagtgatgttgggcttgtttagtttgcaaccataccaaaatattggtaacgccaaatcatgggcgagtttttgctaatgccaacattttaacattgccaaaattactattcaaaatgtcaatattttggtatggcaagttttggcttcaaaccaaaccagcatgttgttccttttttttttttgcctcctacagagaaaaggattacaaattaaaaagttaattgtattcttagataaaacgagcttaatcgttttacaggaatttatcgtttaaagatttgtaatgcttgttttgaatggtacaggctacaattactattgcatgcaacatcctgcaaaacactgcagtggtatgtatcagaatcaataggacatttcttttttacttcaatgcatttcctcgttgtcataatcatgttgttatgctcttttttcttaactgttggaacatgcaaagacgcaagaacaaagaggggttgcaaatggaatctctgtcactctgatgtcaatcttcaaagccgtagctccagcagcagctggaattttgtaagttccttttgtggttagaagttcatgtttcttctctctttttttttccctcttccaagaataaaaaggagatgaccaatcaatcaatctctttgcttgatgcaggttttcatgggcgcaaaagcacattactgggttgttcttaccaggtaaaacaacaaggctcttccaagccatgataatttgcattactgttgatatagtgtcatcatatcactctctctgtcctagaaaaaaccaacttctagatatgaatctgaacatagatagaaaaatcaactttttactagacgttggttttttctgggatggagtacatattatcaggtgtgattagttacctgactcataatggtcatgatacatccaggtgagcagatcctgttcctgatgctgaacatggtgtcagtgattgggttcatcctgacattcaagccatttttcgccttgccggatatgcgatgatgtgtagttaggtaacaaaaaggccagaatttatcagacttcagcctggattctaacctgcaagaggaattcatgtactgtaccgcgtgtaatgttcagttgtgtaatcagtttggtggtatctttgatttctgtctgaactccgaaccattggatggtcgaggcatatgataaacagctaacgggatcttgtttcatctaattacctagctagcagaatcgttgttacattaatcgactgaagcaatatgactgccaaattaaacatgctcaaattccttccaagacttacggaatcaagaacattgtatttcatatatagtgacagtaaaatatgtaagaacatatttaaagatcatgaccaaaactcggggatactgatgagctcacagtaagacgagagaatcaagtgttcatcacattgtcaatatgagaatatgatcgtatatcacccaaattaatattggtagaatgaatatagcacaagcatggatggttttgattaacaacagaatggctacacccttgaaaagttgaaacaaacatagagtaattgaataaacaaaatcacaaagatcagagccatttttcacaaacagaaaaatcacaaacaaacagaaagcattgtctacagcataggatgtctctgaatatcaagaatttcggtttggaacatatctatccccacaaaattacatctgaacataaaattaataaagataattttagcctctgacagtatggctactggaactccccctgtgttgatccaaatgatgcttcaacttacttggccatcatgactttaacgaattcatcgtagttgatctgcccatcaccatcaacatcggcctcacggatcatctcttcaacctcctcatctgtcagcttctcaccaaggttagtcatgacgtgacgcaattcagcagcagagataaaaccattttggtccttgtcgaacacacggaacgcctccttgagctcttcctcagaatcagtatctttcatcttgcgggccatcaggttgagaaattcagggaaatcgattgttccattgccgtcagcatccacctcattgatcatgtcttgtagttctgcctcagttgggttctgccccagcgaacgcatgacagttcccaactccttagtagtaatacaacctggaagaaaataactttatctatgtcactcaaagtctaaaaatcgttcaactcgaggtgtcagtgtatcactacatagtattcacagtactgctttagatcatcaaggcttgtcgctgtttacaaactgataaaagaaagagaaacaagaccaaaagctgagcactacttgaaatgaacagaatcgaagtgttatctaaaattgcttaattattactccctgatcatatatgtaaagattatcgaaaacagtagtagctcatgttagtgctaattgtaaacttcttatcctctaccaccacagatcttctgtagaaaatccaagaaaaacaccaggacagtgtcgtcgtattatcatacgagatgactaacccaaattactacactattgcaatgggaatgaaaacgaggactcgtgagaattatcccatctaaacctaatcaagcacgaatcattacgaacaggcactagccagtgccccaaatctcaaaaaggccagaaaattacgctggatcacgcgattgaccgaccagcatctactcccaaaccgacgagcaacgcctatattatcaaaagatccggagatttcagagcagctaaacgcatcccaaccggatccctacagcaaaccaagaatcgggacacggagacgacggatcagggcgttcgatttaattaacccccaagaaaaagatcgccgatctcgcttcggacagcctatcgatctggttcccgcaacaaaattacgagagggagggagggaggtgaggcaggggttaccgtcgccgtccttgtcgaagaggctgaaggcctccttgaactcggcgatctggtcgtcggtgagctggtccgccattggcgacgcaggcgcgcgcgagcgagagagagaggaaggagaggggagtcgtgggggaggagagcttgcccgagttggagacttgcagtgtgggtaggcttacctccttttttattgcagagataactcacgatttctactgttttttctaagactagtgctaggttaggcttccaacttggcacgttcttccaatggtttaggttgagggaattgcctgtaggaggaacggttcggtactaccttctattctatagttatcgatccaagttatatagaaaaaataatgcttaaaaaaattactgtaatacctatatttaaggggtaggatagagaaaattttgaattgatgtgataaaaggtacttctaaactcctttttttttgaaaactttttaatccaaaagcggcctctattttggaatgggaatggacagagtacatgcactagctaggtctcaaatactatgtattatgtgtatgtggtctcaagtaggatcctaaacaatcatagtaaatccaaaacgaaaatgatctggtgtcccaaacataatagtatatcacaataaaactatctagtacttgacatatcaagcaatttatatttaatagtgatttgtagggtttgttattgtagagctaaatgttgccttagcaaaagtttggtagtacatgtttatcaagcttcaagcattcatcctccaaactctaccatttgtttatcaattgctttcaaatgaattgtcaaattagaaaccctatgttttgggggaaaactgattaaatgaaatccctaattaagaaactgagataaagatagctattataaataaattgaaactacattcaatttgaatgcttgaaacttgtttctctgcataagaaatagctagatgttgtcgtcgacataaaatatagtgtaaactgggtggccaaggtgggaggagggtgctaggggtctataggatccttcgctgagattgatcacgttgtcacttaaagtggtgtgttctctttgcaaattgagagcttgctggtcagtggtgtaggaaagaaaaggagactccttgccttcatcttcttgcctagacgaagaagaagagaactcgatcgagcaggcatcttttgttctttagtgcgtgtctggccattctaggctacttgatgggctttttcattctgcagtctgatagcacacgatttgctctaactattgggctagggggtgacgtcatttctcctatatgggctttagtaattaaaaacaaaaattagcatgtgtcatgtgcatcagacgaggtcaacaagtccatgtacacattgtctagagcaacttagggcaagaacaatgcaagatatgctttagctagacctcaacaagatgtagggccaatacactgatcgaacagacatatactccataatgtatgtggtctcaagtagggtccatgcacaagctacatagcaacttaaaacgagcagtgcaaagacatgctctagccaaacctcaagtgtcatgcaggagcaagacattaaatagacacatactccacagtccacactacatgtggtcttagatagggtccatacataggattcaaagcgaatcccacctaatgatctgccccgggtgagccatgaaacgtgtaggctccatagagatacacgactcctcactgagtgcgaacataggggtggaagtccaccctagcaccgcggggatgttaggaaaaaagcccactgtgtatagccttaagaagaaattctacttttgattctaaacattgtcatcggcaaacatagattttataggacagatatcatggcccgagaagggaagatattgtttagatctaaaatcatgattttttttcttagacaaagttttgaagtttgaccaagtttgtagaaaaatatactaatatttttaatacaaaataaatatactatcaaaatatatttaatgttaaatttgatgaaactaatttggtgttcaaaatgttactaattttctctataaacttgatcacacctaaaaaattgactaagaaaaaaaatcaaacaacttaaatatgaaatgaagggagtaattcagaagctttcccccgattcatctgaaaattcatgtgtccgattaatcggacaacgagggagcagcatagacaagcagcagtagtttagtttgatttgaaagtgattggttggcaacactatcagaactcggcaacggcacaatattagcagtatgtcttgtacctggtgcatattttacacggaaccaaacattctctctaccataccaaaatttgctagtgcggcaatgccaacaaaaccaaaagtttcgagccattgacgctagtatagtttcagaggggttggaatttgcagatagattcagttcaggacaaaatcccagcatcttcacatggcgcgcaaaagagtaccatgtttaatacacgagactgtttttttctttacctatccaagagcctatctcaaatgtaatgcacgcaccaaacactcgctgcatttacccaccacaacaaaacgtgcaagcaggtgccaagcgcagtgcagcccaggcatcctgctatctctctcacccaactctgttggacaccgtttggtagatgttcttcagctgagtattccacttgtctatggcttggtatttcctcattcccttcgacctgcgaaatgcgaatcggatcaccttcagaaaagcaatcgcatagatagaacaatgtgatggaaaaagcagggggaatacgcacctgtcaccacgttctagtaacttgttcacctgatctatgtggccctggattcggttatccagaatgagtgagaccaagagctgctcgacatccttttctgggaaatttagctcctacatgcaaaacattgacagaacaatcgatgacaaggcatcttgtacactgtacgaaagcaaatttcacaaaaaactagacctccgtgaggaacagcatagggtctgcacgattaagcgcacatgatttcaattgaactggaatcacctagtttgggcacacgacagaaaaagatcaagcttcaaactatatttcttgcaacttcctaaaatagcacgagtatataccaaagttccatgttactaataattttcatgcaccatttgttatcacaagatattgtcatattcttctggtattgagcaaatgcacattatctggtgttggacaaagaacagattatctagacaaaatactaatctttagctcacatcaatttctgtcagcaaagattatcatgaacatttaagagagcgagtattcacctgtgaaatgaatggaatcctgattctagtatatggcttaataagcttgagcagaacttgagttctgatgttcttcaataggtcctcaatataattacggatgaaaggatcgtccattattgttcttctgttgctctgaattttgtttgtaacaatcacatcagaaatccagaatcaattaacagaataactagcttagaattgctgcagaaaatagcaagatggataatgttcaataacactgacctttagaatcttttcaaattccatgatgtcattcttctgatatgctgcaatcaagtttgtcatggcgaggatctcaggatcatttttgtacctgaaagcatcaaggagttacagggtggcatgaaattaagatacaagatttatgagggaatcatcaaatgtcttacggcttagcctcttgcccatcaaagggattcacttcagattccatcaacatatttgcaagaacaagatatctaatatgcagtacaataaaaaaggatgaggaagttctaaatttatcaatatacgaaattaaaatggaaaagaaatgcagatgatttgattacttcaggcattgaattctccgcggattgccagcttcatcatagtttttgaatgcttcaaagaaatcagttgcagcatctgcccattgcctctcagccatgtgcatctttccaccacattcacgaattatacccatgattcttggatgaggtatcgctgatttgatggaaagagcttttgtatatagttcctgcagcagaggttcacttcagaaagtgcatttcatgctaactgcctaaggcaggagaaaggtttgaacccaatatgggtcaacatagtactataaatgaaataggctaaatatagtcaatgctcttataaacatattgtccaaaataggtacaaaagacaggcatcagctttgtaggttttattttataaagctgtagaaaatcaataatttagcaaggaagttgtgtgctcactataccacctgatttcaggcaagcatattatgcaaatgtataattgtatactcagtggcaaatatcctggtatcagtaacatatcaacctatacaaattattgtcaaaggaataaaccggcaaaacagcagaaggatgaaaagttatctttatatctgcgttctggctgcagtcaactgtgttttttaacaaatatacagctagagtactgcaatattgaacaagaaactgacacaaaatcttgaacagtagtaacctgtaatccaaaataatcacgtgtaaaaagactgacaatatgtcttaccttcaattttttgttgttctttgtttcagtgtacatttggatctcaatagcatagacttccaaaagttgtgtgcctttcttctgatcatcagaaccatcttctctttgacaagatttatgcagctccttcagtatctacaggaagaagttacgagcaaaataattagagtaatgactgcagaatatgtaaagaaaaccaattgactagagaaacttgtataagcaccttgctcatccggccatactcccccatgtcaaaccaaattttgcaaagcttcaggtttgtcttaaaccataatctctgcgcagcaaagaatagcaaggtataaagaacaatcttttggtacataaaattctaatttggataaggcaagaaactgaacctcattctttgcctcttcaagtgctttcagtgttgtctggtagaactcttgcagaagagagaagttttgactagctgatccggagacaaaatccataatgttgtttatacatttctcactgtagttacgtgtcacagcagatttgatgtatgtcaacatctccctataggcatccatcatttctttgtacttcccaagcttataatacagcttcactgtttgtttcagagctttgaaacccctataaagaaaagagttacagaactgacgtcagatctctaaaatatgagtggctgttggatacagatacacttgatttcactgacaacttataacacattaccattgaaaaaaaaggatgtccatcaaaatatgcagccctccaaaaaggccactaatacttcagttagaattctatttgtggctcaagcatatcctatattgggaatctggggggattcctggtcaacataatatgacctgaggttttaagatcttaggtctgaactttgagaaggctcgagctgatggtttgtgataaacaattttcatacatctttactgcacaaagagtaggtgctagtgatgtcatgttatatcttaaattgttaatcttctgtggatggatctacgtaaacaagaatttgttgtttgtaattttttttctaatactgcaccatgcacacattcattcaaatatataaaagaccggttcatgaaaccttatttatttttaaatttttagggcaattatcttggcatttgtaggatcagaatacagactatatctaattgaaagtcttaacagcatacaggcactgtgctaccataaaaaacatacaagtacatgaaggtatggagtccctgaagcttaacgataacaagtagctcatatgggcatgttgacagtcgaatgccaatagaatttagagttcatatgtccaggaactttatattgtagatggacctatacagcaactaaaatcgacatcattatagatacaattgatccccagtaaatgtagttcttactaaatctatcttacatggtgaaagccatatcacccctcttattctctacctttgaatgagtactcagtggcacagatggataggtaggcgaaccacttaagctttgccttagactgacggaacaaagctaagaagtaggcagaatggaaaaaggaaagggacaagggcggtcgtcgcttggcgcgaaggctgctggtttggtacggtactaaaggtcctcgggtgtttgattcattctgctgagcccaacactttaggcaagcccacaagacaataaaatccaacatcttttgtgaaccgcacagaaggcaaggttttaatgtctaaccaataggatgcatacagacgttcaagaatgaaatattaaatgtgaaagttaaaaatacggcatcaccagaagaatgttttcaattatatattttatttcattttgcaaccatagaatttgttcaaaatgacaccttccttaccacatgcgtaataagatatttcagcagggtatcaactagtaaaatgttatataaggcttaccattcagccttttcaggctccatacgtactacttgatcgaagccagcaagtgcaccctcagggtctgtctcaaccatacctgtaataagatatttgagcaatgtcatatcataaagcagcatatacatgaagtagcatttgtaattgtgtggtaacaaaagacaaacacaatttatgcaagaatccccatgctcccacctcacagaccatatgaactagctttccatttcagaaacaagaaataggagtagccataattcatctacctctgttggctttttagggcatattttattttgaaaaaaaaaaacttcaagattaaactttgactattcatttcacataataaaatataatcataatagccataaaactaactttttaaaaatattttgactaattgttgaccaaaatctacgaaattttacttctcgaaagcgggcatatgcctaataaaaatcaatagagggagtttttttttttctgccagataacactatttgtgatcaatttgattccaaggtcgtcatgggacaaaccgacagccacagcacttgaggatgcaacggcgtccaagcggccaccttggcatccccaatgcaaggtaaggtgagctttagtagaggagaatacatgagcaaagctgagcagaaagaagaaaatcaagcttagcaggttagcagagcaaatgagaagcagcaatggataattggagacagtgacagcattgctgcgccaacaacaccagtacaccacaccttcccttcttcggttattccttctcttaaccttcttttctctatacctactccaccataggccatgcacactcgttaacgccccctccctcacacagtcacgtgacactgccagctgaccccacccagatgctcgccatggacagctagcatatcctggatgaccacatatatggccaaggcaaggtaagcctctgccagcatcctcctcaggcctcctactctcctagatgccactgctatgacttttgataagtgagacccgtctttctaaaaaagaaggggcactcatggagtaaggtaagtgaatcatcggttttgggcataggcagccctctattatagatcccaattgccatctcagatacactactttacaagaatgaatcatcactattgcacttaatacatatccatggaaaagaaggatatcatagaaatttttgttttccttttttggatccccatgcattccattattcacgtaactatggattaattgtccctgcctatccaaatggtagttgtctaagagcgcaattactagagaaactctattttccgtattggtaaattggaacatagtgtgactcttcaatgttgcgagaactagtccttgggcctcctcttcagtttttcccttccctgatccaaaagatgggtgcaccacctaactggcactgtataggcatcggtaagatgtgcaggccagactctggacctaggttcttaactaccggagtgaagaaaaggccagatcaagaaaagggcattgtctaggcgatgccacaacaaccatgattgggtttgtacaaacatatcggcttttttccttcttttttttttttgaggaaagacactgcataattagtagtccgcctgttaagattatgtgcacaaatttgtaaagcccttatgtttataacaactggtggcattaatttaacctcctttataaggctagaaaattctacgttgatctttagaagcaaatgatgaattccaagaaattatcgatcctcaaattaatttagtcatgtaaaattatagcagtgaagattatctttcataaaagtagaaagtgaatcattaaaaaaaaatctttccaaatgttccatacacagaaaggtaaaggcagttcaatcagatgtattcaaagaaaacaatgcacatgcccaactaagtctttgtattttaatagtggcatgatttataagctcatgaagcaacaactatcaggtattcagttttcatacaaactaaatgtccctttttagttgggaagtgtttttttttcgcagaaccaaaatgttagttcttaattacaagggacacaataggactaaccacacagtcggtggaaataagcaagtagtactttcactttattaagattctgatggtgtaggatattcatggtcaggtttaaaaaaaaacgtcctaagaaattcaagaaaaatatacatacatgcccatcaacaaagtcacagttaaaccggcaattacacgcaaaagcaaagcaacatacatacatgcatcatagaagggaaccctaagagaacagctaaaaatcagggatttggctggcacacaatcatggtggcctctcctcgaatactacactaccacactacatacacagggtccgagaaaacgcaccgccgaggaaacacaagaatgaaagagattggaagcgaacctttggagttgtagtactggttctcgatgtcaacatcctgctcctccggctcgtcgtcggagtactcgaacccgtaatcctccatgtccgcatctggaaaaggaaccgatcacggggatgagagaagggggtgcggaaacgacaatcgagcgagggcgcgaatcgggatatcggggattaccggagcccatgtcagcggcggcggtggcggcggagaggaggaggcgacccgcgcggcgacgggcggagagggaggggagggggcgagagctagggtttccgagaccgcagcggtttgcagttgcggaggcggatgcggagagagaagagaggagaggacgaagggagggggcgacttttgcgtataagcccctgggaagttagggattttaagacggagacggaatacacctgaataataggatgctctctctctcccttttttttcacgaaaaaacaggcaaatgtttggatttctcaggggatttttcatgttgtgtttttttaggttgattgatttttcatgttgggttaataaagcagaaattgatgattttgatttaaaagcgagtaacgattgtagtagagaagagtggttgcgttggggttatgttaaaaatagggcatgcacactctcccggtatttatcactctaatttattgctttcaccatatgcatgtccatgcctcttcaccgatgcaggcgatgattaaggttattatttgttctaattgcgtagtatactccagcatttcattcctttcacagctcccaagtggctaactgttaacaataaaattcggtacagttctttagtgggcgcgtttgctttgtggacactctttctcgtctctccgttttccacctcgcacaccaccgtcgtcatcgttgacgcgttgcttgccatcactggccaccatgttagctcggtcaccgaccacctccggcgtgcccacgtgtccctaccgcctagcatcaaggcactccaagcaccttcccccaaccctccgcccgccgtgtggatcttcgtggacagcgtcatttccttggctcatctccgccaccatagaccttcattgtatcctccgccagctacaccgtcaagcctagttccaatggccccaccatcggccaatattctattcaagttgatgcaagcattgcatcgttgcttagagtcgtgtcggcttagttaggactttctcggttagatttgatattctaactaagtggtatatttctaatcataatgttgttttagattgatcgatatatccattacgtttgtgtagatctatcggctaaataggtttttcttattgtcttcaatcttatattgtctcgttaggtccgatctattagattgttgctataataagttaaattctagtaagctgatatgtttcatgcaaaatttcattggagttctaaccaatgagttattattattatgagctccaatgaaacattgcatgaaaacatacctgacgatgtatgctttaaccatcggacctgcatcttccacactatatcagtatcggttaattggttcatttctttctatcatccttgttagttgcaggatcaaaactaactaacacgctctgagccctaaatttaggacctgcactggagtaaaacacatttcccaggccttcatgcgtcacgacgtattttgcatcaacactaaaatacgctgtggtgatgccgttcttgctacaaactcttcaacatccgcaaagatttgtttgaattgctcagagtatcttttcaacttgttgaggcttcatagcaaaaactcatgaaagctactaatattacatcgaaactccctgcaattgcttgaaaaaatagtttgtctatcacttgaacgtgctatcacgtcaggaatgttcccggcaccatatcgcactgtaacggcattcttctccggtcgtgatagtaaagattaatactcttttcctttccgacaaaaatagagattgcggctcacgaactatggcaacaataggtgggtgcgtgtcatgttagatccaacatttacaacatcttccaacacttgcattgtccaggttttcagtagttggcgtcactattcaccttcaccaagaccaaacattatgccataatgcagagcacagctaagagatacttaggatgctaaggaacttaagtatgaagtatcaacaaccccaaaacatcatataattacccttctgttggaaaactgtaacccccactgtgatgcagttcactgccacttaaatggagatcataacaaaacctttgccaaatggtacattgttgaagtctcaatactttacaaaggaacacacgaggtgcagattctgctaaccacccatcatctcaccgttcgaagcccctcaggcagaaaatatcagcattcctttttgaaggaaaaaaaagctggagatggtcttcctacagaatcagtagacaagctggggctcgaattcagcgaaatcaacagagccagactcgattgggggcatgaggtacgcagcaatgatctcagacaccagagcggcaacgtgaggaatcctcttcaggttcttcaccagggggatatcgtcagactcgcctatggcaatgatctttttgttgatctccaccatcctgtctaacttcctcttgaattcagggttctcgacgtcaagaacagcggggaaaatccttgctgttgtgcggttggtctgccaaaaaaatgcacagattgtatcatcagtgtggtcatttcagtatacaaaaattaaaaacattctcctaagcatataagtaaagcataaaatggtctgcacccattgcataatgaaattgttttaatattcagcaattcttctgaaacagtctggactacagtaaagtagggcacataattaattttgtaaacaagaaaaggaagttgattttcttacctcaattatcacatgcatgtcgaattctttggtgtccagaccaatcccttcatagaatgtagtacgttggcaatcatttaggtacatggtcacatacacctgcaaaggatcacacacaaaaactgttagaagaggagcacagtaacaatcttcagtgtgaactgttggtccatgcaaacaacggaatagctcggagattaccgagaggcagaagaaccgtgaccagagcttggccttccagtcgttgaggaactgcggctgcgccttgagcagcgcggagaagaaatcaccgtgacggttctcatcctggcaccagttctcaaagtacttgaagatggggtacacctggtactccgggttcgccttgaggtgcctgaagatggtgatgtacctccagtacccaatcttctccgacaggtaggtcgcgtagaagatgaacttgggcttgaagaaggtgtacttcctagccttggtcaagaacccgaggtccagtgccaagttgaaatcagacagccccttgttcaagaacctgaacagcataaatcatgcagacaattcagttgaattgcttactcaattgagttgaaatggacgccctaaaactgaagcttaaatattttctctagtcatggtacagttcaatttgagttgtaatggctgcttgcaatcacattgtgtcattgtgcaaggaaataatttagagtgtgttactactacttacccagcgtgccgggcctcatccctggacatgagcgagaagatctcagccaccactgggtttgttttctgcaaaaaaaaaaaaaaagaaaaaaaaaggagcattagcaagcgcccaccaggtgctcggtgaaatgcaaagcaagaagctagactgcaactacgaaccttgagcctgcggccgagctccttgtagaggaggaacccggagaactccgcggtgcaggagcgctcgaggaactcgacgaagatctgcctgagaggcccctccatcttgtcggcggcggccttgaactccgggttgcggacgaagtgggtctggttatagtccgtcttgaactcctgcagcagcgcgtcgaactcctcctggttgagctgcttgttgatctcggcgttgaacagccgctccatctcgtcgaagtccgtggtgtagaaccgcggcgtcagcagcgtctcctggatctccgtcttcccgcgcttcttgggcgtcccgggcttcgccgcgggcggcgccgcggctgacgacgccacgcggaaccgcacgatgcgcctggaagacacgacgcggggcttggcggcggagaggccgcgcattgccgccgggttgaggagggagagctccatggcggaggaggccatttcgtcaaacacctggccggggcgggagggggaagaagagttttgggggaggggaggtggtgggcgggtatatacatggtgggacggatggatgagataaggtggcgagagatgaggtgtaatctacggctatctaatgggggctcgccatgtgtaacagagtgcaatctaaccgctagctcatctccttcccttttcattattattattgcctccatttaaaatattatttcttttggtttcttttacaagttggaatagtgtttattgtttttctgggcaaaacaagttgttgtgtttgctggtttttttgagaatgctctttttgccccttttttttctttgtttaggagaaaatcttactgttttctttttgagcatatagcaattggatagcaattcttcaaagctcatctatggagagactatgggcccgatcgagagtgagggtgggggaataacccctctggcacggaaaacggagcaggccattagcacgtgattaattaagtattatctaattttttaagcaacttttatatataaacttttaacaaaaaaacacaccgtttaacagcttgggaagcgtgcgcgtgaaaaacgaggtggtgggggcgtttgtccgtgggaacgagcgcaccctatatcaaaatcttgagaagttggcaagttgcgcaaacagcatatactaggactgttcgctgcgctgcatccatgtaacttgttcaagtgtgggtgtcttcaaggaatttggctaactgtggcacacttgtagttnnnnnnnnnnnnnnnnnnnnnnnnnntgaacaaccttattaccttattacagtaggtatacaatagcaagctataagtcagctataaatatattttaaggagataagagcaagtacaatagtgctattaggaaggctctaaaacttatcaatcatcctaaaacgagattaaggaaagaaaatcacatattgagaaagaagccggtgcttgcacagcgcctcacgctgtatcggctaggagatacaataaaaaaaattcgtttgtgggtcctaccgcttgttaattcgtttgaaccaatgtagcttataactaacttgtagttagtttattatataaattgctctttaagttagctctacctgagacatgacaaaattttagagcctactgctagctacactattgaccttgctctaagagcaagttaatagtatagccaactactagctccatatcacatacaatcaatttaatagccaattcatacaatagttacatactacactattaatatctggttccacctgtcatacacacactgcgtcttggagtccgtgctacagctggct

SEQ ID NO: 79280 - DNA, 73616 bp, Oryza sativa
ttaaaaaagtcagcggcgtcaaatattttgagatggagggagtatgtggcaccttactaaattgtgttggggtagtgttggtagcattcctttttacctgcttggagctgtgatgcacatttcagcctttttactgtcccacctttctgttagcctgtcacttctttttatgccttccttctttgtcttaactttttctggtatagtttcttgaatatgattgtgtgtcactgtatttcttgtaatgttgagtttcattttatttaacatgaaataacacagattgcttgcttagtacaagaaagggttctagttctacaaatatcttctatgaactgtttctctttttttccggtaacaattctttcaatgaatagttgatttggaccattaagctttctcagtatgtacttggcttcatactttttgcatgctgtcttctgcttatgaattatatagtgttcgttaatatcttcaattctgattgggttatgtacttatgttgttgcttatatcttttcaatatagtttatactgctgtgcccatttttatccactcttgttcaatttcctttgtcaggtggactgtaatgtgtttagctgactttttgtgtctgtgtatgcatgcaggcaaacgctatgcctttgacacttcacagaaaaattgcttgttcgttcaaggaccagtttcttctacagatcttccaaatttctttaacctcattacaccaactgaagagtgaaggtaaagttcaaggaccacattttgtaaaaagtagagtgtatcggaatgcccacactttctcacttccatcttctgatacaatctgtaattaaactgcagtacctgatgactttaggcgtgatcccctctcgcttgcattaaggtgcttgtcatttgactttgttggttgtcctgtggatgaaagctctgaggaatttggtacagtgcaggtatgttagtttgcacaattgttatcttctctgtaaaaccattgacctatcccagttggtctatttcttataatttgtgtaatttttattgatgcagcttcctgcatcttggaggcctctccttcaagatccttctactgttcagatcttcttcgattactataaagtcaacgatacatgtgtttcaaaagaggtatacattgattgggtgatttgaataatatagatgatataatctctgattatttttaccgagtgctttgtccattactccataaacacaaaagaggtatattttgcttcatagttcctcatgtttagaatgtacactttgatcgcatgatttttcattaatacattttacaaacttattgctagttagctatcactacagttctgcaatattttgattgacttccattcagcagcaatatttttccaatgttgtcttttaaaagcatgacttcctcacctctgtgaagcagcaatattctcctaatgtatggatctctaagaggcatgctttattcctttcaagaatctctaagaagaaatattttccttgtgaatttatcttacaaacagctgtttcgtttttctttctatatgagtaatgtgccatgttcagtggatttgctctttccttgactcttccccgcctccctctcctatgcacttctttatgtcatttctgcaggctttggaatgtcttgtgagacttgcttctgtcaggcgcagtatttttgttgaggacccttcaaggacccagtttctttctcatctgatgtcaggcacaaaggagatactccaaactggccaaggtataacgctttgtcctttttttgccaagttctgttctattgtagtactcctgttacaaatttcagttacttggaccagcggtttcaattgcaatcctcttacatggagtgaaaagcctcttttatgtaaagtgaagaagcatttaaaacatgagttgattgactcatgcctagtcacgctatgtggtgcactgtagaaaccagacttgctttttataagtaaaagcacacattggttcattataaatgcaatagtaatctttaaacttaggtacttgtctgtcaaattagctccatgcaggaacaaaaataaatgctccatatctttacgtaatttattctgatgtgtgatctgctcatctgcaggtcttgctgatcatggaaattaccacgagttctgccgtcttcttggacggttcaaagtgaatttccaggttggaatcctgttacttaaaatgaaggatgaagctaacttttcttgtttgttttgtgtcaaggatttgctcttcgttctctctctttgcattcttttacagaattattgacttgctagtttttggtacgtaacaactgatgaattagttggcaacagtagtgatgcattaattctggttggtatcctgactgaaatgaattgcgatggtggggattttgtgggattccaaacacgccttactgatgttattttaccctgatttgtacttttgtactattgctttgaaggaacagtaataagtaaatccaatggtttgtagcttctagtcttttggctttactagcagcactaactagtcatactgatatgcagttcaaggttttaaatagtggattgcatttttatagtgcattggttttgatgtagagcatatcgtaatgatgcagtgcatgttgtagtgaacagttgatggaatagttaatttgtatcataattataattctacgaagtgaactattgtgtttatgatgtttttatgtatttttggtaatgtttgcaacttgcaagtgctatttttgttggcatcttcttttaattttttgccttacagacatttggtaccaatttattagctttcaaagtttcaataaacaacggagcatttaatacctgtgtaatagtgttgtcaactgaagatggccattgttccaaactttcttttaccatttttctatatgcattccttgtcccaattgcctattactaacttactgtttgttaagttctaaataaaaagcatggttcaatattttcttaccacattcaaaatttgccataatgaccattccttcttatttagaactttgataataacgtagttatgtaaattagtctatgttgatcatgaaaataaaattgaactgtattatgtttgttttctgttggcatatcttcattgtgacattcggaatactcccggcattttgactaccaaatgatttggttggttgattgttacctgtgtattagatagtgttggctgcactcatttatgatcctttatcaagttctctgttattatcatagtaatattcaagctatgaatggacctctttgtgatcaagtgtggattcttgcattgttgtactttgcagttgtcagagcttctgagtattgagttttatggtgaatggattggtttagtagcagaattcacaactaaatccttgttgtcatggcaggtctgtttcccttttttttttttgactaattctcttagcactggattattcaataattaatttccaatagttctaactattgaatatttgtagtgggccagcaatagtgtctactatcttttgagcctttggtcaaggctggtgacatctgttccttacttgaaaagtgacacaccaagtatgcttgatgagactgttcccaaaatcacggagggttttatcacctctagaattaattctgttcaggtactgatttctaatgagatgatggaactgctttctatctcagattctcagttgaagagtaacgtttgttatattctgttgtttctatccatctcaggccagctttgcaaacgactcatccgatgatactttggataatgtggatgttcttcaggagcagttggagtctcttccttacctttgtagattccaggtcgccatttcctgtcaagttctggtttccaatttaagagacaattttctgttaaacttttgattggatccatctttgtaatcatgtccacctgtagataagataccttgcttaatcaattgaatgttttcttttatggagattaaccctgttccagcttttcacataacaggattcatagttttatgtaattgatttttttattgaacatatacattggttttacttttatctacttgcagtttactgcatgcacttagtaatttcttgtatatggcactagaatttctttctttaagttatggagaactaatagaatgatacaacaacagtagatgcatcaaatttaagttgcattatgctattcattttttatcgtatttaattatacgattctaaaacaagaataaccagagtaattttttggccaacttaagtgctttgttgagttgttcaacttcatattctggacgggtgcagaaaatatagtaaataagataaaaaatttgacaaatttagaaatgctattggatggatcaaaaggaaagataccagtttctctctgcatttttcttttttgggcggttgggggggggggggtcaatggctgtgatcagatgctcatgttccagtataacagtagctatttgttttgttatggcaaactggctgattgaaattttctaagcacttcatgtggtcgtcagcccttcccgattgacatggtcaagaataaaggcaactgtggatagacatgcaacttagcagttttgagccttcgcaagtgttgtgtacacatcctatgtttattatgtatgttagcttgccaacatgtgagtttagctatctacattgtgcctctcaaacagatgaagatctcttattaccatttctgctgttttcagctaatttattacgccacttcattatatatatctgttatttttgtccggatggaatttttatataattattttgagtcactactaacctccttgccagttaccaatagtacgaagaagctagatgaaatgcccttattgttcttaggcctttttttttttgatagggagttgcattatatgacatggccataacatgattttcttttgctgatttgcagtaccaaaacagtagcatttacatcataaatattatggagcctcttctacaagcttatacggtatgttagtgttatttcacagtcctcttttttgggcagaaagaatgccttttcaaagccaaatactttttacaggaaaggtcaagattaccagctcctggagatgcgaatgagctctctgtcattgaaggacagctcacatggctagtccacataattgaagccattctcaagattaggcagaccattggttgtaggtgagaaattaacattccttgcttccttatattctgtttgatttcctttttttttcacctacaatgctcattttttcatgcagccaagaatcacaggagttaattgatgcagaacttgcagcccgtgtgttacagttgataaacgttactgacacgggggtgcacgcacaggttagatgaaaatgatttggtcatctaacatcaatgctgagtgctgagctagtgtacttgtagcaacaacaattttcctttctagtattgtctgcaaattatagaatataattgcatatgtaggtaggactgattttgttttttgacaaacatagatattttctagtactgtaatgcaaataacttacaactttatttttatcgccaatactgtaacatatataaccaattactcgtttctctatttgtcgtgaagcttggagtcacagcaacgcatgtggttgttgatggtgttttggtgtttcttacagttatcatgagaatgctaccaatagaagctgtgaatttgcacttaaaaataggctgaaattgaatttatttaacgaaaatatctaaacaatgtccccctatgaacttaacctttggtaaccagcccactttaagagagttatatttcatattgtattatgtgcagcatgtaaaccacatactgtccccataaaccaaatctgtttctgtattgcgacactacgtatcacaggatgctctccaatttgttctttactttcattaacctgttttagctgctcttataaccattcacagcttcacaaatttgtgaatgatgacttgggtgcattctttgcagagatatcgagtattaagtaagcaaagacttggtcgtgctattcttatctttgtgcaaaatttcagaaggtcatatgtaggagatcaagccatgcattcttcaaaggttagaagaaaccgaataataggacataactattataatttttctttttatcttgatgtacctttttatgtaaatccccatcaagttttacttctttgctgcagcagttgtatgcaagattatctgagcttcttggattgaatgaccatttagttttactcaatgccattgttgggaaaatagctactaatctaaagtgctatgctgaggtacctattgtttagacatttactgattttaggcatactttgatctatatgctgtggctgatcctttgtgtggttacagtgcgaggatgttattgatcatactctgtccctcttccttgaacttgcatctgggtaaagttgtagctatatgtattcactttacatgtctcatgcttattatggtaacaattcttcatatgtattttcgtagcagctatatgactggaaaactgcttctcaagctggagagtacaaaatttataattgcaaatcattctgtacagtcttctcactagcttctgtttcatgttatccctgtgccattcctggtcttagaagtgattctattttcattattaatcttttcagagggattcttttccatttcttgaagaatacagatgtgcccgcagtagaacaacattctactacatccttggctgcttggttttcatggaagacaccccagtaaaattcaggagtttcatggagcctctcctacaagtgcattgctacttatattcataatctctccgccccagaatgtagctatatctggacctgtacagatcgtaggtagaaatagctacattttggggtgtaggaagtactagttaagttttttctccattcttatatggttttcttcttcgtattctccataggttgcagttaatttggaggcaaccgctgatgctgctttctggactgatgttgtgaagtacgcatttattggtttgatgagagacttacgaggcattgctatggccacaaacaggtgcacaatttgattatatgtggtatatatgtgcatcaactcactaactactttgttgatctgatccagccgcaggacctatggcctcctatttgactggctatatccatctcgcatgccacttttactgaaagccatctcactctgtgctgatgagccggaggtaactaccaaatcgcaatgctttccttgcgtagctgttctttttgaaaaagtttgaactgtttttagaaaatatctagagccttatgcttctaaatcttttgctcagctactgcaaaatcaccactttgtgttcatgcaggtcaccacacccctactcaagtttatgtgcgagtttgttttgaacaaagctcagagattgacatttgattcatcatcaccaaatgggatccttttattccaggaggttagcaagctgattgtggcttatggatcacgtattctgttgcttccaaacggcactgatatttatggaagtaaatacaaaggcatatggatatcacttgctgttctttcaagaggtgagttcagaaaatatgttttgaaaacacctgtatgctctgcaattttattacagtttcagtaaagtctacctgctgttattcactgttttctaatgcttgatttttttagtggatttcatcctttccaattttatgtgcgactctcattgcacaatttttttgtttgaaaaagtgtgctttaggttacacttttgctgtgaaatgttatttgaattccaacatgtctctacgaaatttcaagaccaaaaccttgtttttgcaccccattgagatcattgttttccaacagacaatattaacttatccccatgggccatattacctggactgtgaaagcttgttcatttctgttaatcatttaactccttactgatttgtgatatttgagttgaattgtagcctcataggccctggcagatgataaatatttcaattgcataagatttgcagtagttgagaatgggtttatgatgattttggctaaactgaaatttaactgcaactatggttaaattctgttgcaaatatggcagactttctataccttttcagtttcatgtgtggtatgatctatggatctccttattcaagaggatactgatttacttgaatttggtatgagatgttacttggagttttcggttagggtgacagctgagttccaccatctctgattcaaactttttgttgtgcttttaatgttataagaataaaattggctgagttccactcaactccgagcccaattatttgttcttaaactgtatcttctgggaaccttatctcccattgcagactaaagatttgtattttttttcttttgctgttattctgactggaaccattgcagctttatgtggaaactatgtcaattttggtgtatttgagctgtatggtgacagagcacttgctgatgcccttgatatatctttaaagatgagcctctcagttccattgtctgacatattggcattcaaaaaggtattccttgcaactttagtgatttactattgttttgctgtgtagtgctattgcttttattaatatggttattaagatctcaaatatattcattctaagttttatagcattgaagatgtaaagttctcattatatcgcaatgaaagtgaattgaatgttatgtatatcaattaagcagaggtaattacttgtgcctcaggaactggactgagtgattttagtgccaatcttctaatctaactgagaaccctgcatttacgcacttggtccagttagacaacgctgttatgacagaatatacaaattgatcagatcctagtatcttagcctgtctagaaagatttgtatattctgtcataacagcgctgtcatttttttatttgaaaatatacacagtaaaattaccaggagaaaacatgaaatgagtaccgccaacagtgggctccagagttctatcaggaaactttttctttggaacatgggatgctgctgttattttttatttttatgccagacattttcaaacatttttttaagagcattctccaacccctagaactgtactccagttgtgtttgaactttgcatattttttttcaacattttgtttgtagtctccttggcattttaccagcaggtaccctgcatgcgagcttagtttatttatttaggtgatctcctggcaatttttgcccactggtaacatgcgtacaggtttagtgctatgttttccaacaattgtgcttttactggcttgatcatagacaaataaacagcctagacaccattccaggtcttgcattgtcccacattgatttatggttaaccagatgattgagatattcttgtttcatccgtggaagcattcatactaggctctttctttatttcagctgtcaaaagcattctatggatatattgaagttctgttcagcagccatatcacttttgttctcaatttggatacaaacaccttcgtgcatattgtcagcactcttgaatctggcttaaaaggtctagatacagggatatcaacacaggtatacgacatgatgctttttactgcttgtaaaatgttccccgcttcttgttacaacagcatcggtgaatcactgcttaaactgtgtcctatcggggaagacatacttccaatctgtggttgctggtagataataattgatgccatcataatactctattctcttttatgtggtttcccttttagtttcttctcttggatctggatgtcatgtgcaacctggttagggcccacatagaagcagcagtcaacctctctaggcctgcagtactgtgcacatgaatagtaatgggaacaacatctgcctatggttactgtttaatcatttccatgttcttcgatacggggtatatcgtaaaggtttgggttgtagaggtttattaaggaagcaatacacacaagcttttagtctcttttttatctccttcccttatgcagctacctcagcactgcttggttcattaagcctaagggcccttaactatgttcatcacattggaatccatcattgttctttagtgctttctgtttggactaatctgtaaattgttgcttccttttggcagtgtgcctctgccattgatagcttggcggccttttatttcaacaatatcacagctgctgatggccctccttcaccagctgcactaaatcttgctcggcatattggagagttccccactttatttcctcaggtttgtgttaataatcttctctaccatatgcagaaaggtctggatgtaattacattttgttttttttctgtgacagatactgaagacgctttttgagatcatcatctttgaggatgcgggtaatcaatggagtcttagtaggccaatactgagtctgataatgatcagtgaacaggtgcttgtctttttaaaacttttaaatcatgttccttagcatttcttttgcactcttttttccagtttgtattgtctttgttttttttctttttttttttgcgagggtctttagatcttttctaatcagttgtttttctttgtgcagatgtttagtaatttgagagcacagatattagcatcacaggtcagtgaactctctggtctgatattccactatgcagtcctgtctttctagttttatttttgggttaattggatccatgccactgcaaatatgccaatttgaaaaaatgtcactactattcagcattcggctatgtgccactgaaaattggagaaactggaaccgttcacattttccgtcaaaaatccctgttagcccccaactgcacgtgggccccatctccctcccctctcttctctttccccttctctctccaccaccgtagatgcggtaggtgttgtcgccatcgtctcggagccggaagatttgcgattcaccctcaccgatctcgcgacgatgggtgatgtggccgcaccagctgcggcggcgcgggcggcgaggccgacgagcccgttgcgcccgcccaaggcgatccgcagcaccaagccaaggggctcgacgaggagaccgtcatggcaccattcgtcaagcaccttgtctcggagccggcctgctgggatgcgcctgcgtcgtcgtcgtcgttgtcgagcgcctcgtctcggagccggcgagccagactgcgcctgcatcgtcgtcgtctgctcccccggcaaggtccccggccaccgcccccgtgccggtcgtcaccccgcccaccgccgcatcgctgtggccaaccctcgctgccaccgccaccgacctcctcccggagcgctcgctttcatctccttcccccgtgccgctcgtccctccgcacttcaccatcggctccccggctgccgattcccctcagccgtcgccctcctgggctcgccggcgtccatggcggagaagctccccggctgctaattccctcgacgacggcggtgagggtgctgcgtccgccggcaaggacgacgaggaacggacgggtcgcggcggctgctggtggagcagcgagagatggagggggggggggatcactggctagctgcagtggcaaggaccagcgagttcgaggtggagtgctcgccggtgtccatggtggagaagtgaagaaaggaagagggagagagatgacggaggttgacagaaaactggatggaagtggcatggttccaatttccccaaattctagtggcacgtagccgatatgctcaatagtagtggcattttttcgaattggcatatttgcagtggcatggatccaattaacccttttttttcctctgcttgaagctttctagtgtcaagttatcaacaatgtttccagtcatcagcgtgcaggtgttaggagacaagtttcttttcagtaaaaatattaaattctactagtacatcttttgattagaactgtatgtccagcttgtgatgtacctaagttttgttaacatatgtctgccaataacagcattagtaatcattattgaagaactaatgtacgtcttgtttgcagcctgtagaccagcaacaacgcctttcgcaatgcttcgagaagctgatgtctgatgttgctaggaacttggaaccaaagaacagagataaattcactaaaaatcttacaacattcaggcatgatttccgtgtgaagaacattcaggcatgacagctgttcaggaccagctaccagctttaaggtggtgcactcatgtgctgtaaatactttagcttagcttcgttttaggaaccaccattcccgtggggggaaagttatggtttaactcagtttggtttggattggctgaaagatgaagggttctcctgctgcacgtggtggcaaaatgcagttgttgatctcttaccttgtcgtgtactagactggcgagtgcaggagattcttcttcttcttcttcttcttcttcttcttcttcttcttcttcttcttcttcttcttcttcttcttcttcttcttcttcttcttcttcttctctttttataccttagtgttaattccatctctttttgcttgtacagcaatattcatgtgaaagcctgtgatcgctgtttccctaagttgttagggcgaaagcagccatcgctcaaaatataattcatttgttaacaggttagaagaatagaaaaaaagttgtaaatggttgtgcttcctgttgctgtcaatgctcaaattggaagtgaggagacggtaaatttgctccttgagcttcaatacaggtttttattcagctaacgtctttttttgcggctctccatatttcggttcattatagccccggactaatgttgtgtacagcatttttcttttggaggtgctgtccagagttttggagctcgacggcgccttttgcctatggacctatggaaggcagttcttcagtcttgcccacggtatttgttgattaatcttgttctttagtcttcttcagagttcagattgtttagattgtctgattttccacttgctcttaagatgtattataggttaatatagctagttgggtttctgttctggtttccttggtttgacactattcaggttactattcttgattggtttcaaacttcccatatttcctgtaaaattcggtaccttacaacaagtatgaaagtacaaactattcatataaagtacgtcttaataattaattaaaataaaagcacagaatttttccagcactattgcttagctcactctttacatataattccatttaagaaaataccttctcaatactgcacttgtacaggaagaaccagtaaaaatctaaaacaagtaaacatctgaacaatggataaattggggattttaacgtctttgtgagtgtcactgtattggcacatcactccccagtttacgctctcactacaggccctatttagttcccacacaaaaattttatactctgtcacatcgaaccacatcgaacgtttgaatacccgtataaagtattaaatataggctaaaaaataactaatttgcatagattgcgactaatttgcgagatgaaacttttaagcctaattgctccatgatttgacaatgtggtgctacagtaaacatttgctaatgacatttgctaatgataaattaattaggcttaataaattcatctcgtggtttaccaacggattatgtaattatttttattagttcccgaacaccccatacgatatattatataatacccgatatgacgtgccaaaactttacacccctgatctaaacaccctcgtagacttcagcatacggtagttgtgcaatgggcctacagtgccggcgctgagtcctccatccttggggcattcaagccctgtgacacggaaaatttggctttgtatagttcgcgaaattaaaatttttgggtatcacatcggacgtttgaccgaatatcgaaaggggttttcggacacgaaagaaaaaactaatttcataacttgcctggaaaccgcgagataaatcttttgagcctaaaatctgtcattagcacatgtggattactgtagcacttatgtggctaatcatggactaattaggctcagaagattcgtctcgcgatttccccccaactgtacaattagtttttatttttatttatatttaatgctccattacatgtgtccaaagatttgatgtgacgtttttgagaaaaaaaaattttggggaagtaaaccgggccttaaataaaggggataacatataacacaagatatatacatgtacattgttgtcgtgttacatctaaattctaatgggaaagagaatataagcagacagtaacaaaaaaaaaagagagaagaaactgcatctgcaacagttaaacccgatgcagaggtcgaaggatagaagtggcacaaaacacgatctgccaagcctgatggaggcaaccaaacacgccaaaatgtggcaaactgcacaatctgaccttaggaggcagaaaaaacatggcaaaaatagacaaaatgcggaatgtccccattagtgcttgagagtagctaccattggtcactagtcaggatgcaacgacaaacaacaatgcacttgaacatttaacaagcagatgctcatctgacaacgaggacaacatatcgatcctgaccgataataggtaggttactttggatatggaaggatgctgcttcacatctccttcatagagttaaagtggatccaacagtaagtccgacaagaaaaccgactgccaacatcgcctcagggtgtatttaattcataccaaaattgaaagtttggttgaaattagaacgatgtaatggaaaatttggaagtttgtgtgtgtaggaaagttttgatgtgatggaaaagtttgaagtttgaagaaaaagttggaaactaaacaagggctcagatttgccaacccgcttgctcgttgtcgctgtagcatttttccagcctatccaatatcccagcaaaagacctcttgcgagtccttcttcattagttgcgcatataaaatagagttccaaaaacaaaacaaaaaagagcacgacctcaatattttcattcaatctttataacataattgagaaagacatgacttatcatattgaattattagcaatgcgaacaaaaatatgcatacattaaatatattgtcacatcaaaatgtattaagcaaacgcaaacaaacaagtgcgagaggaataatgcttgtgttcatcccaaacaagtcgatatacttttgctaaacttttgtatgattaacaaaagtacagaacaaaactcagtttggaaatgaatacttctttaggagcgtatgttgaacaaactgcaagatcatttgctaacaaactctatgcagtcccccaattaagttgatttttcttaatgttgaagtcccatgttacatgttacattccctttgtcagtttggatgaaattttgacaactaaagcaataaggatcgcatccctatggtcagtgtacctccatttccactacaacttaattaatctattaagcaggaatcagaacatgccatgcccttattcggcttccaaaatctgcctcattccaagtcctctgcgtgggcaagccgaggtactcaaacacattgatatcttcactttgtgttggttcgaacgcattgatttacatgccggtgtcaaccaatctaagcccttcatttgtgaaccatcataatactataaatctggataggtagccaacataagtttcatatgtacgaatccaatgatcatagtacaaatccggactagaactaacacttgttatgaatccaacgattacactgcactatatatattatttagtgagtcgtgactttcgctatttactagttacatgcccatgcattataattagatctatagataaaaatataatttggttcatttctatatattttttatgatgtgttgtggatttttaacatttatttagatatatttttagaggatagtttttataacggtgaggaatcaactttttaggtaggaggacgaaagagcattataatttttttaaagtttttttaggggaaggaggatgaaagaaattgttaagagtaaaaagataatttttttttggaaatgtgaagagactgtgcttttaaaataattaatataaatatatatatttttatgttatcttatatagcttatatctaaatacaatatgtgagtaattatattttatttaatttattagttgagttcccgtacgatgtatcgggaaaaaaatatttggttattttccttcaattatttaatatatgatttaatcgcaatatcttttcaacttctaataaagataaaaaaactatcatatttttaagtatttgactataatccatttataattattgattgaaatagagtactacttgaagggtatttcggtcatgagaattagatagtgtaccatctcttactctcactgtaaagggattgagcagggtaggtacaattcaacaatatctaaatgtgcatgctgtgagatccacacaagcaattgagcagggtaggtacaattcaacaatatctaaatgtgcatgctttgcatgctttgagatccacacaagcatatggatggtccagattgctggtgcatatgcacctaggttcatattatccagctcctctatatatatgtatgtatatatatatatatatatatatgtgtgtgtatatatatatatatatatatatatgtatgtatatgtatatatatatatatattctacacccggccaaggcgccatcccgactggccgcccccaccatcccgtgatccgcccccgcaccccaccggcccaccccaaaatagcgaaaagagaaaaaaaaggaacgcgaaaaaagagagaaaaaaaactcccgcatccgccgccgagaggagggagtcgcgcgctgccctcagctacgccaacctcgggcgccgccgcacggaggctccctccggccggcctccttccccatccctctcctccctccgtccccctccctctcctttcctccgtctttctcctccctcctttcctccatctctcgcaacaactctcataccttccacagcgtcgtgccgtcatggggaaccctaacgacgcacccctctcagctcgtcctttcggcgccgctcatgactcccttctttttttcttgaggtgagttttgccctaaaaaatcttgttgttactgtctatagatcaccatgttactgtccggtttactgcatgcaagttttgtcaagagaaatttttggttactgcgttgttactgtttatagatctacttgttactgtctggtttactacatatgagtttttccctaaaaaaaatctcgttgttactgtctatagatcactatattactgtctggtttactgcatgctagctttgtcaggagaaatctgtggttactgtgtcgttactgtctatatacctccctgttactgtctggtttactgcatgtgagctttgtcttaagagaaagattttgttactgcatttcaactgttccgttactgcatttcctgtattattttaccgtctgatttactgcatgtgagcttgttcgagagagcatttgccctagcaatcaccatgttactgctagctcttgttactgcatttcaattgttttgttactgcctttcctgtactattttactgtccgatttacaacatgtgagctagttcaagagagcatttgccttaggaatcaccattttgttactacattttaactgttttgttactacatttcctgtactattttactgtctgatttattacatgtgaacttgttcaagagagctttttccctaggaatctccatgttactgctgactggttactgcaagtatttttttactgctcattggtgtatgtatcgcgtatgaaataactgtcggctgtctaagatattgcatatgagttactacaaataattagcggtttcaataacaaaggggagcggttacaataacaaaggggaggaagaaagacaaagaacaaccggtgtcgaaacaagctgagagcaagcagccgaaagaccatagcaaaaggtgcagcgtctgtcacaaaattcaaggacacaatgctagaacatgtcctagtagaagcaaaagacaaaaaaacaatcaaccgccaagcaatagatgattatgacgaagaaaaagaggaagaagaataagtgtacaagtgatagatacattgcttctgacttgtaggacatttgtaatatgttactgccatagtatataactgtgactgtctttaagcatattggttgctaaaatgttttccttcatcacgatgcccagttagggcagcacatcactgctatataacatgcttctagtactgctatattgtaatgttttatcatgattccagttgaaatgacatgttaccagtatgtttactgccatgatacatatatgttactgcaaaaatactaatctgttactgcaggaaagtaagaacaatataaaattgtattgctgttgtgaacaatagatacacgacgtaatgccgattgctgcaatgtcattatgtcctctcgtcaaccttggtaattataaacacgggcgtactgttacatttgtggtaccaaaataaatacaaaatcaggtatgttactgtcagacatacatagaagttactacaaataattagcagcattactgctagattctttcagcccacgttggactctacggaaagctacttttgtgggctatcaaaaatacatacttgttgctgccgaaattacgtagctgttacagctaaatacacacttgttacagccgaaaaatacatagctgttactgcaaaaaaaaaaacacgtatcttttgcatcggagaaatcgaaaaaaagaacaaaagaacaatattactaccgatatgactgagaaaaaatctgccgatatgactgagaaaaatgtgacacatatattctgataacatttgttttgcattcagaaaaccagaactgctagataagcttgctagaacggctgtttctgccaacagtactatgttactacgaaagtacatacttgttactaccgaaattacatagctgttaccgctaaaaaacacatatctgttgcatcagagaaaccaaaaaaaaggaaaaaaaagaacagcatgttactaccgatctagcaaaaatataatctgagagccaagtacaagtactactagtgttactgccaacacttgatcatatgttactgccaaaataaatgtttgttactgtctaagagccactgagtacatgtattttccatacaaagtgggaaggcaaaaagaaaactacaatactacttggtgtcaatctacggcctaaatttctcaagaatcgcaggcaataacggtttgttgttgttcaaccgatggtagaggaattcctgccgaaagtgtgttccatcctcctccataaaaaaacaacagaagatttggttcagttacttgggtttgagtacgattaagggaaatctccagattttcatcaccgtctctaaccacaacctttgttattgtcaaaatcttgccactcttcttatctgcatggaaaaggtagaaaaaaagatgtgttactacagagcaagaaggttgtcactgcaaattaagatatttgttactagaaatgtccatggaaattaaaatcagagtcatgcacaatataggctgcatattaagagaagaggctccgctcccactgccgtcgcgcctagtggagagggggaggaaggtggctggggaagggagggtcggccccagccaccgctgccgcctatctgcggccgcgctaggggaggaaggaagggagggagcccggggaggggggtgggggcgcggagaggagaggggagaggtagtccagacggggaggctccgtcgccgctgagggagagcagcgcgtgagggggaggcggcggagagcagcgcgtgaggaagagggagagcggcgcgtgagggagaggcgagggttctggatccgggtgggagagcgtttttcttttcttttcatcggttttcttttcggttttgggcgccgggtggtggggctggcgccaggtggtgggattgaggggatggcgcggttagggggtacagaatagtttttctatatatatatatatatatatatatatatatatatatatatagaaaaactattctgtatatattgtgattatgataaaaatatatatgctcataaggatataattatattttataagtactcttttagccatgtttctaccataagtaatcttttagtcatggtaaaacatacatatcaaacatatatgttcacgaggatatatggtaaaaacatacatgtacagaggatataataatattataaaggtgtccatttctatcatgagtattcttttggccatggtaaaaaaatatataacaaggatataattatatttttaggaaacttctgaatttgaagatgccaactttactatatgatataatttagagatgccaactttactctttatgttatacattttaaaataattttatttatgtaagtacactgattattaggtgtttaatttttttattttctttttttgtaaaagtgtttaaaaaaacaaacaatgactacgacggttattgatttaaatcgctgcttttcctgttcgttaagcataaattaaaatatgctgaagatgaccattgttgtcttagatgttgagtcctgaatttaggtttgtgttatgtatagtgtttgacacgtattttttgttagaaatatttttttcatacatattctataaagaatcagcttagacattgacatttgttttgattatatttacataatcatgtatatatatgagaaatgttaggaattctatattttcttaacttgtgaattgagaaagacattatttatctaagctctctcgttgtgtttttagaagcatacacatagtgttgtgatgttaaaagcatacacatagtgtgtggatgaatgggtaaagcatacacatagtgtgtggatgcatgggtagaggaattctatattttcttaacttgtgaattgagaaagacattatttatctaagctctctcgttgtgtttttagaagcatacacatagtgttgtgatgttaaaagcatagacattatttatctaagctctctcgttgtgtttttagaagcatacacatagtgttgtgatgttaaaagcatacacatagtgtgtggatgaatgggtagaggtataggatgaggtataggatgcccatatataaaaatgatgttagttaaggaaatataatgcacgattatctcgttcgtattgtctggcctaattttcatttctttttatatcaaacttgatatacttttttatcttattttctttctttttttgcatatgtattttctatctaggtgacataaatccatcaaatgaaagttcttttcgatgtctagatttagatatatactgtcatatttattttgtttaattgttgtgtgtgattatcggtttatctgggttgtcacccactcgctgaagaaccctaatgacatattttttatcgcataagtacttgttcaataatttcatgctccctctgtttcagattataagatgttttgattttggtcaaagtcaaactgctccaagtttgaccaagtttatagaaaaaaaatagtaatattttcgacctaagataaatttatttttaaaaaatatttaattattaatttaataaaactaatttggtaatgtaaatattacaatatttgtctagaaacttagttaaacttgaagcagtttgactttgatcaaagtcaaaacatcttataacctgaaacggagggagtatttagtatgctttagacttatgtgttacatcatgcttagcccaagcagtgtttgtttggattgccactgccatgaatgcaatctattatatactagtattttagaaaggttacagtggatggcactgaatctgtcaccaagttggttatttacagattatatgcctttacaacatttttttttccgaattgacctttgatgttaagagcattctaatatttggtttaaacaactgataacatatttaatgaaaaacatattttatttatggcatattgtaatagtttttatatatagcaaagagtgggcatttaactaatcattctaaaatcgtgtatgcgaatgcaaatatatacgaggcccagtcccttattggattaggatgtatagcgatttatatctattatgacggcggtttgtatagattccgcactatgctttcatatatcatgctttgatcaaattccggtcaaacttttcaaagtgtactagaatttgtttcatctcgcctatgtatatgcttatttgtaattaaaaaaatattttttgacatacttttatatatgtggccttagcgattcaaatgcaaaactataaaataaaccttggtggaaagaaaccgcaaaaatcaaaagttttaaaattcgaacttaatcttagaagtataagaataagtggaaatatgaggtcgaatgaattttgaaataatattcctttcatgatcaaataggtttattatatcattaaggtgcattatacctacatatattgtatagtgtgaatttggatatttgctttcatctaacccatatgttctgtttgctgtgctttttcttactaaagcatcaagcttcaaacgttgatattcttttgtgattgtgatggaggtttcatcaaacatgccctatctgataaacaagaatcagatttgataaaaattagtttttgtttacttgattttcagtgtgctgcaactagtgagtgcatttgctatttggctccatgaagctcatttgcaataacgtccacatcagaaaccgattaaagttagtgctttactttttatttaaagtagaatgtacagtttgactattacttagattcattcaactaattccatttggattatgctgtgtgcttttagcatttctctgcttttttttcctacttaaaaacagttaaccacttccagtttatttaagttgactactataaattacgccaggggtatcatctagttatctctctatctacatgtacttgatgttggaaatataagcaattcaccataatatttaatccaaaaataaagattgcaaatcatgacaatgtaagcaaaaaccatagaaatattattctcaaccataggaatatgcaaaatagatatgctataggtgtaaatcatataaacaagcatgtctaattcatttgcgtaataaacagaataaagaaaaaggaaagaagaggataataacacatggtgatggagcagtggttgcaacggtagcggaaagagaactgttgttgttcccgtcgttgttcctgttcttgtcatcagccatgatgaagaagaagtagtcgacgtagtcgtactcaagcacaagcgagcagttgcacaatgctctcccaaaaacttgattcgcttcctcttctcggtgcaagatctggaaggtgggggttccggaggcctgctctcccagcgcgtgtgcacacactcgtcgggatgtgatcattgtagcagcaacagaagtgcaaatggatgaaaatgtgtgtattctcacacgcgggagatcaaatccatcttcttttataggagaaaaaggaagatgaaggggaaaggactcatgtaatgtaaagagaaagatagaaactgattgtcatcaccaagccatcaatcatccttcactacaccaccatgaaacaaccattcgattaattaatcattggattaattctcaaaaaattcttcatcttaaccattgataactcatgagaagatgaatacacatatctcctagcataataaaacttagaatttaattgatttaaatggatcaattacctaattaaatctaacacttgactaatgagttttattgatattttagtgaaacgagtatagattatttggtaatttgaatcaaacagggggttttgtagtgagccttgggctctcggcactttttttctcgctctcacatgtccagtcaacaattaactctgttcagtgtcaaaaggaaaacaattaacattgggttgtcttggtttgacattaccagtgttattactggctaacctgcaaattcccttatagatcagaataatccgtttattttgatataagtggattcacggattagttacttacatccttagttattgctactccctttgtggacatcatgggtaccgcatacccacttggcctgcctatccgactagcggtaggaggtggaccgaatccatgtattatgtaatagagtaagacttcgttgccgtattgccttgtatcctaaagtagggtatagagcttcggctgaatactaacatataatagattagaaaattgatgccgtcactactacacaaaacattttcctggacatgggacacttttgttttcaggcgggccccgtaagagaaaccacacatgataatcaggggaccggcgccgagcagttacctgcacacaaaaatcaattttcgtgtgcaggccactgaacacgtccggacgcgaaaatagccttattttcgcgtgcggacatgttaagtggcccgcacgcgaaaataggtgcccaccatttaatccggccgcacgcccactcctccctctcccatctccctcgcccatctccatctccatctcccatctcctccccctcctcccaagccgcccggatctggtgggggggagcggcgggctcggcaaccgtgagcggcgtgcacacggtggtgagctcgtggtggcggtggcgggcgacaccctcccccccccccgccccgggcccatatccggggggttgcggggcgtggatccaggggcagcgaggcttaagcatccattggtgacggtgcgcaaggggaagaccggatcaatgcgatggcgcactttcttgatgacgttgagtgctcgtgtttcttgctgctcgatctttcttgcttgtttggatttggatgtgttgctgcttgatctgtctgcttgctgcccccttgacgaggaggggatgtgctcgctgcttgatgtgcgcgcggcggcgggcgaccgcccctagcccggatctggcagctgccccatgaagttgcatttatccccctagcgggttttggtgattaataataatagggttaagggactaatgagttttattgagtaatacttaggtgttttagtcccaagatggcattgtgtggtcaagagatgcttgggagacccccacaacatatattcgagcagaattggaactcgaggtgtgcatatgatagtttatttcttgtaatcgagttttaggaaaaaccgtactattaagaggggttccaggtgtggttctgggatacatcaagtgctcttagtgagatccaagtgtcaaaaattttttagagctatttttgagaatagccctatccaggacagatcaggacggccgaaagttccggtcctatggacccggaagttccggaccattgaagggtgaaaatttcctaagtgttgtccggaacttctggaggacaggaagttccgaacctgtttccagttcaaaaatgtgagtaacagctggatggcatcacctagccgtccccagttcactctttggccatttcacttttgcttttccattccatagccgttgctagcctctcccaagagtttatttgcttcctccacctgatcttgagccattcttgagagagagtgagattttgagggtgaaggagaagatttggagaaggtttgaaggttaggattggtgtgagcacttggggtatcttgtgggctgacatctcggtgcttattactcttggagataatctcctagacggttaggtgttgttcgcgagcttcctttcaattgtgcatgtcccgggaaagtttgtgaaggtattcctcacctccgcaaggaaacgaggtaagtgagtaaagaatcttgtgctgaagtcctagaggttttcctagtgtggtgttttctagaagaaggttgggttggatcttagtggtcactcaaattctagaaaatgacctaaaggtgttggggttgaaggctgtggatttcctctgagatttttgcacaaatgaggcaaggggttaatcgagacccggctctttggagcacctcaacgaagagtaggatcgtgagatccgaacttcgggaaaaaaaatcctctttgtcccttctgtgatgaatctgtgcatgtgtctgtgatattgctacctctctgtttacctgtgattcatctcgtgaattttggctaagttcctgttagtgattcctgaatttgtctgttgcccggaagttccggtataagaacaccggaagttccgaactttttgagcagataggaagttctggtgttctacacctggaggttctgggcctgtagaattttaccgctgcgatttgtttttgagttttctggcaagcctattcaacccctcctctaggttacatctatgcatgttcacccccccccccccggatcgtgcgacaacgacagtgcgcggcccctccctcccctcccttcccttgccttgcagatccggtggaggggaggggcgtcttcagccggtgacgggagcgggcggcggatccggcgtcaggagcaggcgacgacgacggcagtggtggcagcggtctcccagcgtctggatccgttgccagcgaccgcgggggcgacggcggcggctggattacggttagggttttggttttttttctttttttttgtttcaattttttattttcccgtgcgggtgcctcacctgcacgaaaaaattgtgattttcgcagacgttgggttccagacgggtgaaaccaccgcacgcgaaaatgagtttccactgcacggaaaaatcgttattgtagtagtgcgtgtctggctaagtttttctctttgtaactctgcctcccaactaatattagatgggcatgaagccctacaaggacataaccacaaattgatcattagatcaatacaacacccgacgaattcaatccccaaatagaagtagagggcatgaacctgtctaaaccattgacctctttactcattcacttttagaccttgtacactacacccttttcttattgccggtctagaacaatggcatcctccatcctaaaatataaggcataaccaccacaaactcaaaaatgaagaaataatttaattaactagattgtatcacctcgatatatgcacgcaatgtgattagagggcttgatggtagaggattttaaataaaccaaatttagaggaggaagatacactaattaatatatgcatatgtgaacgcattgtattatgagatatgagaaaatgttcaatcttatattatatttttgggatagcgaaagtaataatccagcttggttcagactttccatgctcactgataaattatttatacatgagatgttgtatccagggatgaatctaggataagattggagagaaaactcacattcccctactcttcctcctctccctcttctccatttcctccctccttttataaatggtgaatccgaccatagatgatgttgatgaacgaacattggagttgatcaggtgttacgtaccacacacaccaaaaggccatatatagcgtccgtacgtaccgtacgtggatcggtgtgttcggtcggcatcaattgggagtgccgccgttccgttccgttggggttgcccgtgacgtgacgctgacgcaagcatgacgtcggccgtggacagtcaatcaatcagtcgcctcggtaagggtacgtacggagtagttactacatcctgttttctggagtaacagatgacgccgttaactttttctcacgtgtttaatcattcgtcttatttaaaaaatttatgtaattataacttattttgttatgagttgttttatcactcatagtactttaagtgtgatttatatcttatacatttgtataaaatttttaaataagacgaatggttaaatatataagaaaaaattaactgtgtcatttattaaaaaatagagagagtactacgtacggcctggaccgatcagccacccaacgaagccgtccccatcacgttctgtcgatcaacggccggccattgccatgcacatgcatgcagatcgacacaaccaacgacatgttgactgttcggtactatgctgctcctctatttgacttcctactcgcagactgttaaaaggtgactttgattggtgtattccctccgtcctaaaaaaatcaacatattaacataggatgtatttagttcacgctaaaattaaaagtttggttgaaattggaacgatgtgacggaaaagttggaagtttgtgtgtaggaaagttttgatgtgatgaaaaattagaaatttgaagaaaaagtttggaactaaactcggccatagggcatgtttagatcccaccaaaaattttacatcctttcacatcgaacgtttgaatacatgcatgaagtattaaatataggctaaaaaaactaattgcacagatcgcaactaatttgtgatactaatcttttatacctaatttctctatgatttaacaatgtggtgctacaccctatataatgacagaacggactctttaattagttttttatattagtgcccgggcacctcatacgataccctatataatatccgatgtgacacgctaaaactttacacccctgatgaacaccccctaatttttgctgttctagttatactaggccgagtttagttccaaacattttcttcaaactttcaatttttttatcacatcaaaactttcctacacacacaaacttttaacttttccgtcacatcattccaatttcaaccaaacttccaattttaacgtgaactaaacacaccctactcctacatgttttcaaaatataatatcgtagcagcttgccacgagtactcccagaatttttattatattcttcactgttactgtaggtcaggtacacacggaacactgtacatactccgcgtgctgcatgcatatgtgtacggccctatatatcgtcgattaatttattaatacatttaagcaactaataagttattaaattaacgaagtttatataataataagttcagacttcatagggctactcgtaatccgaatatccgatcggtcaacgttagcgtgtcgccgaccgtcggtcgatcgatgacacatccacatgcctgcatggtcccacatacggttaattactaggataaatttaatctatatcattagggcaagtacaaaggtactacgttaattagagactatcacgttacaatagttaagacagtacagtctctaaccattaatgtaccaaaatattttcttactagccatttttcttttattagagcatgtacaaatgtgagtctaatatgagctctctatactaattatgtcactagagactatcctcctacaatagtagagacaatgagatttctaaaccattaatgcactaaatatttttttaattatacttctttccttttctccactctcatgcaacaaattttccattaataaatgctaagagttgactctacgccgttgtcatgcgtagcaaccatctttctctttccttcttcctctctcttccacgtcaccgaatatgcttgcatgacaataaagagagatcgctaataaatacattgtacataccctcacattttctatttcaaaagttcatcattactatttacgatataggtctaatgcttctgaaattttataaaattaaaactattccatcgtcatcgtattcttttctttcctccttccttccttatgttcccttctttttcttttttttctcttcattaattgtcaagcttagatagaaatgcaagcgaacagatccgcgaatttacttgtggtataaataaatggataacccggtgggtacgccgatctagctacccgcttctcacgctcgtgctcagcaaggatggggcgtgtgctcgagaacagcgacaacgaggtcgatggggactcaacgactatggtggtgtttttctcctgaagatgaagataaagataaatattaagtgttttacgcaaaacgatgtgatattaacgtatgattgattgagttttaattattacaaacttgaaaaatagattaatttgatattttagagcaattttcatatagaaagttttcgcacgaaatgtaccatttagcagtttaaaaattgtgccacaagtattcaaaattttatccaagttttgttggagatgaggtgcttgtgcgccacggccgcgcggatgaggaagacgacgaggaggctatggtgctccacacgtacgcatggcctcgaggacgatgactctgagagaacgctaagctgtgttctgttgtgaaaaatgatcactttgtacatatgtcccgattttttgagtaaatcgatcttgatgcatgacgtgaacgatgttgaagctagtacgttttctcgaggttgaacatactttactctttaatatttgtccttttatatatttagtgtattatatacttgaattacgcatatattaatgacttgaaaactatatttagatcatttataagtagcacgagcgttggtggtatctatctcgtaccaaagcaatattaattgacgatgggtttgcatgcctagaacacatggatatttatagtttgataacgtttattttaaggtgaatatggtttgtggtcatttgttatattactgttaggtactatggtcgttgtcacgtgttaagcatgcatgtgccaaataggcatcaattatttattttgtgttacatataaatgaccgggacatatcttggaatcctacgtatatacaagcttatggtacacactccattcacaccagctaacaaatgtcactaatttttttttaaaaaaaagtaaatataatagttgtgcatatataaagtatcaacttcaaatttattatattttagctataaaacaacaaaaaacctacagttttaagagtatatatgtgtaaggattttgtatttttaaaatataaaatataatgaattttaagatgatatgcatgtaggtataatactattagaagtaacgcatagttgtttgttttgaatttttagtgaaatttgttagttggtgtatacggagtgtgtactgtgaacttgtgcatataggatatgttgtctactcacctgatgtgtagagagaaaagcaaagctaaggtatataaatccctctgtccccaaactagtttatctttaacctctactatttatcctaaaataagtacattcctttatctatacgtgtgtgcagtccgcaaatcaattttactcgttcaataccccttagctacccatcaatactataattttctattaatcgaggatactttggtctttttactccacattaatttgtgttccaatggctaaagatgaatttatttgaggacagagatggtattaataatggtccaatttgtactcaattatgtacaaacatgtatatatacgtacaaaaaaagtccatttaattatcccctaaactatttcatttgaattaaccgctacaatattttttttcctaattttaccctaaactactaaaaatagttcactttagtactgaatattatttatcaccttttgtttctctttgtatcagtcctattttaagctaaaatttttaagacataaatgacaccctatcaaagttcccaaatatttctattgctatttactttaaatttaaaaccttgatatttagatcagcctatgtactttcaacatatgcaaacgacaataatagaaattctcaaaaatgttaagaggtatatgttataatgcatctactaacccatcaaatttcggagcataatatgacatatatatagacacagacaaaatattgttagggagtaagattgatcgtttttatatgaagtaagatggagtgctttttatagttgagggtgtgaaatgaaccaaaaaaatatttacgggttaaaagctcagcgaaatagttaggagtaaaatgaatttattttctagaattcctactttggcgcaaatgtgctagcaaccgaactggcgaacactttatccacttatccgttcactcgatcggttacccctccatctgattcccttggtttcgccccccaaccttgatgtttcgttccaccatagatgagatgccgctcctagctcccctcgacactaccaagcgaggttcatttcttcctcctcccccagcaccttgcacaccctgccccccttttcttcctcttgagcgattctaagttccccttcctgctcatccttggcgagacattgatggcgtcgaacggacctcggcacctcgctaccaacttccacacgacgcaacatgtgagccgccgctctcatagaccttatgtctcttcttctttggggagactcgattctcctttctcctcccagcgagatatcagtgttgtggggaaagctacgggaatgggatataagtgagctcccctcggttgaaaatttgagttttctaaatttggaagtttgttatgtaagttaaaacttttgaggttatgatttgaaacttttcaaaaattcggatataaagtttcagtatatagttgaaaatttctaaagtatgaattgaaagttttcgacgtcgagttgaaaatgttatgaattgtagattttatcgattgggttgaaaattttataccacaaatagaagaacttttgagaggttccgattgaaatttgagatttaggaggaaattgattaggagatgtattcttaatccaagttcaaatagggggagaaaggctgtgtttagatccaaactttcaacttttttcatcacatcaacctgtcatacacacgtaacttttcagtctcatcgtaccaattttaacccaaacttccaactttgaaagaaactaaacacagctaaagctaactagactgtattatgatagaatcagatagaagcgcaaacacgtttgtctagttcgccacgcacccctttggccctttcttttctgctatagtactacaactgaagaaacaaaagtatgaagctcagccgcagccgcgtcagcgtcatccgctgctactagtcaattgctatccgtcgaggtagagcggtggccgggtcgatctagtccgtccatccgtaagatccgacggttgcgaggaggcgaagaggtgtccgggcggcgaggtggaggccagcagcaggctaatccgcggctggggcgcgtgggtcccacctggcagcctccagccccccttgccatccgcacgaaggcgcagccaaactgtcgcaatcgcaaaatcgcaatcaatcgatcacgggatttctcggtgggccggtggggcccgcagcgggtcgagcctctgacaacgcggcttctcggtttgtcgcctgcctctctgactgacagactgacaggcgacagctgcttgacccaccccacgaccaccaccgccgccgcgagcccgcgactttcttcccttccccttgaagcaacaacaaccaggtgatcaaaccgtttcggtctgggtcgacgcccattgcacaatcaatttgtgttcacacttgcctgcctgacgcgtcccccatcgttactactcccattttgagtttttcttgtacgggttgaccactcgtttaattaaaaaagttagaattattattttttatttattttattattcaaagtatttaagcacaacttctcgttttttatatttacacaaattttttcaataagatgtatgttcaaacaatacaaataaaaactcaaaatctcttatattatgggacatagagagagtacagtccttttgatgatctggcggtgcacgttgctttttttttccttcttctcatggttgcttttatatgtatttttttataggataaaaagaatgaggtctgctagctaacatattgttctttctaaaataaacttttaacattccaaggataatatacctgactaggatcctacggtaatgactctgataatcgccgtgacaccaccagaatcctacgtgacatgacacacgggcattgactattttctttttttttctttttccccacctttctcttctcttctgccctctgcatcatgtgagcaaaaaaattggaaacaagagaagggaaataagaaacatcacactccctacgttgtttttctatggaatgaaaggattgtggcataacataatggtctattttggagaaaatgcaaattatggtgttattgaaagagctttagtactatgttccttgactaacaagtacggagggagagaattaaaaaggaacatgtacttaagctgtgttcggaactctgtgttcccaactcccccttcttgtttttcgtatgtttcaaactgctaaacggtgtatttttttacaaaaaatttctatacgaaagttgtttaaaaaaatcatattgatctttttttaaaaaatagtaaatatttaattaatcacgtgctaatgtatcgctctgttttccgtgcggaggagatttgttcccaacctaccgtaacgaacacaacgtagttgtcctaaaataaaacatgtagtagttgtggacttatataatataatattggctactattccctttgttttatattataatccaatttaactttttttttcaaagtcaatcttttaaagtttgatcaaatttataaataaaatataataatatccctaacacaaaacaaacatgtttatcaaactataaccaatgtcacatttaataaaactaatctcctattatagatgttactaatatttctctattaacttaaaccaaatttagaggagtttttttttgcggttatatagttctaatggaacatatattatttgttgaatattactactagtagtacatgattaacaatgtaaccagcgtggcatggcttgggccgcaagaagagttgactgcccagttgaccgacacatgccacagttgtactcccaccttgtgttgtgtgctcaggtaaaaataaataaaacggcgtggcttcctgtgcaaggagaggaggaggaggagcacagggcacatgcggatgcggcgatgtggcagccaagagggaggatagctgggtcccacggtagtaacggccggcttcaccagcagccagcagccagcagccgcccagaggcatatgcgtgcgtggcaccgcgcggcactccacgcggtttctctccagctctccttcacactccacacgccgcgcatgacaacccgcgccacgcgcacacgcacacccacccccccccccccccccccgccccccccgcgccggccacgcttttctctacctgtgccgcgcccacggttctagtaccactagaagtactagtacggagtggtattgagtttctcaaaattggtcttggaaaagtattagtttctcaaattaggcctttgaaaagtacaagttttttaaaatgcaggcacatttttttgccttaaattccctctactaatattttctatcagaaaatttcccccgacttttttgaaactaaaatatactactctaaaattacttactagtagcgaagacaccacacaaatgggacacattgggtttgaggtaaaaggcttagtcttaaaaatccactgaaatcttatcgaaatataatgaaaattcaagtatctagttttgaacgtgttaccataatctggcggcgggggctgactcaggtatcatcttaatgtaattaattgagtctaaataaagcttccattatcttaaaaaactataatctagcgacaactctgggtacattccgctgggtacacccacccatttttgcctcgaatgccttcccctcgactataaatcccaccgccctccctccccctttcccaaccacacccacccacccgcccaatccatccaccaagcaaccacaccatcaccatggcgaaccgctgcgtcagcctcgacgccacctgggcccacctccccgcgccgcctccgccgccgccgcaccacacctggctctcccccgccgccgacgacgcgatcaccgccgcgctctgggcctccatggcgccgtcctccgcgtcctcgtactgtggctccgccgcctcgccgacgccgtcgacctccaccaccaccacctcctcctccgccgcgtcggcagagatcctcgcgggcggcggagcgcgggcggcggcagcggcgacgcggccgagcgggcgcgtgttgaagcggaaggcgcgcccgtcgcggcgcgcgcacaccacatacatcaccgcagacccagccgacttccgccgcatggtgcaggagatcaccggcttccccgtccccggcgcccacaccgcctacccctccgcctccgcgtcgtcggccccggcggccccgcacgccgccgcagcgctcgcgtgcgtgctcccgactctggacacgtccgcgttcctgctcgaccgcgcttcacctccgccgccgccgccgcagccacagccggggcggaagaacgacaagacgcccaccaccacaatggcctccacgccgccgcagccgccggcggcggcggacgaggcggcggcgtcgtcgctgctgctgcaagagctggaggagttgatcggcgcgtcggccttcccgacattggagagctgggggatgatctgattctgacctcgatttctcctctctttttttttctcccataaaatttcagggttttttttggtccgtccgatgcgaggatcggacggctgcgggttgtcctccccttagccaagctgatgatgatgtcgtagccaagtagcgtagcactagaaaccaaatcagcctctctctctcgctctctttttctcatggtgtaattattactcctttctgtttgttgctcatcattgccttcatttagttaacgagtttaatgatatgcttaattagttctaaaccactgtgtcttgattcatccgctaatttgagctgccgtaataaccccaccgtggtgatgatggcaccacgtaatgatgtagtgtgaacgcctttaatgtggtatggctttcgttcacgtcgctagtggctcgactcgtgcgtggccacaaataaaagcgcaggcagggggtgacgtggacagtgttatcctcctacgtgatgaaatcaaattagctggaaagggttaatgtgaaaagcctgcaaagggtaatgtgaaacccggctttggccgtgcttgtctttattgtaccgtggtacggacagctttgaccccaccactggacctgcgacccgacgaccttgatcagccatgatctcgtgggaatatttgctccatctttttcaccttacttattgttcagaattatttgatccacgcttactattctttaacgaacttttatccacttcattttattccaactaaatgtatttcttaaagtatttaatttaccatataatcaatccgtgacaatgaatagtgtgctactatcccaaatataagaaattatggttgaatgtgatacataatggactgaatagacatatgatagtattacaaatctagacacaccatagtactaatgttggatagattcgtagtactaatgtattataatgtgcctcattcgatgctaggttatatatggagagaatattagcaaataatcattttgagatactgctattaaaggttgtttgtgatagtgataggccgagtttagttccaaactttttcttcaaatttccaacttttccattacatcaaaactttcctacacataaattttcaacttttccatcacatcgttccaatttcaaccaaactttcaattttagcgtgaactaaacacacccatagttaaggggttgttatgccatttcaaaccatatcattttttggtaaaattaacaaaaatgtgtatatatttagttttttgctaaactttggtaagtatataagaaattctgtcaaaattttagcaatattgtcaatttaccaaaattttggaattaccaaaatttgataaggtttattttggctataatctaaatacatgtatacgaacacacatttgaaatattaaacgtagtctaataacaaaacaaattacagattccaccagacgaatttatcaagccaaattaatccatcattagcaaatatttaatgtagcaccacactatcaaatcatggcgcaattagacttaaaagatttgtttggcaatttcctagcgaactgtgtaattgatttttttttgtctacatttaatactccatgcatatgtccaaacattcgatgtgacaacgtgaaaaattttgtttgggaactaaacaggcactaagacaagataaaagtaaaagacttgaaaacttatgaagtccgcaacatatttcagtcacccatggtttgagcctctttgacgtacacactgcaagtcgccaagtcctgtaaccggcactcttttgcatttgaagaacataagcatatacggggctacaacttaaatgagtactccaacatgagatactcatttttctctagcagagaatactgatcaatgagattacaaggatcaatcatgacttcgcgagaaataaattattcagaacacacgcattacaacatatcaccacctgaacaacagtatatgcacattggttttctacatatatgtatatatatacggaaagtcgatataacttctacctatttcccttctgtattttgaccttctcaattgattccatcgcatcctcaaatgatttctgcacattatttatcaaacagctcattacattacatcagtaaaaaacaattaagcaaacatttggcaggaagaatatggttcaaatggcttggactgatttctcacacgtcgtgtgtaatctcctcctgccatgcttctaatcaatcaagtgttcaacaacatatcaagcagacagctcaccccaacccaacagtactcaaacatccctaggatgctaacggtactcaaacatccctgggatgcttaatagaaacaggttatctatgacaggatatagcatcccatgtttgcaccgaacatttcagacattctagaatgagtaaagtgcataggcggtccttaaacttgtagggttgtgtcatctaggtccccaaagtctcaaaatgcagattcaggtcctagaacttgttaaagtgtatcatttaggtcccaaatcgacatagcccctctaggatcctacgtggcgctgatgtgacacgccacatggacgtggcgtatcattctctctcttttttttcttcttttctttttctttttcctttttgttttcttctaattcttcttttttcctttcctttcttctgctcgggttacagagaaaggagaagaaaggaaaaaaaaggagaagaaaaagagaagaaaagaaggaaaaaggaaaaggaaaaaaattttaaatgggttccatttgtctcgtcatgtccgtgtggcatgccacattagcgccacgtaggatcccaaaaggggttgtggcgatttgggacttagatgacacactatgataagttctgggacttggatatgcattttgatagtttaaggacctagatgacacaccattacaagtttaagaactgtctgtgcactttactcttctagaattccagtcattggtgcaactagactaaatgcacattgtagtaatttaaaaaagtaaggcatggacatattaaaaatgcaatgccatggtttcgtatgaaaaatggcatatatactagagcataggatgtgagaataacctgaatctactatacaagggtcaccctttactttctactaacacacaatacaagaaagtacacacactctctgactctcatagtaggcgctatatgagaaaaacaatacagtttgtaatccatgtgaaatcaaacattatatatgcagattagatacttttcaacatacaaaacaaaaacaatgacaataaagaaacatatactatcttctctccagcattgttaagttaaatacatggatggtttaatttcctgaaagaaaacttttgctctttctataaaacaaatgaaaatcacatgctgacaccctaaactcttccatagtgttcgatggtacacaattacaatgaaaggttttagaaatcaaatctaaatgccatagattttaattaagtgtcctaatcattcagtccttggctccttgcaagttgcaaggttcaatagtaaacaaccaataggggaaaaagcaaagctgtttctgctgtttgaaattttatatatgaacaagtcatcgaagtgatgccgcttttacttggtaaacacatttatctccatttttttctagacctttcagagtacactagtgaaagtttccaattaactccctccttacttgcttttattcagctcaaatttcataattaccgatgaaatgaacaaactaattgcatgcctaaaaatctgctatcagcctatcacatccttatggacaacaatgtgcaaagtagccactcaattcaatagccagtgggtgtttgatcaatacatcactaagttcaaaagtgtagagggtcaattgaatgagctgcgaaataattcacatagatgcaaggaaaaaaagaagtattgaagaaacgttatgcagggtgctccaaataaaatgataagctaacaaggtgtatacttaccccagaattattcatcttccagatttctaaaatacttccatcaagaaaagctgctccagtcagcagtacactgcagtacagagttgtcaacatgagctaacatctcaaactctaaaatgctgttacatttcaaatactaaaatacttccagcagtagaatacacagaactgctgcaaaaaagtagtgtgtggaatgacatgagtctccaacatcagggtgcgttatttgacagattttgacccaatacatggcattttgttcttcccgtcaccttgctcaaaatctatgtatagtaccagatctggctggtaccaacaatagctactctaatttattttggtagttgctatcttgctggtttaactgtctcagcagtcgttaaaatacaaactgaattgatgagcttcctttttacgaagaaccattggaacatcaatggtcataaagatttgatcctttttcttatggaacagcaacgataatacttttttatggaaccgttgaatccacaccaagtgaattcatgtttgacacaacagaaatggtcataaagactaaatcctcttctttcgtaggtcataaatgggcatgcaatttcaacggtattcattttatctgtactcggcaacatttgcaggtttggttctattttgatctcggtcagacatacatgaacatcctatgctgtcctattatttatgaacttggcaattgctttttccacaatgattccctcgagaaaagccagcaatgtaacggatcagcacaacaatcacgcaatggcggcatatcaaatcagccaaagcaagaaaagcatcagcgcatatgagcagcttcacctggcgaaacccagattgatgaggaaccctcgccgcgtgaccgacttcagcagcaagtcccaatcgaatccggccgaggcggcgccccctccgcccggaggcggccggcgccaggtaccacctccgcgtctgtggccgtagccgtagccgtagtcatacgaggccgacgaggaggaggccgaggccgaggcggaggcggaggcggaggaggaggcgcggctgtagaaggaggacgagcggatgcggaggtcgtactcggcgcggagtcggtcgtcggagaggaccctgtaggcgtcggaggcgaggcggaagcggcgcgcggcgtcggcgcgcgcggccgcgtcgggggagtgggcgtggcggtccgggtggtcgcggagcgcgcggcggcggaaggcggccttcacctcggccttggtggcgtcctgccgcagccccagcgtctggtagtggtcgccgcccatcgccaccggcggcgacgaccgcggcagcttggagaggatctcgccggccggtggatcacgaaatttctcggcgagggagaaggggaaggaggaggcgatggagcgcgacgacggttgcgtggcgtggcgtggcctttcttcccgccgcgcgtttcctcgggccctctaagcccggcccagttaggcagtcagtttagaaaatggaataagtgcactttcactccctcaaaaaataagtcaaatctgatctcgcacatgtcgaggagatatttaactatttgccacttttagacaactatttgccactggacccacatgtcatagacacatgtagacccacgtgtcattgatatagtggtggcaaatagttaaatactaaatctaaaagtggcaaatagttaaacggtgcaaaataactaagttcaacatgacattgagatatgttgaactcttaactatttaaacggtgcaaaataactatctcggtggtttttggggtggtttttcactgacatggcccattgacctagtctagccgctaagttcgcttcgccccggcaggagcttgcccccaactgctgccactaccctcgtcctcccatcgctaccgtcgtcgttgtggagaagggaaccagaaggggagaggaagataagggggagaagataaaggggggaggaggaagaaaggaaagagagaggatgacatgtggcccccataatgatgacttagcggttggactaggtcaatgggccatattagcgaaaaccacactaaaaaccatcgagggagtcatatgttacaccagttttaatagttaagggttcaaaatatctgacattgcaattgagggatacaaattagatttgatgtatatttgagggagtcaaagtggacttattccctacaaaattgtactccctacaagatgctcctaccccacgcgcgggggccttgtacggggagcttaaggtcctaagaacttgtttgttggtacttgatagccaacttctgagaatataaagaagctgattttctaacttctaagtttaatttatttgctaaaatatataacttctgagtatccgagtgataatttgaactattcgagggaagcttttagcaattgcagcttttaacaaaatctccaactccaccaaacatgtcctaagtcgcgtgtgcggtggactagaaaggtattggtggggtccactggtcgttccacttcaccaaaaagaaatcttcccacgcgcatgccccttcccttttttctttcaggaaaaagttccttctgcgtgtgtttcttctctcttatcttgttttggagttgacttgaacaaactttcaacttagatttaaaaattttcaagtcaagatttttgaaaactttcaactcagttttgaaaaatttcaagtcaagatttgaaaactttcaactcagattcaaaaaatgtttaactcagatttgaaaactttcaagtccagatttgaaatttaaacttagagtgaaaactttcaacttagatttgaaatttaaacttagagtgaaaactttcaacaaggatttaacaactttgaactgaagatttgaaactttcaaatcaaatttgaaaactttcatctcagaattcaaaacatttaactgaatgcatggttttttctcaacatactctctatgtccacaaacataatcattatgaccatttaaaatggcaaattttgttataggacatcaaaaatctgttgctgatagatattgtgaaaatgttccatggctaaaaggcactctaaaaaactagtcattttctagaggttatattttgggcttgattagagagataaattctgaagaaagacgagaatgcccctaggaccacatgcttcaaacatggcgttagagtgaaaaatctagaaattatgcaactctaaatttgccatcaccccaagtgcatcactagcatacatcatatttcatcttcactttagcctaagctaaaaatcttttaacactatgtgcttttcatctttttgaaaaatttctttctccaattgagacaaaagtgtccttcagcaaattacctatttttaggttaatttttcggtcatgacacttttttttatgtctacaagtaaattatataaatttttagtgtcctgtaataaattttgctatttaaaacttatcagtatttttacatgtcccatcaatggtacctatttaaaatttctttttgtcttaccccaccttgtaaattgggtgggatgggccaacatgttacctactccctctgtcccaaaatataagagattttagttagatgagtcatatcctctatccagattcatagtaatattatatgtcgagtaaattgtacccacggtacaatatcttggcaagtgggtacgatagagtgtaaaaacttgagaattaaatgtccgagtgtaataacttgacaaatgggtgcgttctagtacaagaacttaacaatttagtattttggtgtatcaacttggctaagcatatgctaggtgagttttttcatgatttcaatatgccattacataataatcatacggatattatcttataatattgaattcaatctttaagaattatactggcacatagtagtacaatttacatccaattacctttaagaatttttttgttttcttcaccttctcaaatatcaaccaaaatataataatttctacatccagtttaattgactttcagttattatttattaggataaaaatataatacacttatacaaatccgcgctagtatattgtcaaaataagtacttaaaacttgattttatattaaaaaatgctccaaataattgagttgttgcaaatttattgtatcaaaatcgtacctagcttgcaagttgttgcattcatacgatcacttataaagttcttatactaaattacacctacatatcaagttgttgcactagaacgctcatttctcaagttattgcatcaaattgtatccacctgccaagttgatgcaccttgaatgcaatttacttttcgtagtaatattatatgtcttatcctatcaaaatctcttatattttagaatgaagggagtacaaaactatactcactgttttatttggggtggcctatcaaagttactgtggataagatttttgatcgagtcgtctataaatatagatatgactatctgaatagtttcagactccgcatagtttacttaactgtacataaacgaaaaggccaaacgaaaaggctgattgtttgttcagtcttgaacttttcggtttataagctggtttacaatcctaaacaaagatagattaaatttaaactaacatataggaggctcgttgtaacctgagctaccaccaagtatatgcacgcagattatctggaaatgtctcaccatttggtgggaattgtttccttttgcatatttgcatgcctcacaaaacatcaagtcaatatacaaagaagcgtgaatcaagcagaaatagctgaataaatgaataatggatatggaaacttcacgacaatgttaacaaatactgtgagaaaactgagaatcatgtgtaaaaaggaaacaaatttgcacgtatgatattcttttcgcgattttctttttatgacaagtgctcgaacacacgaggattcgagaacgagatcgacgcttccaacagccaaatccggccatcaaattgctttctatatatacaacattaagagattcgcgaaaatatttttaaataagctagcaacaaaaccagccgccagagcctcacttgccatgcatggatgataaataccgattaaaaatcacgaggccaatcgaaaaaaaagggcaaaggtcaagaaagaaattaatggcaagtcatcaatccaagattagcccgacttctatataaatcaccaacccctaagcaatcgtcgtactcatcagaactcatgtgttcctaggctagaagaaacctatatcacaccccccccccttttttttttgttgcgtttgataagtagaagattgacgatataatattggtgtgatgtgaaggggatcagaagatgatgaagaagaagagctccctttcgatccaattcaggagaggaagtggtaggatgcagctgccggttcatggatacctctggagtgcagggcaaatagtcctaccctttcatgggtttgcatgactcgggagatgaacccgccattgtcttcctctattgattggattgaagggagctcctctagctacatctctgtcatctctctctctctctctctttgatattactatatcatcatgcatggtatgtgtattaacgttgtttgcagctagcttcttgttcttgattaatttggggttttttttatcaccacaggagtgagtatacaatgacaggaaagcagaagaagaggtataaatgtcacatcttgttttaggttagtttttatgagatagaaggagtatatattagttgtcggagggccggaggcagattgtccaagagccatgattatcaattacgagaaaataaactagcatgtacacggtacttttgtttctttttctaatttactcattctggtcaaggaacaatataatgtatatataaggacatgttgcgttctggttttctgcagtaatgaacgatcatttgtttttcttctcctttttaagctttgatatcaatctaaatatctaacgtttgaatatacatttgttcttgaaaaaaagtttccctgttatatagccctgtttatgtctttatttttgtcctttggattgtatatatattaattctcactctatatttaggcgttgttcagattgatgccaaaaatgatatggttgaaaatatcatgaatctgaactgcctcgaggttattaaatatttaggcgttcgtgccttagtacctcgtaaaccctattcttaatttatttatcacttttttatttttagtgcgcatgaaaatagatggcatggtactttatttagatcaacatgatttttaaaatattgatacaacacttagtttaattatcataaattgattctaaaattgtatatacattcaaaaggcctattgatggatttaaaaacagtagcttgtagagacctaaagatttgcaatcatctcaaggaaatccgttgtatttttatagcattcgctgtattttttaaaagaacagaaatcttatttttatttttctgtcaactgtttatttatgtgggagcgtaaaatcgtaattgatcgttaccagccacgaagcaccaaggccataactaggtgaatatcacgtttaacgctgaggttaccttgtaaatttaatttactaaaggaccaaaatacaaaattgcagtgacatccttatcgtctactccctgctaggtttttcaactcgacatcatatcacccgctatttacatgtaactcgaatagctaaaaaaaattggaaaaagaatagtaacatcaattaggatgatatgaatccataaacaaaaatacaagactaaatttaatttagaaccagagaaaaaataataaaatcaaggagtgaatagtacctacacaacgtagataaaattcgttatttttctttcttcatgtgtagattgaatttagatttaatgtttatatagtgtcttatattatcaaatatcttattaaattttataaatattttaaataactatttaaaccacataaatatatatgaacaccgtagcatataggtgtagaaaatacttttcccctgcccatctcctctctcgtcttctcacggagggccggcggggcatccggagatctcttccccaatctctcttgcccactcatcactctctcccagctcatcaatatgtttgagagaggataggcggtagccatgctttttttttttcctttctttttttttatcttttctttttcacactttaatcttcattattttcttcactttaaatcaattgaacaagttccaactttaacgtttcttcttatatattcaccaactacagttctacatccttcatccttcatttatcaaattcaacaatgaaaatcatctcagtttgatccaacgtcccaggctgtctacactggttcctcccaaaatcgcagagtgcagttctacatccttcatttatcaaattcaacgatggaaatcatctcagtttgatccaacgtcccagactgtctacgccggttcctctcccaaaatcgcagtgtgtcattcatgatcagcgaccacgaaaatctcgcctcggctttcacgataatatagaatgataagataggtcacgtgataagaaagtttaggaatttatggttttagtgaaggtcgaaaattgaaaggttaggacggtaaccctttttttttcttccattacgcacgtaggatttccggttcggcagaacttttcagctacgaaaagttgcaacataattcaacatataactcaatctgtatattaaacagatatcccaggatgcgtccaaccaaaccactcaatcaaaattcactagtatactagcaaaggtgcccgtgcgttgcaacgggaagtgtacaggaaaaaaaattgagaaaaagttaagaaaaatttatattatgtaattaattaaaataagcaaaggtgcccgtgcgttacaacaggaagtgtacagaaaaaaaattgagaaaaagttaagaaaactttacattatgtaacatgtgccagataacaattataaaaacagatagtaaatatctatttctttctttaattttcattttcttacgtttcaattactcaccccttttatatcttcttaatattaagagaattgatgcatggtgtacacgtatatataagagatacatgagctgtgtgtatcaactccaggtgtatagagaactatttaagatgtattagagcaaggataagagttcactttctattatcaacctatttagagacaagctagcatgagaatccaccagaattaatcggtttagttctttgcttcaacagactgcttcagctttggctttgctcaattcctacatcaataatttgcctgctgtctttgctccctggagaataaatttaagaaacacagtacgtttttagttagaatatgtagatatcatattcgcaaagaacaaaagatatatctacatatgcatatccatggcaacgttggtccctattttgaattttagtttactcttatttggaagactatattttgcagacttatatgaaaaaaaaactagttcaaatttctaattgatttgataattttttgcatctctatgtataacaaaattaaaatttgagattttacagcatcactattaattttgttaaggtccacgagaactctaatattgtgcacttagctacactcatccttacccgttaattttgaatttccacagtcaattttaccctagctaaatcgtataataatattattaaaatagcattcacccgttacagtttacgggcatttttctagtacttataaaaattgaggatgtttttgccggtattttgatacgtcatccgtgtttgagtcagtttttaagatcgttcacttttggaaatacagatccatgttttggttggattttaagcttgtttgcttttggaaatacaaaaggagtcctataagaaatctattttaaaaaaaacttcgcatgctaacttaagatgaaagtcagactcccaattgcggctcatgatttcttaaaaaaaattcaaacggatttccacagtaaattttatcctagctaaaccgtataatgataataagattaaaatagtattcatccgttgcaactcacgggtatttttctagtacttataaaagttgaggatgtttttgccggcattttgatacgtcgtccgtgtttgagtcggtttttaagttcgctcatttttagaaatacagatatgtttttgagttggattttaagctcatttgcttttggaaataaaaaagataagaaatctctttaaaaaactcacatgctaacttgagatgaaatatggactactaattgtagcttatgattttctaaaaaataaatatccaagcgaattcccacagtgaattttaccctagctaaaccgtataacaacaatagaattaaaataatatttacccgttgcaacgcacggatatttttttctagttaatacttatatacaagttatattatagttatagtatagttatagtgaaattatattataattatactatagttatagttatagttgaaagtttttcccttaaaaaacttgctgcggttttttaatagtctctaatttttttcaaaaaattacattgtgaattaagagaatttaagcatgattatatgaaggtaagcctatggctcaaacccaagttaccctaggcttgcctcctagagtctgagttttagcccatcctgtcttattggtgacggcgtctagttctccctctatggtaaagagagactttgatttgcagtttatttaatttttcgatgatatcttctgcttcggttgaagagcaatcgttagtggtgatatgtaggtgatcattcggttgaagaatcgagcatagatttcaatgagtctttgttgcttagagtttgaattcagaacttaggtggtgacgatgtgtatccgctttattgacattaggatcttgctacaaaggtttaagaggataagaactacatacatattatgcggattttcgccttccgcggagagaggtttagcattagaggtcgttatcattgtctttaggttggtgttgtagttagttttcttgttttgtatcaacatgcattttgtatttctgcaatcgttttggctgtagactttataataattggttataacttcttagaagcaaaggtcaaaatgaatttcccaaaaaaaaaaaacgccaggtggagggcgagagaatggtatacatggtgtacatgagatatacatgaactgtgtgtatcaaccaaattcacattaggtgtatataaaatactgattcagaggcattagccatgaacatttcacaaattaagagacaagctagcatgatgaatccatcatattaattggtttctttccttaacagactcagcttcttaatcgacgtagtctatcaaggccttgatcaatccatcaatttccctgtgccatcgttgctccctggagaacaaatttaacaacaaccgaatgctttagttacaatgtgtagatatcatattcgcaaatataaaaaaaaagatatctaggtatgcaaacgcttctcaatggtggtccctattttgaattttttttttaatttattctcgctcttttttaaaaacaacttttgattggaagactacattttgcagattttttgtgaataaaaaaatagttcagttttctcttaaaattggtaaattctcggatctataatgcataattttgtgaaaaaaaatcatatttcagttttctcttgaatttggtattttctcacacttataaaaaaattatgagattttacagcatcagtattaattttctgaaggtcgactagaacacaagaatgcacactgatcagctggcatactataaagaacacactcatccttacctcatttgctgctttgttttttcctcttgacaaagccacaagcagggcgctgcaatacaaaaatatattcttagaacaatttataaaaatgcatttgcttatacataatttgctccctcctgatttattactcccacttcgatctcccacagtcaaattaaatatatgtcagaaaaaagtaactaattctccctctatttcatattataaaatattttaagcttttttaatcaaattttattaagtttgacaaagattataaaaaaaataaagcaacatttagaaaactaatttgatatcgtaaatatttgctaagtttctaaaacaaaattttgacttcaaaaaagttaaaacatattacaatataaaaacggagatatcgaaattaactacgagctgatcagcttaagtataattacctgccggttacgagcgaaaagaacaagattacgggcagcttcatcgacggcggctgaggccgagagaagcagcggccgtagctgctacccgaggcggcggcgccgccgctcccgcggctcgtgggcggcgaggtggcggtgcgagggaggtggtcgtaggcggcgcgggtggcgtcgctgtggaggacggtgtaggcgtcgtacacccggcggaagcggccgccggcggcggcgcgggcggcggcgtcggaggccgcgtggcggtcggggtggtgcagcggcgcgaggcggtagaacgcggccttcacctcggccttgctggcgccgcgctcgatccccagcgtccggtagtagtcgccgtcgccgccgggcgccattgatcgatgtcgacgacgaagacgaagctgcaagaggtgtcgggctagctagcttctcttcgcgcgcgatgcagtaatttaggatccaaaaaactgtatacgaagcgattcaatttagatcacaattaatagggcgcttgtagccttttgatttcgcctgcgagtccgaatagaaactgagtctgagttcgagtaatacatttcgatagaattcgatcggatttgtgtttataggtcagtcaaatccgactctcttttgccggaagaagcccctatttttacacgcgcgtaattcaaacgttcgatcaacttcttgatcgactctaattaggaggtgtttcgctctatcaactccttcaccagttattaatctattcatttcccagccgtttttttcacattttgatcagcttctttaacaactgattttttacaatttgtccctttctaaaagcttatttacaaatacacctaaaaacttatttgtgcctacgtctaaaccccacgttggcgtacggcctggatttctctgtcgcgtgtgagattcacgagagttcatatagtggaatccaatttctggatttgaatttttttttacttaggtcaaatctattaccgagtttgaattttaattaattaaactcttactgtttgctgacaattaattgaacatgctctcggccttgatcagtattcgttacggtagatacagatctgatcaaacttcaaaagtcgcaaacaaagttgaaaaggaaacaaacactttggaagtaataatctcaaaccattacccccaactattacagtaaatcactcgcaataatcaaatctgatttccagttctgcattaccaccaaatactccaaattcaacggatgcagttcaagtatgtttcccatttgcaagtagtattctgattttgggggtgcataacagcataagcaaacgatagaatacctctatgtacaggcaactacaacacaagtcagcacaacctttgcattgccagaaaaccggctagctgacttcagatggattaataatcagatctgtatacagcaaacccgttacagtggttagggaacaacacaattttctctcgcaagtgtaggaaagtttcatccgcaatcttatactatactctaaagacccacgagtttccggtgcacgtgttcatggagagagtgttcgtcgccgtcatggtgatggaatacgtatgtcaaaaccccaacgaggcacaggaccgagccgacaaggatcttgtcgtaacgttccacccagtggaacttaatctggctagcaccgtagaatgagagggccaccaaggatgtcatcactgtgatggtactgcaagtggggaaaatacaatcaaacagaagaattggtaaagattttgataaatatctgatctattcacatgccaattaacacaaagcacacaagggaaatcttgaatcacaaaaacactcaattcagctattctagtattcagcaatcttactgatcatacattgcactgcacaaggtatttttataacgttcaatccagctattcttgtgttcaagatgactgaccggaatgcccaatagagtgcacaacatagagatggacctatagttcacaactgaggtgttgctaagacccacccttgaaggttcataacagtggcagggacgcagggtctcaggagattcaaagggttataatgtaagtggttcttaagaatctattaatcttgtcaggcacaccgttgaagactaaatatttatcaaataccaccatttgtttccatacatgtaaagcagtcagtttgtgggaacatttcacatcaactaaagggtaaattgagacataacttatcttaagatattacacctcatataggttacagaatgccatattgagcaaattcattgtgaattaaatattaaaacatttgtagaatccatagttataaacacaacattagctagttggtaaacgaggaaaaagaaacatcccaaaaggaaaggtggcacatggaagtataggagtatttatctttctactttaccacaacatacagtctactaagaaggatatatttcgatgttcattttgtcccaactcaatgtgcttttgtatatctatggtagcctggtaggtgataccttgatgatttgacccaatgaaaaaaagggttttcaatacaaggagattcctataagcctagagtgtgatactcctaagtcctaacaagagcttagaaaaacttctcaacaagacaatcccattattttagtggaaggataaactattattgttccctctttcataatgtgttgcggctataaaaaaaagtatagcaatttattgttcggtagaaaacaagcaatgcaactgaaaacagtggaaaggggtacccacctaaagaggagcacaatgatcgcaaggatcatcatggaggatgaattgccaacagcaagaaacactggaagagttgttgcacagggtgataatgcaggtacaagtacaagacctgcaactgccatcttctccattggatgattatgagcatggccatggccaccttttcccagtgcaaacagcaggatataacttccaccaagaacaatcagcaacagtgatgcaagtttatgcactgtttcctcgcctgctatagtatttgccatagtaacagcagttatcccaagaagagcagtggaaacaacatgaaggacgcctccaaatgcagctgcggaagttaggatattttattagtagtgatatatagaataagaacatggaaaagtaatatgagtattcatcactaatttatgtagaaaatactagggggtagggtacagtatgaaattacaaaatacaagtaactttctaaacgcgtatcatagctgaggctaacagcacaatagtaacacatgaacaaggaatcaaacagaaataaaaggtttattttataagatttagaaattagaacttttttaataaaaaattatacagtaagctttggaggtttgcagacaataaatacaacataggatggaaaaataactacaaagttaggagtctggtcattcaaatgcactttttgttatccaagtgataatgcacagttgaacagaaaaaagaagtgattgtgcgtagtttactgaaatcacaacaatcgtgcaagattaagggataacaggttggtaagctgcaaatattattacaagattaattagaaaagtaagcctgataaaggaacaccaatgccaatgatcaatctacacaaatataaacagcaatagacctcaatcaaaaattttctgtgtgttctgatttaaaaaaatatccccatacttgcgatgaaatacacatatccctgtaattatgacaaaataacatattcacagcataacaaaacagaaagatgcaatattgattcagtttgcattattgttcccaggaattaatcattgatcaacatcccaactaggatattgtgtaactccaagttggatcaatcaaatagttgcaggcttgcagtctataaatcgaactccatgcactcacatacggtacacatcttgcaatcatataataatagcgaagcagcaccgaacttagatgtattcaacccatgtagtcacacaaagtgaaagttgtattgcctgaactaccgttatgtacgaaacaaaaggcgcatggccctgaagttggaaaacatgataactacacattgttgacagaaatacatcccatggaacagagatccccactgaaaagatcacagtagaggactcagaagtttacctatcaaactatgagcagactactcgattgtccaccaattcgtcagtaacagctcaagattttcgggcgaaacttactaatcggtgcatgaaacccacagcatcaagcagttagccacaatccaaatactataacttcagttttgcgatagaacattgggttttttttagaatgcaacaaattcgtcagcacgagcacaccaaactagagtatcgccattgcaagaaatgtggcgcgtgccccctcaccactgaccccgaagatctttggggggggggggggggggcggccccaccgtaaagcggcacagcagaaccgagattggggaaagggaagcgggggggaaatttgggggatactgactgacaaggagggtgcgggagagcggccaccgctgggcgcgggcgacgatggagaaggggagccagtgcgtggggatgaaggagtgcagcagcgacaccgtcgcgatgcccccgatcgtcgacgcctcctccgccgtccactggaggccgcccagtccgaacccgcctcctcctccgccgccgccgccgtccatggcctgatcccgcctcgcgtcgctggcggcggtggggtgtgggagagagatctgggaggagaagcagaagaggagaggagagagaaggcgagcaagtgggagagggcgaagcgggctgcggtggggcccacctcacctcggcttatggcaaattaatcccagttaattacccgtttgctgtggaagtggaactgtggaaacctgtcgatcgtctccatggaaaagaaaatttttgatatttctgactttttatttataggcccgtgctttacaacggatctgtgaaaggactttagaggttcatcctaactctcctctcataaactacatcatattttgctagaaacacggtacaaatacatgcgctcacaatacgcacacataagcactttcagaagactaggctagtaatcttgagattcaaaagaagtcgccacaagcatctattgctggaaagataattagccataaatactagcactcatgtcaaatctaaagaataattagttataaatacgaacacccatgtcaaatctagaacttgaacccggataaactggttcaaccacatagaatctaatcacttgagctacgctcacttcatcaccttaattgtttgtagtatctggatcatttatcgatggcgtgggataccatccggtttaaacatattaggttgattagttttttataatgggcctgttcggctgttatgtttagcagttgtgctgttgcacaaagaaaacaatgtggctgttggctacaacacaatgaaaatgagtgcagccgaacagagccgatataataggttttttaaaatcaatttttataggaaggaagtggcttttaggaggaagtgggggagagaaagaaaaggagcatgactatctcttttaaacagtagaggccagttaaaatttaaattcaaacagaaaaaaatatggtgtttggagttatgttgcttggaaggtaaattttgagtcacggagaactaatttgatgagtagatagatctttgaaaaagttcttcatcattaatactttagtctttgatcctttatttcagttgagctgatcctttttttaaaatgaattaattgattttagaaccatcaaaataagattaaaaataactcttttcaaaggctgtttagatgatatggggaactacactttttatttgcactatagatggcctgataattaatttagagaagcaaaatgttatgtacatcattctttattttatattagacttttaaatagaaattgagatgtcactccatgagcattattacattaaccttttaaaacatttttgaattatgtttttatagtatctctgaagttagtggagagcgtgaattttctggaatgcttctggaaagaagctatccatctagcaaagccgctaattccacaagtgattagtataattaaaaagaattaaggtcaacaaacttgaaaggacacgccacctatttgcctgctcctatgcagttcttttttattttcaccgcttcagaatgtcaattgagaaagaattgacaatgaaagaaaggacaaactaataaacacatcaacttagcttcttccatttaaaagtatgcatgacagtaactcatcaaaatatgttaatgatatcaagttggctcaatgtattttcgtttctattctttgctgtccttttccccattagatcaacaaaatctaagaagaccaattgtttctttggaaaaagaaaataaagataacacttccggtgaatattggttacgtaccaggaaaacagttctaaagttttgcacaatattagtattgggtgaaagctcagatgaactcactatgtataagcaaaaaagaaaagggtgagagattgataactctagtaatatttttcatgccttggatagttatcaggggcggatctacagtagtatgagcggtgtcaggcgacaccgacgactttcagcaaaatctatagcgaaactgtttatccacatgttataacactatgatctaagcataactaacatactatgacaccgatagacacgttatgacactaacgaatcgattttctgaatccaccactgatagttataggtctaggtgaacaatcatgtcattttggtccattcagacagtcacataacaacaatgataagtggacgagtgaaatagatggtggtactcaccgccgaagcattcgtgcgtgcacaggcaaccgcacccttcaagtaactgcacttagtctaaaaagtcaaataaaattaactactaatacattttagcctgtcatgaataaatattagaagttcaataattcatctgtccaatacatactagaacttttcttataaaagcatctcgaatgtataagtaaaattgaaccatatattaaaaaaaaacacaacacgctatgacaaccaactgttgcctataaaaaaaatctaccacaaagaaagagtcaattagttgaacttagcgatgaaaaaaatggtctgccgtagttggctggccgcgcaaggaaggatgtgggcatgtgattagagatttttttttacatggttccacaattaatgtcaaacgttacggtcaacgaaagaaacaaacttttgttcaatcttagggcatgtttagttccaaacaaaattttttcgctgtcacatcgaatgtttggacacatgcatagagtattaaatatttaaatgtagaaaaaaaaccaattacacagttcgccagcaaattgcgagatgaatcttttaagcctaattacaccatgatttgacaatgtggtgctacattaaatatttgctaatgatggattaattatgcttaataatttcatctcgcagtttcctagcggaatctgtaatttgttttgttattagactacgtttaatactttaaatgtgtatccgtatattcgatgtgacatgaagggacgaaattttttgccaactaaacagacccttagtaatcaaataagaagcgcagatgctctaatgtataaaaaatactagttatttacttttcttaatcgtatcacaattagggtttaatgttttggtttgctgatttgtatcaagggtggccaaaatttctgaaattttggtccgaaattttacgattttttgaataaaatttgaataaaatattatcaaattcatgaaaaaatgaaaagaaaatggccgaaactatatcgtatcgccgggggagggggggtccgatagaaccaaaattttggaaatttcaatctgaaattatgacccctgatcacaatcaccctttcacttcctaccatccccatttaaggggagatatctaagccattttgcttccctgctaattcatgttttgaatactgtacaattgcattcttttctcagatggtgggagtatataacaagttgtatcgtgtttgatatacggcttcacaacaaacctctcatatgtgttgttcctgtggaggcagccgaagaggtttacgggtttgtcaagcgaagtgcacatcaatagagtccctcggatgcagtcgtcgcggcattgccgcagtaccctgtcgatttgctccttcattgctgcttagtttcattaggaagtttgcttcccttttttcagttaacctctctcttattatggttcaactcttatgtttatcatgggcgaagtattcgggatttcaattccctaaatgctgtcatttaataaagtgttatgtgttttctttttttaaaaaaaaacccacggtgtatgatgaaaatgtttcctcccttttgaccatgccactgagaattcccctaaaaaagacccgcattattccagacgaggaaaaactgaagattcttgcaacccaaactggatatgccgatttggtagagccagccgtcattagagccgtccaccaactcacgcagcatcaggtagtcaatcaggttcagtttttttcccgtcggaaatctctgaaatccaatcacaaaacggaacagcaaacggctgagcagtagggggacgggaagaatggtcgctttttttttttcgcatagtggacctcctgcaagaacctattatttccgtgcgttggtagagacattgacataatggctatataatcatgttcttcgtgttgaaaattttggaaggcaaatagtttaatgagttgattttgtgattgggactacctatatttattccgtcgtatttttcataaaatatagttaacacgtacatacatcgtaagtccctaagttatatatgtaattttaatgtatttacaatgtaagttaagttgacgtaaatagatgtaaatagaaaatgctagtgcaaatttaatggaaaacttataactagccattagatcttgactataatcagtcataaaatgtgatgataacattttagcaaacactttgtgatttatatttgtttaaaattttattatatgacatgcagatggtagacttcagccggctattatagagagaacaaagagtgatatgtattattgaacttaccttgtaggacgctgatttcttattgttgttataggaatttgaattttttgaaactcgtggatatttccatgtaatttggagatatgttctttttcgcaaatttttcgtcttttacagagtataaaaccaatattttcaggagcaccgatgccctcgtacggagttgctacgaaaatcaatgtgacgtcgctggcatagaaaactcgacactagtaggacttaactgcaaaacgtaaataaaaaaaaacatagctaaggtaagcaaataattccgtttactactacttccctcctaaggcaccgttttccaatacatgaaaatttcatcctgagatatctaaattaattcattcacttacttttctctaaaaaaacatgacctaaattttcgaacggcgattgtaattggtagggcctattcagaatcatgttattttataccataccattatttagtaaaattgataaatatatgatattatttagtttgttactaaatatttatcatacctagagaattgatcatcatatttaaccagtccttaaaaccttgatagcgttagcaacttaccaaatatttttggtaataccaaattctggaaaaattaaaaatgaatataaagtgaacaggtccgttgttcgtaaaagccacacgaattcaaaagacagtagtcttccatcggctgaccaaacttcgcagtaaaccccctgtactctccagaaatcacaatccaacccctaacccctttcctctcctctcctctcctctgcttcgcttcttcttcttcttccccaaaaaattccaaaccgaaacctctcgattcttcctctccaagctgcctcgccgtcgccggcgacctcccgcccaaatccgacgccaccgcgcgccgccatgcctccggtggtggcccactagccctgctcgctccggcttccccgactccatggcttccgggcgcccgctgctcgacgcctcgccgcggccgacgcagcagccgccggcgtcatcgctgctcccgccgccgcagccggagccgcccctccgagccgaccgcctcgcgttctccctcgaggtgcccgaccccttccgccgggagcccgacccgtcgtcggccgcgtcgcagcggggggaggaggaggggggcggcgaggaggagtcccgcgcggttgttgtcggggagccctcgtcttcggaggcggcggcggggttcgccgggaacggcgtacggacggcgaagtactcggtgctgacgttcctgccgcggaacctgttcgagcagttccggcggctgtcgtacgtctacttcctcgccatcaccgtgctcaaccagctcccccaggtcgccgtcttcggccgcggcgcctccgtgctcccgctcgccttcgtcctcttcgtcaccgccgtcaaggacgcctacgaggacctccgccgccaccgctccgaccgccaggagaacaaccgcctcgccagggtcctcctggcgccgcccgccgcgggggagttcgcgcccaagaaatggaagcacatccgcgtcggggacgtcgtccgcgtcgcctccagcgagacgctccctgccgacatggtgctcctcgccaccagcgacccctccggcgtcgcgcacgtccagaccgtcaatcttgacggggagaccaacctcaagacgaggtatgctaagcaggagacgcaactgaggttctcgcaggacggtggaatcggcggtgtccttcattgtgagcggccaaacaggaacatctatggatttcaggcgaatttggagattgatggcaagcgtgtctcgctagggccatcgaacattgtgctccgtggatgtgagctcaagaataccacctgggcgataggggttgttgtgtatgctggaaaggagaccaaggtcatgcttaatagctccggggcgccgtcgaaacggagccggttggagacacagttgaaccgggagactgtcatactgtccattatgctcattgggatgtgcacgaccgcaagtgtgctcgcggggatttggatactgaatcaccgtggggatttggaattcacccagttctttagggagaaggattacacgacagggaagaactacaattactatggcatggggatgcagatattcattacattcctcatggcggtgattgtatatcaggtcatcattccgatctctttgtatatatcaatggagttggtacggcttgggcaggcatatttcatgggtgctgacagagatttgtatgatgagtcatcaaggtcaaagttccaatgcagggccctgaatataaacgaggatctaggacagattaaatatgtattttctgataagacagggacgctgacagagaacaagatggagttccagtgtgcatcaattcggggggttgattactgttctggcaaagattcatgcggatactcagttgtaggtacgatgtctttaatgtatatttctggttttcatgttgaactttcctagtatggctgcttattttctggttttggacagtcgatgatctcctatggacacccaagatggcagtcaagattgatcatcggcttttgaagttactgaggggtggtggcacagatgaggaaacaaagcttgtcctcgaattcttccttgctcttgctgcatgtaataccattgtgccacttgtcctagatactcgtgattctaagcaaaagttgattgattatcagggtgagtcccctgatgagcaggcactagtgtatgctgcggcatcttatggcattgtgcttgttgagcgaacatctggttatgtggtgattgatgtccttggtgacagacagaggtaaggtagtctttcatcatttgctttatggacatgctaattttcaactctgcatgagtgtgttttcaataataattagtggcattatgcaatttagctaataccaattttggtgtatcaacatcattatgtgactaggagtggatgtctgctacagtgctagtgtgctacctgatccatgatgtttacatctctggaaaattatacctacaaaactttattcaactgcaatgtcatatagtcatcaacagttggtagcataacttattcaataacgattttcacaagtgttttatgcactttgctttatggtgtttagtgacgtcattcttttgtcttatcttattggtttgctggtgtgaatgctaactttgagttgtatcttgctagttatcttcctattcctattcttagcatacagttaatatttattcaaaataaaaataataatttggaatattttgggatgcaacgtgccaactccaaatgatttgtggcattaccccacatgagcgaaatttcagtacttagtttatcaggcttacctcttggagatatgttacaactctccaagtgcatgtcttgacttttccttgtgtttatagacatgcttgcatatcctattatagtaagctagtttgtggagccaatactgtaatatattggttgaatatatttgatgaatggagctctttttattggttaatcaccaactgtagagagttaaatgtgtttgctgtaagtccatgtcaaacacctgggctataggcaaaaccaagttaattatcactttgaacccagttattgtgatgagcacatatctgcactagggccataaatttgtaaggagctgcattgaacaggctggcatttataaacaaagcaaatttaggatgtgcatatggatttgcagctgaatttctggataatttggataaaaccatatcatttttcaccaaaccaaatgtttatctaacatttttaataacactattccaaaaggcattcttagttacctcatatgtacgaagtacgctagctttgtttataaatgcccgctttgttactacattgactactctgctccattctttcagttcgttgttctttatgtgtaaattttattttcaatatcttgtttacaagaatggcttatagttccaatttatcttctggtatgggatgtgcagatttgatatattaggacttcatgagtttgatagtgatcgtaagaggatgtctgtcatagttggctgccccgataagactgttaagctatatgtgaaaggtgcggacagttcattgtttggaattaccaaaaattcattagatctggacattgttcgtgctacagaggcacacctccacaaatattcatcgtttggtctaagaactctcgttattggcatgcgtgaattgagtcaacctgagtttgaggagtggcaattggcatatgaaaatgctagcacgtcagtacttggaaggggaaatttactccgatcagttgcggccaatatagagaacaatatccgcatattgggggctactgggatagaagataagcttcaagatggggttccagaaacaatagaatctcttcgacaagcagacataaaggtttggattttaacaggagataagcaggagacagcaatttctattggctactcttgtaaactgctgaccaatgacatgacacaaattgtgataaacaacaactcaaaggagtcttgtaagaggagtctcgaggaagcacatgcaacgattaagaagctcagaattgcttcaactggcacacagagtccagaattagcatcagaatctgctggtgtaactcttgcgttaattgtagatggtaacagcctggtttacatacttgagacagagttgcaagaagaggtactcatctaaatatgattcttttttttcatttcctttcatccttggtataaaatcatagttgatgcatggactttcttcttttgtttgtgtagcttttcaaagtggcaagagaatgtagtgttgtattgtgttgtcgggtggccccgttacaaaaggcagggatagttgcacttatcaaaaaccgaacagatgacatgaccttagcaattggtgatggtattattccctcctggttctgctattatggcatataatattctgtgagaaccaatttatgtacatgtgatatatgctaattaatcttttgttgttcaggtgcaaatgatgtttcaatgattcaaatggctgatgttggtgttggcatcagtggtcaagaaggacggcaggctgtaatggcatcagattttgcgatgggccaattcagattcttggtccctcttctattagttcatggccattggaattatcaaagaatgtcatatatgatcctctacaacttttacaagaatgcgacatttgtcttggttcttttctggtaagagcccttttgcattgaagttttcacactttgaaaaaaaaaactgtttttatgtagaaaattatctaaacgttactgtggaaacccccatgttagtaagacctagtgaaaagaagtggactctatttatgttcagttgaattaccaaagttgttgctttcttaatttttgcaatattcagagacattgtctccaaaatataacacttaattttgtgatctcaggtatgtactttatacagcattcactctgacaactgctatcacagaatggagtagccttttgtatactgtgctatatacatcccttccaacaattgttgttggtattcttgacaaggatcttagtaaggaaacactactagcttatccaaagctatatggatctggccaaagggatgagaagtataatgtaaatttgtttgtcctcaatatgctcgaagcgctatggcaaagtctggttgttttctacatgccatattttgcatatagacaaagtacgatagatatgtctagtctgggagatctatgggcacttgcccctgtcattgttgtaaatatgctactagccatggacatctttcggtggaattggatcgtacatgcttttgtgtggggaacaatagcagcaacaaccatttgcctctttgtgatcgactccatttggtttcttcctggatatgggtaagtacttcatttccagctttcttttatttataggcgaaccctcttttttttaaaatgttttggtgctaaaaatgtagtaaccaacctgatgtttggaactggcaatggctttttaaattctttcctgcaaggcattttgtaaatttcataactgtaaatttctgaaatatgtgttaatatcagttatcctaggaagtaaaatgacttttgagcttatgcaactgttatgggaggagctcctgagtactcttttcgtactcgtaaaggaagtcgtttaggataatgtttaagtcaaaccttgggaatataaatcatgaataactctcaagtcgttgagtttgaaaatgtaaaaattatataaatagatttgtcttgaaaaatactttcataaaagtatacatatatcacttttcaataaatatttttatagaaacaagaagtcaaagttgtgttacgacttcctttatgagtacggagggagtatgtggtctctattttctcatttgtagtattttgtgttgccttgttgctgttcacgttaatccttgtagagttcttttattcctaggaggatattgagaagtagagatatattcaagtggtaactatgatttattgagagggataagtgttcagattaagatatatagaaaattaacatagatgctgctacctctcaatatctcctatgtaaaagggataaaagttgtcctgatacatagttagattaaatgcctctttctttgcaagcatgtttgtgctacatccatcatgtaatgcgagcaccatgatcatgttttcttgaatggatctcctaaagtgaaataggagttctttttgcaatttcttgattgattgcatactgactcaatataactatttcagggccatctttcatataatggggacaggtttgttttggttactgctgcttatcattgttgttgcagcaatggtaccacattttgtaatcaaggcctttacagagtattttacccccagtgatattcaagttgcccgagagatagaaaaattcgagaatgtaaatcaggtgaaccgttcagaagttccaatgacacgtctgcatgacccaaggagatagctatagaaaattctcctttatagaaatttctttttttttctgttgtttttcgcctctttggtgtgtatacgagtaaattcatttagcactaaggtgataggtttagcctccaagatgtatgtatgtaggcatgtgttcatctaacatttactgaaaaggaaatataaattgtttgatgtatgcaagtttctcatccttgtgtcgaccagcacaactgtaaggtgaagagtgttatatacctatattacctcttactctatcactacgatgatcctgtcctattgcataagctgatttatctttgtatttttagtttcttagcttcagtttattcatgctatctgtcacctccacacaagtgcacaacatagggtttttacaccctttgattcagtgaggtaaatgaattttgataatttagaaatgggtgttcattttgacccaatggtattgacagatatggtgttagtttggggtaaatttcaatgctgcaaatgagataactaggctgatttgcttatgtccaaacggagttgatccccatccagttacaaaattatgcattttctgcaggttaacatagaagccattacatgaattttgagaagctatatacaaacgtcagaatgccagtctaaaaattcaaagaaagtaagaaaaaagagacttcacagttatccttttcacctccatcacagcgacagctattgactaatgatttcagatggagcatgttttgagctccggatcacaagctcacaattctctccttggggagaagcagagatttttgatcaacataaacattaccacagaaccaagttcatcactggcaactctgccagatttgagttgctagatttgatctggctctagcaacatatgagctcaagatcacactggatagaaacattgtgaccattcctgtggaggtagcagtatgatccttatgtcagaaaacaaacagaaaagctcctcaagtcgtctcttgaaacgattgagaacgcgaaaatgctgctggattggcctgcagagcctgaggcgattctggtgccgtgccatttttcgcaacatttggctggaaagacttgaatatgcctttatcgtcaggcttgatgccaagggtcgcccagattgaactctttgcagcctcagctggatcatcaatcctaagagttttaggtacccataagtaatttctcgtcttctcttcttcctgcaagctttcttctcttgaatgctttcccaacaccagagaactgcttcctgaacaagaaattttgtttggagcggttgacggcagcacagtagtattacctccagggcattgtgcattccacattccattaggccagccagggaagcagctccacagaggtggcacaagagggattggaacaacaggagtacagattcctggggccggcaccatcagttgcggtggccatgaaggcgggcagggtatcccatcttttaacccaagaacgggctgcatcgagcactgggtagctggcatgagagcaacactgttccatccaagactccaggggagcaccaaagcaggtccagtagggaaaggcaatgccacaccattacaacatcctgacctgttgtttggctctttcataattgcattatctggcatcagattctctgaacagctggatactaccacagaagatgcacatgatttttcttccttgttatcaccagaggccaagggaacaaggtcagtatcattcggctctccaatatcaaggattgaagctgaagacttacatggtggtacttctgatatgaattctgtaggtgtttcattttccttcagtgttgctggaaggagagaagatccatgtgtaataacctgatggtgaaccacatcagaaacatctccaggagctacagtattattgcacgtcatcatcgcctgacagtattttgacacatgcttatttctgcgtcttccagcaccaactgggacattcctcatagctccaccagcggtccaatatctttggcagttcctgcagaagtgcctgggctggtgaacattgtagttgttgaagtagcagaactttgtttccatgctattgcagcgtggacatggcagaatcttatctggcttcttgagtatcttctcagggacagatccatcaggctcagtcttaacatcctcagtcatggaatcgatttctattcttccatccggtctgctgatgccttgtaaatcatttttcttactattgttgggacaaaaaggaatacctttgacaatcaaaagcttgtctgagactaaaggtaagtcattattggtttttacaccatttcctaaattaggcatgacctgaaatggattatacataagaggtaagaaaataataaaatatcaagcagagattttggatcatttagctaaaagtatagcaaaatgttaaaactgtgatagtgtgatagtgtcaagtattcaattattatgaggcatataagccatgttatattcaaaatgatgcaggtgctactggcctaaattttcatgaaagtctttcttcagcttcagctgaatcatgtggggtcacggaaactacctgatggcacaactgatacatcgccattacaatgttctgttgcagtttcaatgtccttcagttaaatataaatcattttatgttatccctgaataatcagagtcgccatgtttgtgcgataagttattgcctaatgttactaagaatttctccccgttgggatcttttctctattatactcagtattcacttgcacttgtaaaactctagttcatacttggggttgctaaaaataccatatgttaacatttcaagttatcactgtgtggctatgcaactgttttctggcgcacttgagtttaagcataaagcagcacttcgagcaaaacattacttcagtttcatagctcaatacttcacatgttagtaccagagctactcagtatcaaacctgttacatagcaacaatacaatgtgcatatgtaaataagtaatgagtgggcattttatttttaaggctggtagtaaaatcatctttggagtcagtttgacatgcaaaattgtttgatgtatggcaaatttgctctgtagcaaatagcaatcgacatgtacgatatatgacacattttcagttccttcttgcagagagctgatcagagtcccttctccagtgttttgaaaccaaattgcaaaccaatacggttttcagaggtacgtacaactactgtttgaaaactaaggctcagttccactatcatagtacatagtataacactacttttccagactccaatttagcatttagagtctgttttttttttctttttttccagaattgcttgctggaataactcatatactagtacgtaaaaagtacctttggcaacaaaagttaacccatactagagtgcaagtgcactgaaatcaagtcctgataagcaatttggttcaaaggcacggactatccagtctatcaggtttcaggacaaacagacttagtaccatctattctaggttctgcatatggttatcgaaagatggttctttgcacaaagaaagctaagataagccaatcaaactcccagaatcttaccccaaatgttgccaagaaatcaagaaaggatagaacagaattttctagaacagaattttcctaccaacaaatatgaggttggggattagcatgggtcactaatataccgttgacccactctatttgttcaaataaatgagctaaaactgaaaaaaaaatgttcttttctctagttatattagtatatttaggccctgtttagttcctccaaaatagtactccatccgtcccaaaataagtgcagtcatggttttccgcgcccaactttaacaactcgtcttatttgaaaattttttgaaaagaattaaaaacataattcacgagtaaattagtatttatgttttatcatcttataactacaaaattgctaattataaaaaaatttaaaataagacggatgatcaaagtagggcgctgaaactcatggctgcacttattttgggacgggggtagtaaaagttttgctgttttggagtactttttacaaaatggatctaagcaaaagttgtcaatttagtatttgccaaaaagtgtattgagagccgtgcatcgaacaccatggcggtatttgaattctttggagagagaaaaaacaagaagaatgtgcttgagaatttgcatcgaacaccatggcggcaaagaattaatcccttttttaaactcatttctcaatctcctaattagccgacacgaactagaagagcaaacccaaagcatcgataccccaaaaagcagccaggaaaagagagaaagagagagagaaagcgaggcgcgtcgcatctcgtccaaagcggggagggagttagataaagattcctctctccgactacttccctattggcattggatgaaatcgatggctcacctcgtcggcggcggcggcggcggcggcgggggggtcgaggaggagggggatggtgcggccgaagagcttgatggcggggtcgtcgccctgcctaagcgcggccatagcggcgccccgatctcgtccgcgctgccaccaccggcaccggcaccggcaccggctcctcctcctcctcctcgggcgcagcacgacgacggcgacgagcggggatgatgccagcggcggcggcggcggcgggtggcatgtcactgggcggaggaggaggcggccgctcgcgttgtgttcggagtaatgacactatagtagtagtactagggggtggaggaagctcggggatggaggaagctcgtggctcgttagctagctctgctcgtgaccaagctcggctcggttcggctcgtttgattttcctaacgaatcgagctgactcgcgagccgctcacgagccagggcatatgagctatgggcctttggaattggattttggtagagaatggaggcccaagagcccaactcg

SEQ ID NO: 79281 - DNA, 9198 bp, Oryza sativa
gaaccactctagcgcctgatctctctgcaactttctgcagagttcagtgcttaacaaaaacaaactttggcaaacattggggttaacaccaatgagccacattattcatagcaagtacttacatgattggaaagatagaaccaagcacctactactattttattcatgggaaaggaaacatctaattagcataatacttattttccttccctatctctatgaatgcacgcttgattttagcgcacaaaccgcgactaagggtatcgaaattatttctaatgtcagcaagctctacccctagctccgcgttgcgatccttaagctctatgttctccttgcggagtttcttcacttgtgcggcgagcttatggatcgagggctccggcgatttcacctcctcttcttggaattggctgggagccctcacaattggagggggcttcaaatgacgcttcaccttcataggtggagggctacgggattctgctgccccctccttttccgatgccatcaaaggccgtagtaaactcttaccatacccactgccgggagttctcactccttggatgcggaatcgctcctccttcggagtagacggagtagcggtgggtgtggtatacttgtggagcatctcatctccttccttggtgaacagggtgcccacatagcgctcggcgagaggtggcgcggccttcccgtcatcttggaaaagccgtcgtgccttcaacaagccgagttctcccgttgtcggccgtcgcgtaggtgaatccccccagatttttgtccttgtgacatggcgaggggagagggatcacgctgccgaacggggctgagaagggttcggccgaaccagggagctcgtcgatcggctccaaaattgcaggggagcctggcacagctgcaaggggttgagcccatacagcgtttaccccttccatcgtgtattcttccaccgggatcaattgatttgccggtgtcgcctctccggtgaggtcgtacgtggaattggatgaagagccgatgaatgtaatcaaggatttgccagccattggtgggtatgagtgggaattcgaggaattgggttggattggagaggagagtatgcaaaggtggagagaaagaggaagaagaagtgttctagcgagatccgagcgttctacctccaaatgcgcatctaaacaaactaggaacgagcgggggagagcgaagttcaaaaatggggctgatcgggcgcctccctggctcggccgaaccagcaccttggtgggtccgattgagctccatttttttcctaggcctaataagtcctaaactaagcacaaaaatgacaacttaccgggttttaagcatgcaatagatgagatcatcatggttcataatcaactaatttaacaacatccacttcttcatctaaagtttcatttggctcaaggaaagtctttaagcgttgaccgtttaccttaaatatgttaccgaagtcatcgcggagtgtgattgccccgtgcgaagaggtgtcgatgacgtcgaatggtccttcccatttgctgcgcagttttccgtggccgaagagtttaaccctggagttgaacatcagtactttgtctcctggcttgaatttcttgatttttatccttttgttatgtaacgtcccgccttcccccaagccgggcccacttacatctgatagctttcataggtcatagactgccctcacagaccaacacatgtcttttctgcacattttgtcctcactcgtgtgcacccgggaaattcttcccggtcggtcacccatcccaaattgctccaggccaagcacacttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgcccatgtgtccaatgacagcgcatgtgccatgctgtgtaaccactccaggtctacaccagccatgcgcaccatgcctgcgcaactgcgatacacgcgcccgtgaaaccgcgagagtcggctctgataccattttgtcacgtcccgccttcccccaagccgggcccacttacatctgatagctttcataggtcatagactgccctcacagaccaacacatgtcttttctgcacattttgtcctcactcgtgtgcacccgggaaattcttcccggtcggtcacccatcccaaattgctccaggccaagcaaacttaaccctcgagttctttgtgcatttggagttttggacttgtattccataatagctcccatgagcataatctaaaagaattatttcactaaacaaacctatagttaatcttgagtgataacatgtggacttaatattaaactcaaatatcatcttctcagtctaaaagaagtttaatgtaatccctataataatattagatgcaattatgaagtgggaacacatatacaaacaaaggtcatcttaattctctaaaatattttgtgcaagataaaatcatggaaaaatttatgtggacaatgattagcacaaacttatcctccgtaatttggtaacgtgttaacactcaagttgatatctcaaattaatcggtcgaaacagacaactaaaagaaatcaaattaaattttaatcggctaaaaccatatttcatccaaaagtacatttaactgcacataagtgaacatggaaaataatttattcaaatactagattagttatcatgaataaatgtaatttttctagaattttccttctctgtttaagcctcctaaaaattcaatctagctttctaatagcccatctttgtttaatttctgtgagcagtccacccattatttttgagtgcaaccaaagaaaatggaatctaggtgtaatcatttacctccagtaaaatcaacactaattaatttggtccacacattgaattatgtagtttcaaagttagaggagaaaataattccgaaaattaatctaaaaatcaagtttacccagaatcttacccaaccctctcaccctagcctagtttgccacgacctggacccacctgacagcctcttaagcttgccttgactctgtccatcacttcctccactgttccagccgagagagggagagattgagcgagccgacgcgtggccgcaacgtgtcgtcgatctcggtttcccttttctcgctctctactcctcccagacgcgtcgccattctccacacatcactttggagctgaagaagccgagggagaggttctctgcctctccgtcatcctcaacctcgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcaagccacgtcgacaacgccctggagcacgcaccggagcgccgccgcttcaaccatcatcgtcgtccggccattctcattcacctcagagaaagctgctgcgccattgtcattgcctcaacctcctcttcaaaacgcctcaagaaccccagccggaaacatcaagaacacggagaacacatccttttcttcaccggcgccaatctaggatcgcctccgccgtcatcgtcgattaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagaccacatgcatgcatccttttcgttcgtaatcgacttccatgcgcacatgcactttcaccccaaaaccaccgccgctcacactcgccatcggcgctactccgatgtcctctaaccaagaaaactagaggaatggaatcgcgagagcttgctcttcattttatcttttgacctcaacctcaagcgagccaccgtttgccgccggcgagctccagatcgagctcagccatggctagctctgctatgtctagagcagagggatgacttccgtgaattagattaagtgcagggatccgtttacaattatagaaacacactgacatatgggcctaggactgcgggttgattcctagaaaactcaagggcctttgtgcatattggtccctcacagccatgtggacccatcctttaaaatctgaagaaaaattaggaaaatgcccaaacaattatatgtttagcagaaaaatgcacaagttgtaaaatctatataaaatcaaatatagctcattttgaagtgattccagtttctgtagattcttgaagttatgaactttattccaggaatataaaacttgacactcactgtacaaataatgtctctaagatttatctaagataagtcatgcataaaacatgtacaaacttataaaatacaaagaaaattcatttcaactcattttgaaacaaactcaaaaacttcagattcatcatcagacactctctgattaggtaaaataaaagtaatgacttactttgcatcaaaagcctctaaaactattatctttaaaatgactagttttagataagctaaactttagaaattcatgtagaacccaatttagcttcaatttgaataaacttaagttatgtaggatcactaacacatgtatttccaagttatgaaataatattatatacttgctgtgtagtaaaagtctctaaatattcatataaggatttactaacatagagcagccattaatttgtaaaacttgtagaaaattcatttttagtccaaatgaaatgaacaaagtttctatagaaccagcaaatagttatcttcaacatagtaaaataaaatttggcaccttctgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatcctcatccactaaacttagaagaacttggctcatataacaatttctaggttaatataatatattgctagtttagattaaagcgtctctactttataaaatatgaaccatagtagtaaagaccataaacatgtgagataaaaatgttttagttaaccaaattattccttttattcaacttaaacatgaagtagcatgttctgaacctataactcaggagtcatacatatataaaacactatatgcctaaaacacgttgtaacttgtaaaatgcataaagaattcattataaatccaaaaattgtgaaaccaaatgtgttagtcttagaaaacacatctccacacccctgtgaagtctaatctagtaaaaatcactttacaaaagtattccataacactacctaagactatactactataaaccgataaaacttctaaaaattcataactccctaatggaataagataaagataaaataaaaattctttcacctaaatttattttagatcagtaccaacccactgtgcataaatcatgcattttagagcattttggattttcaactctttcggtgtttaattgcatatcgtgtcctttatctagataattgcgtaatcggtgaagaagtggattaggtgctaacaattctctgatcaaggaaagttttctcctcccatcctttgaacacattgaatcccatgatttgaggaatgaaaatatttgtttacaaagttgcatgtgaacttagactatatcggtatttgaaattgggttaaggtagttatgacctatttgctgcatattccaccttgaataattgatcctcttgctgtttgaacccctagaaatggttagagtacactctttgtgctcaaatgggtttatatatgctctatgtgcaactacttgcttagccatgcttagaaatatgcaaatactcattccatctataattaaaatgtggtttgatacttgaacctttgctggaataaaatgaatatgatgagtatttgcgaactaaaatgtgtaaaatgtgattttacacttgggcagcaagtggtgtgcatatagtgttagttgcataccgatagggggagtgtttgcccaagtccataaggaccgaacttgtgtcacccatttaaagttattcgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtgggttcccgttgtgtccgccaccacggcgttaagtttaaggcgtgggcccgccacttaacggttctagacatatttccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaattgattagccgtgctcacggtcatgagtgctttggtgatgtgtcatgagtatagactatgttttaaaaatgtgatcatgtgacattggtttgaaattgataaatgtgttgagttgtgtatgtggtgatacattatgacttattattaagtatggcaataagagattgtttatgacggaattatgaagaagctaataatgaaacttaaaacttgtctttgttaattgaagcatcaactcctttacaaaagaattgcgaaacaaaacttgctttatgctgaaaatgaactacatattgccttcctttgaatatatgccttacatgtagtatggtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtatacccctagtcggtgtgcttgtgtttgggtagtcaagcttccgctgttctctaataagtctatttggccggttggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgggaggttgcagatctttagccatttttgtcaagtctcctgaatgtgtaacacatctgatcgccgccttcgagtggtttgacgggcacatctcaggctgaagttgactggcaggctaagggcccagcaatgtctccaatattcctctctcgaggcgtcggatgtttcattatgcttgtttgatgacttgaattattcacttcatctctcaaatataatggaaggtctggagagcctatgacatgtcatgccagcgcttcgtcctttctttatatatctttgcgttgtggtaagccatttctctccattcctcaagttctgcaatctgcatttttctccattctcctgctccctcaaaatccatgttcgaattcctgatggcccaatatgctctatgctcaagttctacgggtagtcgacatgacttcccatagactatctgatatggggacattccaatgggtgtcttgtatgctgtccggtatgcccacagtgcgtcctgcaatctatccttccattctgttcccattttgttgaccgtcttttgcagaatattcttgatttgtttgttcgatgtttctgcttgaccactggtctgtggatggtaaggagtggccacgttgtgtttggcttccatttctcgtaggaggtctctgaaggttttgtcaatgaagtgaaaacctcggtcgcttatgaccattctgcgggtaccaaatcttgggaagatggtttctgtgaacatcttcttggcgtgcctcgcatccgcggcgctgcacggcatagcctcaacccacttggagacatagtcgactgccaccagaatgtactcgcagttacgagacttagggaaaggtcccatgaagtctataccccaaacatcgaatatctcaacttgcaaattgtatgtaaggggcattgcatcgcgagcagtgattcctccttgcctctggcagcttgtgcatcttctgatgaattcttttgagtcttcgtacattgtcggccagaagaaaccactttgccagattttggcctgggtgcggaatgcaccgtaatggcctccatagggtgaggcgtggcatcgttctataatcttaagtccttcatcagttggcacacatcttcgtagtaagccatcggagcatacccgatataggtagggctcatcccatatatgacggtgactttcatacttcagttttcgttgattttcccctggtggtatgcacttggataccatgtagtttactatgttagcatatcacgtgttggagtcgcgaaccgtcatcagcatgtcatctctcaagagatcatttatcggttgttcctgcatgttagtgatgtgcaatctggacaaatgatctgctacataattttctactccctttttatctttaatttctatgtcaaattcttggagcaacaaaatccatcttaagaggcgtggtttagcatctttcttagtgagcaggtatttcaaagcggcatgatcagtataaattatcaccttggctcccactaagtaagatctaaacttatcgatagcaaaaacacccgtgagcagctctttttcagtagttgcataattcaactgagctccggttagagttttgctagcgtaacagattgcatgatgctttttatccttggtttggcctaagaccgc

SEQ ID NO: 79282 - DNA, 83838 bp, Oryza sativa
  unsure (1)..(83838): unsure at all n locations
tagccagttgtataaatgggcttcgatgaaggaggtggctcatagaattcgccccgaggagcagacatctcaaaacgaggttgctccatggtcgagaagagtttgacaggaatacttctctaggatagcaggggtgaaggtagactaaaaaagtaaaaaggatacaaggatgaactgggttcggaaatgatcagcaaccgttccccggcaacggcactaggaatgcttgttggtatttaatacgggtacagataaaatctgcaaccgcacggatataccgaggtagcacttcccctacggagtattccaagggtatcgaatccaaatgaacgtgtatggtcagatcttcctccggttcatccaaggacacaaagtaaatgataggccaggatagagaggatttactagtgagagacagtatctagggaaagcttaactttaatcctaatgcaatacttcaggcactggcaacccgctgttcccagatgtcgctctagtacgtacccggaaagggaggacttaagtgatctcaagggctgtcaccacctctacacctacctcaaacgtaccgtgggatacgcagcaattactggataacaattacttaaataccacgtctaagcaattaatatctactttagtgtttataactcatcaaagcaatcactatattttagttgattatagtgaacaataatcccgtatgctatttaggaactaaccaagagataattctcacaagataaatctaaattattcaagaagaatattatattgaattcagagtaataaatagaataaaagaaataggagaagattaccgacaactccggaattcttccgacttcttctactctactctcttcctattctagtgtacaatatagtacaatagagcctcttataattcagctcaagcttggaagtgtgtgtgagagtgaatgaagtgaggtccttttatagggcagttatgacggttgtgagaaggggaaatgtccgaactgcaccgcaaccgtcattgggagaacatctggagcatccacgccaaaccccaggatgaacggtgatcggggggttcggccgaaccagagggttcggtcaaacctgggctgggccctcctggcctggccttcggtcggtggactctcgggaccttcctctattcatttctcggagttttcggttgatttactgatgtttcgatgaagttcacaaccctacttgtatggatacataattctcctcactttagtctgattttcctcccaacttcagggtttatcatctgcatacaaatatacaccaacacttgtggaatatgtaagattaagcacctattactatgttggatgttttattatctagactttatgaagatgttggcggtatgggattgtcatttaacaaccgccaacaatggggcatggcatcgggtccacgagattgatcgccgcaagactaaggctatgttcgtctgttcgctggagcctgttcccaactggaacagtgtgcacgaaaaataaaacggtccattaacaagtgattaattaagtattagctaatttttttttcaaaaatgtattaatatgattttttaaacaactttcatatagaaactttttacaaaaaaacacaccgtttagccgtttgaaaagcgtacgtgtggaaagtgaggaagatgagttgggaaacctgggctaggaacacagcctaagggtctgaggcagaagcggaggcgaaagtttctctttttttttcgtgaagtactttcctccgtgtgctgtgatgagatgattaaagatcaagtttctgccttaatttctcaattggagcatgatttttcattagttccattgttttcagaatggtaccaataatgttagaaggtgctttattttatacctagaaaaatgtctgttgtagagaaatgaagaggccatggtaggacaccttgccatatattttttaggaagaatggctaatatgcattggctagggtttaatatctaattttattgcagctggccatgattggagacattgccatgtataaagtgaggtatagcattatattctatattgatgccaactttaggataagggatattttacgttcctctgattcagctcatggtgacaagttattatatgacttacaggtgcagggaacacctaccaaagtaaattgctattggagagaaatagtgtgtattttggtggtatttcagacgaacaatgtgaagtacctactttgtaatttgccttaaatatatggcataatttgaattaaagctcccattaaactgattatttttactaacacaaaattttagtcatttattaaaaaatattaaagatcgtagcgttagcacgggcatatactagttttaaagatagaatgaggccgaactaaacaatgctaatttaattagtgaaaaccgaaacaacaacagggaaaaaaacaacctaaatactctgagcaacagccacatgactaattaataagctcaaagcaaagcatactccctacacaatgccattgacattagaccatctacacccccccccctcccggggattggacaaatctagcatccctaagaagcacaagtgaacaaggtcaacatcctaaccaataccaaaacacaaccccattggacttagtgttattgttgcacatgttgcccccctccccctttcttccacgtgaacgttgcacctctaactttactaccaccagctttattgaaatatgcgtaagctagattagcaaccagggagcagccaatcctacaccctattagatgggagtgctaactcaaccaggaggtgggaggtgtcatcatcttgttagatttaattctcaggatctaatttgcttagcttaacacatggtcacaaattctaagtgtggaattgagatgattactgaccggatgaactgaagccataagctttgccaattcttctgttttttcttcttctctgttgatggaaaggaagcacagagaaaacctgatgaaccccttccagtgtctaaacgatcaggccattaattttagggtttgaggttagagagaaatcatattgtcacctagcctccctccttctctttctttacataagcgacactggtggggctcgggggttatctcaattagtttaggattctgttttctgtgccgatcacacaaaaaaaagaatttatctcttagtttgtttcttgttaggataaggaaaccggtggtttagttcttctcctaatccttatcgactcaagtcgacaaaatcagctaacattctccccttgatttcgagacttacttatgagtctattaaataaaatagctcccaaggcaatgtgtcttcaacaacattatgcgtcactgagacaacaagacctatagctcactataatactcaaataaactcaagcttaacttagtgagtgttgattgaaaaattaagtccccctcatccaggatcttagtaaggctctaatttacatatgtactggccaaaacataatcttaattaatcttaatttatgagcctttagaatatggatccattagcaaatgcttagcttaataattcgatcatgggacatgtctttcacaaccatatcaatgtgttaggcagaaaacacacaacatgttgctactagaatagaaaactgtgtttaattagtgcacaacttataacagtatattttgggtggttaacatcttttgagtggtttatgagcgctattcactactcttagttttgggaaatatgattaatcataacacgctttaaaatctaacttcatcgtcgactatgcagtaagagattatttttggagcttttacatggttattgctcccctatgtgtgaacatagcttaatctgaataatcttcataaatatccacacatctcataaaataagtgtccaaatatctctaaacttctgagatcaatggactttaggaaaaaagagcatgttacttaagattgtcttgcaaataatggaaaacattattaataccagtggtttagtctggatttaattaaatactgccaagattcccagtaaaaaaaagtatgccaaatctgtatgcatccagatttgagctaatctcaagcttctgtcagctgaatcataaatgattatctttgtaacttaatgtcagcttgactaactttaattgaattctctcaaattatttctttatgtcagtgtatgacttactgatataaacccagtactccttcggaccaaaataattcatggaaaaaaattccttagtttctaagagcaatatgcattgcttgacaataaaatgtcattagaatggagtaccggtgaatgaaattcccacctttaattttcatgcacctgtccacctcacttgaattgtttgaaatttccatcagagtcaggcttaattttattaacccacttaaatggcccaatattttgactcattcagaaacttctactaaattctttattttgttcatcaatctcaattattcttatatggttcgaaaaccatttatatgaacactttaatgtcttattttgttcatccatctcaatttattcttacatgattcgaaaactatttggatgaacgcttatttttaatgtcttataaggtgaacaagctttatttagtgtttaccaccataatccgatctcataacttcatttgattttagcattagtgtcttaaatttcttaaaggaaatcggaggtcgcttatgggtaaacatagccataaaaaatcatttgttggctaatatcttaacttcgtgaaattttcacttaaagctaaacaacgccattaaaatctaagggaaagaatatctatatctcatgagacgttccaaactcccctaggtatgtgacataagagataatgacacaatttcaatgacgtcttgctttcatcattatagaataattattctcctcattcttatttaagcttagttcactaatgacggaacagaatttaaaacatcatcaatgtttgattaagtccacaaatggatttcttaggtctgcaccctatgcgtgacttgtctttccataacaaaaccctaaagttatgttatatatatttaattgtgcaagtcacaaattaagagatacaaaattctagcgtccacataatggagctatgagtcataaataaggtagaataatcttctcttattagagctcttgatgagctcccacagattgtattatttatttaatggaagcataatatcttatttttcataaacttgaatcacttaattttacttggtgatttatcatctaagtaataatagatgtcagaaatttctaagggtgaagtgtctcgatctcaatgagacgtccattctccccttgaaatgtggccgaatattaaggccataattttgacaacgtctcataatagttcaacccaaaataatgccattaatcttcttattaactactttcttaattcaggacattaagcatgtccctattttttgcaaagaacttacacaagaaaatttcaagagtagcatacataggacatagaggcaatttgatttccccttgcgaggaatatgagctttattatcattaaatttggaagttgcaacactcccccttagtgaagcttcatctttgccatcaaatgacaagattaacaagatcttacttagtttgtctcttagtcttcaatatttcttattgatttgaagagtgatgaaccaagtcaattatggtccattttgtcttagtattacaactccgaaaatgaccgtagtctaatgggagaagaatcatatgaaatggacaagtggcgcatatgaaatgtgcgatgtccatcccactaagtttgcacgccaattatggcggcaaatgtgcataggcactaaatttgtactaagcattagtcttgacaaacttctaaagttcatctcaacatttgctagatacagtttcgcaatgtcatgctcaaaattctcccctaacactaacagggatgataatcttaatatttatgagtgacatgcgaaacataacattatattggccttctcccaggctaaagatgcctctagagtttaggaaaaattagtgacattagctgcgggagacacaaggaatccttttttaatgctaagtcatactcaaataggccttaggctcagttaagtcaatgaggaataataataataattccatagactttaactgataaacaacattatttattgctgaaatattaagtggcactattattgtggttgcttgggcaaattacgtgcaatagtacattaacttgcacaataataacttaatctttatttcgctttgtatcaccattgggcagagacaaaatgaaggaatcaataaatgaaattacttgtaattcaaaatcaagtcaccgttgggcagaaatgatttagggaataaacattaatgtcttaaatcacatcaccattgggcaaaaatgatgaagttaataatttaaaatcctaaatcaaatcacgtaaggtagaaatgatataggaatgatgcccttagtgatgccatagaattaaaattaaaattcttagccatatcaccgttgggcagaaatggtaaaggaattaagcttactgacagattagatcctcgataacatcaccgtaaggtagaagtgataaaaggaattaatgcactaatggcataaataaaattctaagtcatatcaccattaaggccaaaattacagagaatatttaaaatagtgattgacaatacttagatttcttcccttaattacatcaccattgggcagaaaataattaaggaaataacaatcttaatgaaatcatctttctttctagataaacttcccgttggttccatttatcttgaaataatttactcagtattgcaagtgatcttaaataataagaattggtgattgcatataattagtttaccatggcttaatcaatcatatgcaaaataaacttagaatttcatagtcaaagcaccattggtcataaataattatgaataatcttaaaattaattccttaattatatcaccatttggtagaaaataactaaggaataaaaaattataattgtcatgcaattataataatgtgggttaaatataacttcaaatcttaatactttctagtcaaatttctcgttggttccattcgagtataaataattaagttattaaggaaatgaccatcataatgatgttgacatgaaatcataaatactttctagttaaatttccattcaactagaattaaattaaatggcttaaagaaataataatcttaataatattgacatgaaaccatattaacgttggtcaaatataatatcatatcattaatttctttctgaacgaccaaataattgatcataattttccagcaattttaaatggctaaaataatgccaaattgaattgtgtaattttgaaattaattaaataggtgcttagtgaattaaattgatttcggccaacttcttccaatgccggcccaaaatcgggccggcccgtctacgcgtgagctcgcaagcttgagcggcgcggctcagcatctttttttgcggcccagaggccgtgcggcccatcggcggaggcggcccatcggcgaagatggcctaacgcggggtcggtctgaaccgtccgatctaatggacggctctgattcgctccacgccgaaaaagtcgccgacggggagggtgagaaccctaaccctagctcattcttccccaatcctcatctatcttaatgctggccgaaaccataattctgaccgaggccataacttattttcttgagacaattaacttaattaaactgaagcttaagcattacagaagaagatcataaattaacttaatctaataaacataatcttgaaataaaatttgcatcaacaaaacatggacagattgtagatgcggctaattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatgaagctctcattgatgttggcatatcttgtgatttgcttgatgatagtgctacttgccatattgctcatgttgcatcatctagcatttctacctcttgtgatgatcttgtggatatgtctagctctagctctaactcttgtgtttctatttgtgatgcctcacttgttgttaaaaacaatgagcttaaggagcaagtggctaagctcaataagagcttggagaggtgcttcaagggtaagaacactcttgacaagattttgagtgagcaacggtgcatccttaacaaggagggacttggattcattccaaagaagggtaagaaaccttctcaccgtgccactcgttttgtcaagagtaatggtaagtattgctccaagtgtcgtgaggttgggcatttggtgaatgattgccccggtggtaagcctcctaagacatgcatgtttgattctcattatatgcttaggaaggctcatgatggtagcattgttgatagatatgtgggttcccctatactcggtggtaaaaagaatgccatttgggtgcccaaagctttggtctgtaacctccaatgacccaaacaagtttgggtacctaaaagagcttgatcttcttttgtaggtgaactactgcaccggtgggagccattaggtgcttgatagtggatgcactcaacacatgaccggtgatagggctatgttcaccacatttgaagtaggagggaatgaacaagagaaagtgacatttggagacaatagcaaaggaaagataattgggttaggtaaaattgctatctccaatgatttgttaattgataatgtctctcttgttaaatctctaaatttcaatttgctttcggttgctcaaatttgtgatcttggcttgtcatgtgctttcttcccgcaagaagttattgtttctaaccttcttgacaagtcttgtgtgttcaaaggttttagatatggaaatctttatttggttgatttcaattctagtgaagcaaatttgaaaacttgtttagttgcaaaaacttcattgggttggctttggcataggaggctagcccatgttggcatgaatcaattgagcaaactttcaaaacgtgatctagttgtggaattgaaagatgtgaagtttgagaaagataagctttgtagtgcttgtcaagccggcaaataagttgcatgttctcatcctactaagagtatcatgtccacatctagaccattggagctctttgtcacgcccggaatttctatccaaaattccaaacgcttacatgtgtgtgaaccctcgtccaggaatcagccgaggcacacaataacaaattgataatagagtacaaatattactccaattaataagcgaataaaatgtcattacagaggtagatagttcctctcaatcaataaagatctaagcagcggaaaataaataaacagcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatctaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccagcaaaaccatgtgctcacaacccaccattaccaggttttagttggcacattaattaattaactaatcacgattgaccatcgtgaactatcatgaaaccatcatgaaatattagtgagtcattagttatcccgaatgtgtactaatgtttctaagcagggctaagcaattatatctaatatctagttgaaccaatataaataaagctcaactagtcaaattgtaataacccaaggtatcaaggaataaggtaatcaagtacaaaacggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaaagtgtagatctcaattttagaagaatttagagacttgaaccaactaaatcggagctaagatgaattagttatgaatttttaaagattaaatcggattaaaacctttatatcggtttaaattgaattatgacgcaataatgaattattttgaaaaggaaaagagggtttattgcgtcagcgggctagggtttggtggaccgggcgcacgggcggcggttcacacgaacggacggccgagatcgaaccaatccaaaacgaacggccgagatcgatcggatccacagcggctcacggcggacgaccccgatgacgtcagcggtgacgtcaccgacagcggcggcggctcggcggagaagacggctcgaacggcgcacgctcgccggtgaacggcggcgcgaggacgcaaacggagggcaccaagacgaagcgggcggcacggcgaactcaccggcgaccaaaacgacggcggaaggtcaacggacggcgacggcgacgaggaggaagcggcgaagctcttcggcttgacgacggcgacgaagctccgacgatctccggtgacggcgaaggggcggacgaggacggcgacgacttggcgagcacgacggtggtcttcccgagcgacggcgacggctgaaacgacggcggcgcacggctggagcggcggcggcgacggcaaagctagggcacacggcgctagggctcttccgacgacgagaggcgaaggcgaaggtggcgacgggtagaggagacaccgggggtccttttaaaggggctcagaggcggcggcgaaggcccacggcggtcggcgacgaggaaggaaagatcgggaagaacgaatccgggacgaactcgaatccaactctttccaaaacgatttagccaaagattccaaaggagaaaaggtagaggagatcccggagattgttttccctcttttgattcgaccggagaaggaaaggaacggccggatttggaaaggaacggcggcggcggcgcgctagggtttcgggcggcggcggccgaaggtagacgatgggtccgacaggtgggacccacctgtcagcgtccgaacgcgcgcgcgcgacggctgcggactgggccgaactgggccgaggagagagagagcggttttgggccgactttcggcccaaagccaaaagagactttttaaaacctttttcaatttaaattattccttaaatgcaattccatttattaaaaatacttccttagctcaaataaatcccagaaaaatctaggaattatagaattaagcaaagtatttaatgaaattttatctggccccattttatattggaatttattaattaagattagattttcttttcaagacttttaaaattatttctaaaaaattccaactaaacaacaatttaaattttgaattttcagggtgtgaccatgatgggaacatgtggctaagcaattgctatgataccacaatgttagatttaattctcaggatctaatttgcttagcttaacacatgatcaccaattctaagtgcggaattgagatgattactgaccggatgaactgaagccataagctttgccaattcttctgttctttcttcttcttctctgttgatggaaaggaagcacagagaaaacctcacgaaccccttccagtgtctaatcgatcgggcgattaattttagggtttgaggttagagagaaatcagatcgtcacccagcctccctccttctctttctttatataagcgacactggtggggctcgggggttatctcaattagtttaggattctgttttctgtaccaatcacacaaaaaacgaatttatctcttagtttgtttcttgttaggataaggaaaccggtggtttagttcttttcctaatccttatcgactcaagtcgacaaaatcaaccaacacatctcaatctaatcaccattggtcctaaactggtggatgcccaatatgaggtaggaacgccaaaacagtcatccaaggaagacatacaggcaagactagctccaccactcaattcgacaactcacatttagattttcacattgaagatcacaagggtcaggacatgggagataggacaccaatggcaacgcctttaagaagacaaacaacactcaagaatgtagtcatcgctcgtaccattcaaagctaagaaagtcttccactcaaagccaactgaaaataccgcacgaccccacgccgcaaactaggcaacagcgcaaagaaacacttccacagccactagaacaccataattctcctcataggctagatttggagaaaggagacaaatccgacaagatggaaggatctaatgcagcaacaagttttcaatagtgccttcgcctcagtgctaggtatatacctttcgcacgggccttgcccggtgccaatgcctcaacaactttgcaacaagcagctaccacaccactctgtcatcggctagctcgtcttgacccgatgccacttcatgctaacaactagcaagatgtggcctccgtatagaccacacccgagcaccgattaggcgtacaggcaaaagctgactaaatgcatgattactcatgggaggtgtcacgtagatctatcttcataggtgctgcatggtctatgctccttctacgtgccatggtccacacaattaggacaccatcttcccaatagtagccaccactacaaacacactccaagtcatcggcattgagccaccgcttaaagtgccaactggatcttgctagccaagcacccttcacgatgccccgttgacctggcatgcacctattaccgcaggtgggtgttaatgcgaaaaacacacactggcctggaagatctacttaactcctgtgcaggtccaaaatcttgcttttaagttcgtgagcatgccagttgatttgatcctgcaatcaacaagaataaaagacaagaaaacgaggttaaatccataaatgatagccgatcggctgagagccgatgacatattgtcaatcgtcgagccgatgttattgacattagatcggcaacgatgaataaagtaatataaaactaaatctactcgatcagctgtagatattaacgatatataatctttctctcgatgtatacttaaactaagtgattgggatatagatcgaacgccatgtcgaaacagtataaatcacttaagtctaaagatgcattaagatcatgattatgtgaacgtttataacatagccaatcagatagatctagcatgtatcggctaatactctaataccactctatattaagatatagaaacagacaaaatatattaagcataaagtgtaatataccttaatgcaacaagatcttaatataaagggcatatttagcataacaatcaagcatacatgatataaagtagctaaatcaggtaagatcggctgaaactccgacaatatctctaatgatgatcatgaaataggctagatatcacaattatagatagaatttaatagatcgaactcaaccgatgcatcattaaccataaagataattgtaagatctaaacaagataatgaaaacctctaagacatggtagatacacgatataatctaaaccaataacgagatctaactctatccgctactttctaacagtaaaaactagccaataacaagttatataatgcaactaataaatattatgaagtgtatatgataacttgacgaattacataaacaagattagagtgtcataaagatggaagcactaatcccgagaacgcaagccgtcatgacaagtttacctctagttgaaaggaagaactcgccgaaatagaacgaaagtaaaaaggttggcgatgtgccgaaagtgttattggactgttgttgtaaattacatgggatcgggttatatttatacccgagatacatgatatgtccttgccggacacgactcttatctctaacaaactctaagatacacataagtctttacggcagacttttacccaaacatatctctaaggaaattacataaaatatactaattaatatatacaattgtctttctgagagcttatctccatcgtggcaattcttgtgttgcacgttgatcgattctagaagttgtttcattagaatcggctgtatcggctgtcctctgttcgatccatctcagtcaatgcagactccaactgatgccttcacagccgatgcacactctgttcttcgaatcgaactctttgccgaatctactttgattccaataccgaatctggctcatgtcttaccaaatttggtcgctaacagtgggcctcttaagcagctgcctactggcccatgaaccatcctcagggaagagatttttgcatgtggggacagttatggcccgcctatagcctggaagggatcttgtccgaaaaaagtgattatgcagtagtgatgctgtgacgcccagggcccgtaaatggtattggatccatctcattaacacctagcactgcaactcactgcattcttcgtcctcgctttaacacaaaaatttcgaaatcggagttgctagtgcttgtgaaataaaacctgctattatgctaaattgagctacatatagccctctttgcttgcaagccttgcatgtagtttgttaggattgatttgtgattgctagtacattaattcgattaatgtactgactcttgctatgtatatgtttaattttgttttgcaagtatagacttagttaaattgagtgttcgggactgttgctttacttagggcttgattctaaatggggtctacccctagtggtttgcttgtggattgggtagccaagcttccgcgaatcgatatttatctgccctgtcggtcgtacgtaagtaatctagttctttgtctctatttatatctaagtcatcttttatgtactttaccttgataacatggcttagatgaaaatgcaaagctagcaacttcttcctagggatagctgagcatgagtaagaattttgagcaattgagatattgtagagcttaagcaatttgagtcaagtctcctgggatgtgtaacacatttgggctgcgctcaggaaccttgcctctctacatgaaaaacaaagcacgcgattatagtgagattaattaagtattagcctaaaaaacttaaaaaaatggattaatatgattttttaaagcaagtttcatatagaaaagttttacaaaaaatacaccgtttagtagtttgaaaagcgtgcgcgcagaaaacgagggaagttggaaaagtgaggaaaagaacacagtcttggtcgctgccatcgtgtggtttgactgaggctaaagttgactggcatgctaagtctaggcaatatctcctttgctcattattcggcattacggattttatattgaatggtattaagttgtgatcatgaacatattgaggtttgagtggctatttatgcgtatacgtatcctactcatccaaaatcatgtggtggtcacaaatggcataaaaaggtttaaataattattacgtatcctactcatccaaaatcatgctcacagaggtcataggttttttatcagaggcttaatctgtgcgcattaacgtttgtttcgacctactaatcttttcgtgtcatgtatcacctaactttctctcgtgagaaatggcatcctcatttgccagcacagctgttgaaaagtttagcatcaaggcccaaattgtattttgctaattgtaaggtcaatagtcaccgagtgtttttactcatggtatgatcgatgtgatttacattgtcctatttttgtagaaggctgcttatttaattactcatttttccacttccttgatattacatctgctttgcctcacatgttggttaaattacatcagaactttacaaaacctactgccttgcaaatatgaatgctaggtgattgattgccttacctgaatgtgtaatatacgatagtacatatgtatttgtacctatttagattagtggatatctgtaaacttaaggcaagctaaattcattagtacatgcttgctagttgatcttgccttttgttgtactattggaagttaatacatgtgccaaacaatttgctaatctgatagatggagttaactgattttacatgcacatgtcagacctgctgctatttatgaaattgtacaaccaatctgcaagttcttctgtctagggcttatgaaataatggcagaaaactcattttatgagtacatataactgcacacatcatctgtgattgattttttttttctgcccagtgcactggctatgtctactgcttgtatttatgacatttctgcatgccctgtttgtatttcttcccttcatattgaaagagtaattgttttgttcttgttgcagatgaggagaggtgcccgtgtgttcaggcatggacctctgaagttcattccagagcatcacgcggtgtatggtggtaggactgtcatgctgaacaggtcgggtgttgttcggcataggccggcagcaccataggtgccacaagatgctcagatcctcgatgttgatgacctcaccaacctggcactcctaccaccctctccggagccatcttcaggaccgcgcagaaggggcaagagaatcatggcgccggggtactcttcaggtggaagtagcaagaggacaaggagcgactccaccagggatgcactgaacaggcttgcggacctgagggtccagtccaacgaaagttgggcaaggagggaggagcagaagcaagcgaagagcgctagagcatgcatggagatgctcaaggctgatgggattactaggcaggatcccatataccacacagccctgaggatgtttcgtgatgggtacctgcgcgatttcttcattaaggactgcatcacaccggaggagcgcctcaacttcatccaccagcatggtggactaccctaccctccagcattcgctccagaccctctgctgtttgctccactgccaccaccgacctgctcaggccatatggacgactggtacaagaggtttggtcctcaagatgatgatggtggcgatggtgccaatggtggttctgatggtgcagctgtgttttagcactgctgttgcttgcttctgtcgatctggtgccatgctatggttgtgatgcatcttttaattccgctgtgatgtttgtttaataacttgctctgattcatatcgggcatcgttcttgttgtaggccttaattaagttgtgtgtttcatgaacaatttcggcaccattaattagaactatgagcttgtgtgcttgaataaattaagttcagctgaaatttatatgccctctgttcacttcctgtattttgtagaagtaggtaattttttattgttaccctaactacatttacagtaccattgctttaatatgttctatacattaatccctgcctttcttgcaggcctttgatactttgatctaacgtttggactaatatgttagttgctttaatatgttctaatactttgatctaacgtttcgactaatatgttacttatctcaataactttcttgttttgcaggactatactaaattgaactaaccattgcactaatacattcgatatgttaacccctggatattttgtttgcaggaatttaataaactaaactaagatatctgtaaactgacaattctatttatccctagttagatgcattgcttcttttcagcacatagggtgctaactgtaccatgatattactttgttatctgttgatgtaggaaacatgagcacttcgtcagaaaggtcatatggttctgacgatggctactacagtgatgaagaggactccattctggacatgttggttgcggctttgaaggcaaggctaagtgtgagggcagcacgtcgggaaccgcaacaggaaccgcaacaatctggaatggaatggatgatggagacaatggcaaacccatccaatgccaagcaattttccgtctgatgcctgatcaaatccatgctctgtttggggtacttactaatcggtacaatctgcatggatcaattgaggtatgcctaatggaagcacttggaatatttctgtacatcatggcggggggcaattcaaatagggcgactaataataggatggtgcgatctgggtctactatctctaagtactttcatagagtacttaatgctatttatgcaatggctgctgacaaaaataagccggtagatccaaactttgagagagttcattatcgtgttgttaatgaggaagaatttctgccatttgctggtgcggctggtgcagtggatggaacacacattccttgcattgtggtagtggatgattccattcaacataggaactgtcaccacattacttctaggaatgttctttttgttgttggatgggacgaccgtgtcatttttgcagatgctggatggccagggtctgtgcatgaccaaagagtactgacagaagcagtacggagctatccctttgctttcccaaggctaccatggggtaagttttaaatttaatcttacacaaatgcaaagctgactatctattttcacaaaaaaaaatgagtttgcttattttttggtgcagggaaatattttcttgtggactcaggatatgcaagccggtatggattcctaccatcatacccacattttttgtaccacttggatgaatttgggggtaatacagaagcagccttgccgcatggaagggaagagactttcaactacatgcacaattcactgtgtaacacagtggaaagggcatttggagtcatcaaaagccaatagagaatcctgagggaattaccttacttccctaggagtgacgatcataccaagattatacattctgccttcgctctccataacttcaggattgacagctccgacactcatttccttacacaaaacccattgtacaatgggtacccaatcatttcagacgctccacctctacgcggctggtacgatgcacccaacagtgcggaagtaatgaatacagtccgcgacgctattgccgatgaagtttacaactagttggtttttagggcgcaccgtttaaaataaataacatagccatggctgttgtggatatgttatgtagcagtctgtgtgtttctatgatctgtctgttcctgcatgtgttaagtcagtgtgtttgtagtactgttttatttgtctaattttcctgtacgagactattatgattaatgcgaccacctttgtgttaatctctccatttgatttcgtatcttgcataaattagcttttagcatccttcattactgccgtgattcccaccagcagtgcgtcggcctcagaacagctgctaagcagcctcagcaacatctccaccgacggcctaacgtccatccaacggcgcctcctcgctccgttcctgctctgttggctcacgacagtactttgcttcccagctgccgtcaatcgtactgtagtgcataaagtagagatgaccattaaatttctttggatgaagccgttggaccaaacgaacgagcccgttgtcgtagaacttaaatgttgatatgtcaaatggcaccctaataattatttaattgatggtcccttgcccattaatctaatgttattaaaagctgttcaatcacataaaaaggttgcatcttgccacaaacactgctaatcggtattagagcgagtacaatagggtgatatacataggttgtacaagttaccacatcatatttgtgcttatgtggatgagacaggagatgagagaataaaagcgggctgcaaatttatagacagctgcagcatgagctagctccaataaattatgtgacagggatgtgtggattagttgtattaatgatgcaatatataattacaactaactattgtaatgagtgagctatttggctggctatatatgatattttaatttttagagtaagtagttggctacattattaaactttctcaaatacatttactccctatatgttgattaatagaacatttcatcccttgagtagagttggtgccgctcaagtcaattcaatgaagccattttgccgtatgtttcatcaagtcaattcaatgaacatttcatcgatcaatagttcattttagttttctataggtgaccatatgctcttactttcttacacaccacccccccccccccccccaacacacacacacatatagacacacgcaccgtctgaagaaaacaaagcaggaatagcttataccccttgccacattcattttgtagtactgcactatatattcatgacccactttctttgttttttttcaaaaaaaatattttgtttaccagagttgatttcggtgcaatatcttgactatctagtctacctacacacctttatctatttttatagtgaagctccatgcatacacggtgcactcactaattaaggagtaggtaggtaattagggatgagcgacatcaggaaaacatatagttgctctgatgatctggaatgatcgcgatatttggtcatctcccgttgcacaagtgaaacccagtgagcaaatcactcctcactgcagttacttgttctgcatattggagctaccggtatacttttgttccctagtcgcttattttgctttacttttaaaatcctttctttgcggcttaagttactttccaattcgtagaggaagaaaggattaaaaagtctgtacagttagatactatacatgcttaagattggctcaacctctatgcatgcatagtaactgctgcgcttacactcttcctcggttcagtattccaacctgattggtcatgtcgttgaactaatcaattttgatgggtggatgagttgtggggagcctgacatgtaaattgagaggagagatccagagcaatggctccgtgtagcaaggtactaataaatatactagtacttaatttgttagaattaaaaggactggacccagtttaattccagcaatttcaaagcctcattatttatgttaagagattaataataccttgaaaacaaatgagatagtccctgcattccaaattgatctacgtataattttcttgaggttattcctaaatgatctatatatttgtgttcattcattaagtctattccttatttgtgtattggagtaaatgaacattgatgcatacatccatgcacacaagtatttataacatacatgcaatatcttgatttgctattggctagaaaatagtgaggatggtgcatgcatcgagtttgttgatagagtaaatatagtatgagagatttattagcttttttttgtcttggtatacctatgaaatatgtagatcaatttggaatggagagagtagtatcacagtatggctgcgttcgtttcacgaggttcccaactcatctctcttgtttttcgttcgcacgcttttaaaactgctaaatgatacggtttttttaaaaagtttctatacgaaagttgctttataaaatcaaattaattcatttttgaaaaaggaatagctagtacttaattaatcaagtgttaatggattactccgttttccgtgcagtagagttgggttcctaacccctaaccccaggtatcaaacacacagcctaaattaactactactccgagtccagcaacacctccgacgagaccggcgctacctccatctccgagtctggcaccacctccatggcgcgagcaagcgaggcgagcgggtcagccatgaccgcgagcgcgatgcgagcggcggcggcgagcagtggcggcgagctcgacgcgagcagcggagtcgagcgcgacgcaagcggccagagaggtgtgctgcatgcgggagtaaacgaagaggcttaagaattggaactcggccagagagggcgtgctgcatgtggcgcggcgttgatggaaacgaggcgagcgatacgaagcgtcgcccttcgcgcgagatttcaggagctcttttgtaatccgctgatcaatatggaattttctgtttttcaaaatatgtagatcaaaatcaaaagagaatggagggagtaattgagagcacctttcagcggttgagttggtggtgagaatgcaacgcgcacgcgcgtcctagagctggtcggggcgtggcagggtggccgctcgttttcttcacgtttctgtttttacgagaaagcgaaaccgatggacactcacgtttctgttacgttactctcgttactctggtaacaggcaagttcatgaatatcgatcaatcacgattaattcagagacgttatccacctacgggataaacagagaggaactcacttctgttcatctatctgattcttcgttgctacacatctcccaccttttgttctgcacagctttggctctcccacacgagtgtttaggattgccttcaaaactctgtcaagcttgagtacctacacagctaagcggacgattcattctcagctaagcggacgattcattctgattgaattagcagcttaagggtgtgtttagttcgcgaaaagaaaaatttttaggtgtcacatcggacgtttaaccggatgtcggaaggggttttcggacacgaatgaaaaaattaatttcataactcgcctggaaatcgcgagacgaatttattaaacctaattaatccgtcattagcatatgtgggttattgtagtacttatggctaatgatggactaattaggctcagaaaatccgtctcgtgatttccatacaaactgtgcaattagtttttctttttatgtatatttaatgctccatgcatgtgttcaaagattcgattatgacgttttttgagaaaaaaattttgggaattaaacaaggcctaaaggtgaaagttttttgctactaagaacatacacaatagcaggctataagccagctacaaatatattttaaagagataaataaggagagagaagaacaacgggctacagatttatagccagctgtagcacggactccaagatgcactgtgtgtatgttaagtggggccagatattaatagtatagtatataactattgtatgaatgagctattagattggttatagatgaattgaagctagcagttggttatactattaaacttgctctaatacttatttcatcatgggcaatatttgtgcactgaatgactctttaggttgctttctttggaatggttccaactccctcttgtcgtttttcgtgtgcacgcttttcaaactatcaaacggtgtattttgcaaaaaaaaaaatataggaaagttgctttaaaaaattatattaggccctgtttggttccacacacaaattttacaccccgtcacatgaaacgtttaaacacatgcataaagtattaaatataggctaaaaaataattaattacacagattgcgactaatttgcaagaagaatcttataagcctaaatgcttcatgatttgacaatgtggtgctacagtaaatatttactaatgacagattaattaggcttaataaattcatctcgctgttactgacagattctgtaattagtttttttattagtgtccgaatatcctatataatacccgacgtgacacgtcaaaactttacgccctgatctaaacacccccttaatctattttttaagttagttttaattaatcatatgttaatgtgcttttccgtttcccttgctgaaacggaaggttccaattagcacaaaagaacaaagcctagagtggcttcaattatcacaacacatcaatttactgccccgtgcatataaacagccatgcgccgccttctttttccttcacttacttctccgcccacttgcttacttcttctctcttgggttctagtactagtctggatgaggataccaaattcatgtgctttggacactcgcctggagtatttaaccaggccaaatccatttcataatgtcacatcgatatcgatcaatcagcatggccatcaacttaatttgatgcatttggaagaaaaatttctctacgttaagcaaaattataccaagattacgagaatgtatttaaacttttacgagtagtagaaaagcaagtcatatgtcttgccaaacatgtatcaaagagtactggagtcaattttggataaataaatggcctaaaaccactacaaggtagggatcttttggttttggtagttgagcgaaagaatgaacagtactgcagcaaaccaggtaatgccgcttctcggggtgaacagactataaatagcggtcacgtatttcattagccagcatttcaaatagaagatagaacatgtcatatgtgcacaagacggtacatatatattcttagaatgggaagcatcaaggattctaaccacacggaccttcttgatgggtctataattgatttatctacaggtagtgtttgaaagtgaaattgctacccatcacaatctacaaaggactaggctattggagtaattggaggggtgggcattgctttggggtcaggaataaccgggaacaacaattggaactgcaatgttctgaagaatggagaatttatgttagaaagcatgtaatgtacattattatcgaatgtttgtcacttccagcctgttgtcctagctagtcccacgagttctaccatcaataggatatttcattactttagtactccccccaccccgtccctaaatataaaggattttggttaaaagctagtaacacatcctaggctaatgaatctgaacatgcttctgtccagattcgttgtactagaatatgtcatatctcactacaatttcttatatttaggtacagagggagtatccaataaaaaagaccatatgtggctgggtttcgcgcgtgggttggggggggggggcggcggattatcatggagcgtacatatgaggatcatgatgaaatggaacagtcaacatgagcagggaatagctgaacagctatactgttacggggccacgaaacttacatgcatgggttgttttgtgattaagcgaatttagttgacttctgtgacgcccctatatttttcttgaggcattcaaagctattttagtaaagtaatcctcatttcaaaatttttgttcatcatatgtattatggtcctagtaccgaatatttttatcgaaaaaccaatttttcacatacgcaagtagactacgtaaactttttagacagctgctaaagagaaccacccgcacaaagaaaaatcgctatattaaaagtgcaccacccagctatgcaggcagctagccccatgcccccatctttctaaagtacctcaataccatcctctcccagccaaaagtttcaaacctatcctcacgcactaccacgtccttcattccctctacctaccatgcatacaagctagtggtggcggggttcaacagcggcaggtgctggctcgacgaccgagcttggtggctgcggggggcttgtcggcggtggaacttagtagctgcggtggctgtggggctcggcatcgtggtcccatatccaatagcctcactattggatccgtctatggcttgcctcaggtgctactgtgtcggtgatagttgcgacagggcatcgactgcgaccatcatttcctggccagaactgagattgttccgatcttcatccacactggcaggaggagctcgttgaggagcgcgccatggtggtggtggtcaagaaaggaagcggcggtggaggcagatccgatgatggcgtgcctgaatctagcgatgacctcctgcaacgacgacaaccatcgaggcgctgcttctaggatgttgttgatgttgttattctttttttgcatgttgatatttgcatgctgttcagtgatgatatttttaaggtactaacaatgatacttatagtacgatgatactaagtaccaatgatgaaactccctgtttagtgatggtacctatcaggtactaatgatgatacatgtatgtatcgatgatagtacctaccaagtatgagtgtatattacctgctaggtaccggtgatgatacttgcaggtatcaacgagtgactatacattaaaaggtagtggtgagtgacgatatttgcaagatatatatatatcaacaagtatgatacatgtaggatgaggtatatggcccatcaaaagacagctctagcaggtctcatcagactagttggtgaactgataaactctagcaggttcttcatggctgtgcttatgcacggagtagtgtaggtacagcctaaggcctctcacagtgcaagctatgggacccatacccctagcctaaaaagttgacccaaagacacccaccccatagtgtaagcacccatatatgtgtggttaattggatggaggcactggtaaagggtatcaagcccacagtgggcgtgaccctaggcgcgttactacagagcggaacgaaatttatttctctcaactacccttcagcgtggtcctcacctactactcgcaagagtattcctgcacctctcctcggcacgaccgcctccttctcctctctcccgcaccaccgcggctcctcctctcctcccacgccgccacgcctcctcgcctcccacgccgcggcagcacgcgggggatgccaccgccgtgcgcctcgcctcgctgtcgaccgcgccgctcgcttctcctccccttcactgtctcctccttctttgtcgtgctctcctccctcgcgggggacgcctgggacaccgccgccctgcgcctcgccttgccgtcgaccgcgccgccagcgccgcacccactacatgctatggcggtgaggggggacaccggggaggtgaggtgccgacgccgcggtgaccgacgcgcactggaggactcctctcctcatcagtacgtgcgcgggctggggaggcgaagtcggcggtggcgctagtggacatgagcagcgctgacgccgcggcaactgacgtgtgagggaggcgtccccgggaggcgccggcgccagtggttgccgcaccgtcagcgtcgctccccacctcattgtcgtcctcctcgtcatcggagtcggagcaggcggggttgtcggagtcgagcatgacccagtcgtcgtatttttctatgatggttttgctttctttttcttttttatcttgttgaatctgatttgttcttcttttccaatccccaagattttcttgccttttctcttccaatctgatctgtggtgggagaaataatgctgtggcgggaggggatttcaggagggcgaatcagggattttgctgcggtgggaggagattttgggtgctagggcacgcgagcgcaaggctacgctgcccacagcgtgcgcgacccgcgtcttctctttgctgtgcaccctcgttttggcgaggttctgcgtcgctcacttaggggccgagaaacctagctgaggcgcggtcgcccgctccatgttgacgcgaatccgccgtggcacaacgagatcacgcgccagctaggagcactgtaagagacctaggtaggcaacgcgtgaaggtgctgcactgctgttattgccgtgagaggagtcatatgcggatgagcgcacgtcttgctttcttatcaaaattagaaagtataccgttttataatggtataccgtcatctagcagctctcatactgcgttaactacagtaaaattgaaagtatcaagttaactaataagtaggccgcttataaatctagggtgtagctatatttatggcaccatatttttcatcaaaaaatagtcggcatgtatttacattgtaagtccctaaattacatatgtaattttagtgtatttataatgtaagtctcaaaattacatatgtaagtcaaaaattacatatgtaaattcaaaaattacgtactaattacatatgtaagtggggtgtaaatgaggtgtaactaatgtgtaagtggctgaaaaaaaatcgactgtagtatatggcgccatatttctagcaactccgtaaatctatctatctattatatactaaaagtcaattaaacttactataatcgctcctaagccgccacatggcatctctacaaacgctcctagactgccaagtggcgtttaaaacatctagccattaattttcatttaatctggtggacctatatttttaaccgttatatctaaaaataccaaatatatttaattcatctttagaattcagaaagccacacgtccacgttgatcgatcgctcgtgtacttgtacgctcatgtgcgtatacttcgttagtgtacgccctccccccctccctttcttttattttttctttttctttttcactcccatgagataaaaaccaaataaataatttcaaccaaataaatagggagtagctgatcctataagcactttacaacattgtcttaaatttattacttatgtattaaaaacttaatatgtattatgcaatatacttggtcaatcctagcctaaaatatcaatcgtatatcctcactgatccctatatatgcaagttatatatataagtcactatttactaatcaccaagtcatattacttacggggtgttcatgcacaatgcacctaacggccggttagctaatatctaatgagcaatgagcatgtatgtcatcaaacaccgaagataaagagcaattctaagtgtgtaatgatcaacaaattataggtaagtagaggatgcaaccaatccatcgcaaacaatacttgactacaggtagattgtgactatgagtaatagtatttctatactcctacaaacacttctaagatgtcatgtgatgctctaattagaactaatctaagaaaaactgtaaaataaaataaaaataactattcatcgatttacactcaaaatcggtgatccattatttttcaaccattaaattagatctataataataatccctctgtctaaaaaccatctaatcccttcttacgtacatacacagctaccattaaattagatctataataataatccctctgtctaaaaaccatctaatcccttcttacgtacatacacagctcctatgtacatacctatgcagatatataaaaaagaaaaaaaaagaagagtgtgtatatgatttgtctcatatggttgttttccctttctttccggattaaggtgtttttctaaattgagcatatatgtagtgatcactccttgccatggcacagtctcatgccaccctcttcccatcaaatttttaaaaatacttttttactaacaatttaaaaggcaatcacatgagctcacataaatgcatgcggacgcacatcatgaatacaaattcgcaaacccaatttctatgatagacaaatatttatccgaaaagaaaaaaaaacaaacgtccatactagaaactactacgctagaaaaaaacaaacatgtaactacatttatctcttttttttatgtcgtccccatcaaaatagtgttaacattttgcacaaataattttaataaatttcatcaaatattaatccccacaaacatgaattggtgaattagatgtataatacacgaaaaaaataaaaacttatattaacttgtatgtttgcaaaagatcacagtttgagaaaaaaaattttacgtggtcctcaccatcgaagctattagatttttcgaagtagagtccaatgatcaaccctgctaatttttaaaagagaaacttatatatataccactaaaatttagtagtatcgattaacaccataaacaaactatatatactctatataataaatcaactcaagacataaaaaaactattttcatcaactctattttctctcactcataccctaaagggtgccaagcatggatctcaactggctacattgtagtaactatggcaggagtatgcattattgagctgaagtcatcttacccaaactgatctaccttattttaaactattagatctatatattaaaaacacctactgatcgatcaggccgtcagaggccgtcagagtgcgtatgtacagcacatgtttccagttccctgctcacggactaaacaaacccactggatctctcgcctctttgttttccttacaacaattaagttaaccactaaataaaagatcctaaaaattaccctgaaaaaaatatccaccttaattttttaataaaattggtagactaattacttcataccattagacatctaacgactttctaccaacttaattatatttcccaacttgtataccgggtctatttaagctaaatcaatctataaggtacaaataaatccgtctatgaatgaagctcttttttattactatatatctccgtcttataatggatcttaaaattttataccccctccatcccgaaatataacaacttttagcacttacggtacattaccaccaacattcacgtcccaaccaatcacaattctccgcctttcacttttctcaccttccttcatttctcaacccaacataacatctccctattaattctacttactttcttaataattgtatccaactctataacttcttatattctggtacggagggagtagaaatcaaggaggaatgaaaaaaatactatgatacccatgattaaataaggctcattaaataaggggtatgtagagagttagaaaatggttagagtaatgttggataaaaattaaatgaagaatgaccagatggaacgagtagtattaataattccttatattttaggatataaaatttaaatccttcgatttatggatggaggtagtagaagtaaatagaagtacatgagtatttgtttaattagataaagaagtcatattatcatatttttaatagaaaaattcttatattaatatatcgtaaaatctacaaaggcatattttgtatacaagaaaaaatattaattaaaagtttaaactaagatgctaaatatttttaaaaataaaaacatgtagtataaaaataatattttcatatgaaccagctccattattgtgacatatttttctcataaatttaagacgacatgatgcaagtaattttagtttacaatttgtaacagcccattcttcagaacaaggcagcccagcctccatccaattggcacgcttacttataaatattaccccacttacactttcattctcgcttcgcataaaatagtcaacccaaaaatgatatggttggagggataatgccttacaagttggctacactcttgcttaaatagcaagatagtactactaatcatgtgcacacaatgcttatggacaacacatatcaaatcctttcaataaaaaaacatagaccacatcctaattgcactaggatgtctaagacacccccctcaaaggatctgacgttcccatcggtccaacttacctctatagttacatatgcatatagacaaatatccagaaacatgttccctcttaacgcacgctcgtacgtccagtgatcgaaacaaacttccaaaacaatccaaaaaaatattgataaatatagatttagaagagtataaaaaaaatcctatacataaacattcatcacaaaatttcaaacactgttcaataaggtgcccgcgtatttgcgcgggctaccttcctagttattatatactaaaagtccgtcacgtggcacccatacaaatgctcctataccgccacgtagttctctaataaattagaagaattataaaaaaaagcaaaacatctggccgttggtttttatttaatctggtggacccaatattatttttaaccattagatatagcataaaaatgtcaattagatttattatctttaaaaagccacacatggcacgtacgtgtacgtacgtcaagtacgtacatattttgtacgtgggccccatgtcttctttttatttttctttttcacgagcacatgatgagaaaaataaaattcatatttcagcccatatagttcggagtatgtacgttgcacatgagataaaaaccacattaataattccaggcttcagcccatagttgtacaaatataagttattttgagttgtattgtactatacgcacgtcatcaaaatatttataaaatatctaaataagtggataatatacattatataattatataattgtatatcacttaataacatgtattgttaaattagaaatgcattttgaaaaataaaaacaactccagttatgagtaacattaaaaaaattactccctactataagaaaatactgttatataagaataatattactaaattattataattacactctaccaatcaaatacttaataattaaaaaaattaccaaaaatataatataaacttggcaaatattagtgcactaaccatctacactattcataaaaataaggaaagttttttttattaagtatactattaataattttaatgttatgatttaaaaagtaataatattatttatttgttaattttttattataccgaataagggagtaactaatcccagaagcattttagaacacactcttaaacttattacttattacttagataccaacacaatatgtactgtacaatatacttggtcaattctagcctaaaatatcaatcgtatatcctcattgatcccatataccatatatgtaagttttatatacaagccatattcactaatcgccaagtcatattacttatgaggtctctgtgcacagtgcatataacgattagctgagatctaatgagcatgtgtctcatcaggcaccgaagataaaaagcaatactaactacgtaactgtcaaagaggatgcaaccaatccaccgaaaataatagttactacaattagattgcgactatgcgtaatagcattcctacactcctatagacgctcataagatgtcacgtgatgctctaattagatagaatctagaaaaagttattaaaaaagcaaaacatctatttacactcaaaatcggcgatccattattttcaaccattaaattagatatatgacagtaatacctttgccctaaaaactatccaagctgtacttatatacatacacaactcctacatacgtgcacaatagataaaaaagaaaaaaaaatagtatatgatctgtcccatctagaagttttcttcctctttccaactataaggtttttcccaaattgatcatatgcatagcgaaaactcctagcgatatggaaagagaagacatgccatgacgccgcctcatgccacccgttgctctaccctcttctcgtcaatttacttgaagtattttttttactaacgatgtaaaaagcaataatatgagctcgtctaaatgcgtgcagatgcactctatggatacacttacatacatgatggacaaatattccttcgaacaagcattggtgaaatagatgtataatataataaaaaaataaaaacttgtattaactcatatgttagcaaagatcacagtttgagcaaatattttttacgtggtcctcaccattgactgaagctattaaatttaaagtagagtcgaatgatcaaccgagctaatttttaaaagagaaaataaattatgtctactctatacaataaatcgactcaaagacataaaaaaaaaactattttcatcatctccatcttctttcactcacaccctaaatgatgccaagcatggatctcaactgacctacttaccaatacaatccgttataaaattatactctacgcttatctttaggagctcgactatatcaatgcggaacccaagaataaaggcatcaaagaaaaaatcttaacggctacaatcggcttcacccgacttttagagaggcattcatatataagtttaatgatttcatcctgttaattggtagaagcggtatatttaaatatttatatatagatttggatacctgtaagtcatgttatttggaatgaggtagagatgaaccttttttggtattaatgatgcattgggtttattttttggtacatatataattctatcaattaaaaagaccttcatattttaagacaatgatagtaagtagtggtgatgagtgagaacaaaaagatttttgtttggatatgatagatattcatattatttagtatgtcaacatttatggtttactcccccgtcaaaaaaacccacttttgaatttgaatatggatacatatgaccagattcaaacatagaagtgagtatttttttttttgacagagggagcattctttatagtaaatatagcgaggcaaagcttcatttagttttttttataaacagtaaataaatttcccgtatgtgcgcaggctttcttcctagttattaagtaaaaagcctatatcatcctaccgttgtctatatctcgttattgccagttgagatcaaattatttaacctctgctatatatctcgtgcagcttctctaatcagtacttgcggctcgtcaatattttaggcctcacatcttggactgttgtagacgatcgatagttatggtatgacggctgcgttgacggggatagatatagatgtggtagtaactttttgccattcaaagcatcacgtgtacatctgatctcacaagatcgacttttgtctattttgcttaaacttctcaggtcacaaccacgtaacaatatctgatctttcagactttgcactccaatggccaatatacggggtcgtatatatatcctatatatacacactactggagaatcttttatagtcctggttgggaacccctttttagttctggttttccaaccggcactacgaatccgggactaaagatgactcctaggggcagcggcaatccggttagtttctatttttttcattgtttttttttctagtgattttctcccaaatccagaggaatgcatatccccaaatcaaactaatattccaaataccacaaattaaatacatcacagatccatgcaatggatggcagattctaaaaaaaagaaattatacatctcaatccatcaaatgaatcacaaattcttcatctcaatcaatacaatgaatcacaaattcttaaaaaaaaaggacaaatctccggtcggcctccatgcatgcatatgccgccactcccacccgccagccgccactgcgcccgcccggcggccgccgccgccgcgccctcccggccgccgccgctcccacccagccgccaccgtgcccgcctggcggccgccgccgccacgccctcccagctgccgccgacccagagagcaagagtactagtagagaacttcgtggggaggggcaggagagaggaagggggaggaagaggagaggagaggggaagtgcatgcgcttggttgttggatcgagatgagaaggataaggccgatattaaacagggagagaggaaggggaggggatcgataagtctcggacttggcgcgcgcgcggctcgggaggatttttgttgttcccggttggggtatatctaaagttaattggggcctaactagatctggtaacttctttgaaccgggactaaaaacaccaaccgggactaaagatcaaaatttttttaaccaggactaaaaatgatctttagtcccggttactattcgaaccgagactattgtattttttggacgaccgacaaaatatggtttctccagtagtgacacaagctttccgtacacaccaactagtaaatctttactattataaaaattgaagatgtttttgcctcatgctttggtaagtcgcccgacttccacacggcctccccacacctccattttctcctggttttttttcaaccgcagtcctataagttcaatttggtttcagtcaggcgttgtccgattccccagctctcacaagctacgcaacgatgcacgatggatgagatcacgtttccacgcagtggtgcaaaatccggttcatttacgttccgaatcgcctgaattagagcccgccgatctatgtatatactataactatatacacacacacagatatactccctctgtttcgaaatgtttgacgccgttgactttttagcacacgtttaatcgttcgtcttattaaaaaaatttaagtaattattaattattttcctataatttgattcattgttaaatatatttttatgtagacatataattttacatatttcacaaaagtttttgaataagacgaacggttaaatatgtgccaaaaagtcaatggtatcaaatattttgaaacggagggagtactatacgcaagagtatcgtaagtacacacctgcagattgttcgactgtcgacgagcgcagttggttgaggctgcgttttgattagcagctaggaagcggccgggtgcgctccaaggcctgaggccgatggttcagtcgtggcgaggcgaaccaccaaggcatgcacctgccagcagcaacgacaagatctactcatcgtgtattagatggatacgcatagaacaaattatttagttttcctgccatctagacaacttgagtttttgtttatagggcaatcgtcagatgaattctttacatggagaaaaaaatatatttttggttcttactgcctcgttttttaatatatgacactgttgattctttcaccgttctttttattcaaattttttatataaatctttactattataaaaattaaagatgtttttgttggtactttgatatgtcatctgtgtttgagtcggttttaaattcactcgcttttggaaatacaaatccatgcttgagatggttttaagttcgttctctaaatacagaaggagtcgtataagaaatggtaacttgagacgatcaaactcttaattttagctcataattttataaaaaaacaaatccaagcaaatttccacggtgaatttcaccttagctaaaccgtataataataaggtaattcaaataacctcctcgttgcaacgcatgggcattttttatagtgttatacaaaattttaaaaaaattagacgcatacttctaataatattacacctacgtgcgaaatcttatcttcaaattcattatgttttagctgtaaaaaaaagataaaattctgacagatttttatccttaacactatcagattttttaactttttttgttacggctaaaatataatgaatttaaatatgagactttgtagatatgtgtaatactattagaagtaaatgtccaattatttatagacatttttgtgatatttgctagtcagtgtgcacttatattcacagtatatggaagttcttacccctaatttcaattttaattctaattttaccttaattttgtaatattataatttcattccgttttctcaacttaagcttgtgtttgctttgattttaggaattaacggtgctcaagcttgtatgtacttccttcattttataatatattataagccgttttgatttttttttcaaactttttaggttttatcaagtttatagaaaaatttagcaacaatataagtttgacgtagaaaatagcaagtcctgataaatagacaaaaacacccaatgagatgatataagtagattagatcatgcaatgagtagaaatgcataattacatactactatactagcaatatacatccttgttcttattcccccatatatagtagtatgtaaaccatattattgatataacgtacggcatccaactatacctttcatacttttttgcattcattgaacaaactgcaggcagttgatttcgatgcctagtcgaagaaaatgtacaacaatgctcacgcaaagtcaactatgtgaacacgaatcagatcgtagactcgaacattttgcttcgatgctttgacaattatggatcaatgtgtttcatccttttacaggagatattactctctccgtccaaaaaaaactcaacttctggagtttgaattttgtcccaaaagaaaccaatttctatcatcctacctacccttagcatataaaacgagaagttttatctctcgaaaaccctgtacccacctatcaccattactaattttttcgataatgaggagcattttgatcatctttactcctcactaaatttgtattggaatgctctttttggacggagggagtaggtacaaagcagacgcagaacaagtccactgcagaattatataaaatcgaatcactggcctttcaatcgctagactggactgtgtccaatattacttattctaaaccatattattgatactacgtaccggtcgtactagcactgcaagtcgcaccagctgctacaaccataaatctaccacatgaatacatatactacctctgtccgtatcattttaaatgcagttatgggtttccatgtttaacgttccgttttatttgaaaaaatatataaaaaatttagtcaaatagaaagtactatttatgtttgatcatttaataacaacaaaaaaaatactactccctctgtttcacaatataagtcattctaacattttccacattcatgttaatgttaatgaatctagacatcaacatgaatatataaaatgctagaatgacttacattgtgaaacggaggaagtaataaaaaaactgttcaaataagacggacgattaaacgttggacataaatagtgtaaaactatattctttatagatcggaggtactccctccgtcccataatataagggattttgagtttttacttgtaacgtttgaccacttgtcttattcaaaattttttgaaattattatttattttatttgtgacttgctttattatctacggtattttaagtacaacttttcgttttttatatttacaaaaaaaaattaaataaaacgagtggtcaaacgttgcaagcaaaaaaaactcaaaatctcttatattgtgggacggatgaagtagtatatcttcgtgttggaatacaggaataccaagctagccattttccttccattcctcaatagcaaagtaccgatgaataatgacgatccacacgaaaacggctctgctatgcctcctaggcgccgtagcaactacggcatggctctccttcgccgtcgcgcaaccacagccgccgccggcctgccggagaagatgcggcgacgtcgacatcccttacccgttcggcctcaacggcgatgcccccggctgcgccctgggccacggcacctacggcttcaacatcagctgcaacgacaccggcaacggcgtgtacaagcccttcatctgggacgtcgagctgctcggcgtcttgctgccggaaggccaggccaggatcctgatgagcatctcctcctactgctacaacccggccaccggcgccatggacggtcccgaaaacaacacctgggcgctcgacttcacctcgtcgccgtacaggttctcccacaccggcaacgtgttcaccgccatcgggtgccgcacgctcgcctacatcggcggcgacaacgtggacgccgacgtcggcagcctgaccaccgggtgcgtggccacgtgccggctgcaggccggcaacctcaccgtcaccgacgacgacgtcggcgcctgctccggcatcggatgctgccggacgtccatccccgtggggctccagtactactacgtctggttcgacgaccgcttcaacacgacggccatccacaacgtgagccgctgcagctacgcggcgctcatggagaagtcgtcggcgtcgtggttcaggttcaccccggcgtacgtcacctcgtcggcgttcaacgacaccttcaacgggcaggtccccttgctgcttgattgggccatcggaaacgagacctgcgagcaggcgaggcgagcgagtcccgagtcctatgcgtgcaggagcagaaacagtgagtgctttgactcgccaagcgggctaggctacatctgcaattgttccaagggattccgtggaaatccttacctgcacccagaagatcccagcagttgccaaggtgaatgttcccttttcttgattgaggaattaaaatagttgctgtgttagttagtttggacagtaacataggattaattaggtaataatcaaacaacaaacagagtattattaggttttaattgaggatcagagcaattaattaatttagacttatggtgtttcttatttgtagtatttgattttgttaaaaggacaccttagtattatggacgtgactacacagctagtggtaactagtttgtctaaaccagctaccagttcatctatgagagacattatcaacctatatttcaaatacaattttctattaaactactcatccgatttatgatccgattgcaccattatgtttgtaacaattaaatctttaaaacaagatcacacatgattatattttgataaaaaattataaattacttttataatatatctaaattactttcaaatttcactaaattacttcttatacatgtaaaagtaaattcaatgaagcctaaaagtaatttgcatatattatagaagtaacttataaccaaaagaaagtaactttaatgaatgtcttttttaattggatgtgactacacagctagtgatagctagtttgtactccatctagtatctcctttcaacttgaaaaatacgatagtatcttcttttctcattctatatgaaaaacaaaaatgaaagaaaaagacaatcaatgattaaacagatttatagagagctacttttgaaccatgcaaaagttacttccaattaacattgaaattacttttaaaaaatattaaacttatgtgtgttgatctgtgctgattaaatttaatttctagataaagtcatatttttatccctacgacgaatttacttctaatgtcgtgacaaaattacttccgttttgttttaagttacttttataatatatttaaattacttttagactctattaaatttacttttatatgtctaagaagtaatttagtcaactctaaaagtaacttatatatatgataaaagtaacttacatatataataaaagtaatttacaaatataaatattttttcatcgtaatataatcatgtaagatattgttgtgaagatttaattgtaacgaacacaatggtgtaatcagattgtagatcggataagtaatttgagagaaaactttgtttgaagaggaaaaggacgtacatgtatattaaaaaaaatgcatgcatgtattaccatgtaatagctggacttctccacgtttctctatgttggcgtcgctagttaaggcaaaattgagatacctctctaaatagattttacatagtattatttagctacacattgtagacgcacaatctatttgatttggttcaaattaaacggacctttcaaaaaaagttccattgtctcgttcacccaattagggcctatttagttagcgaaaagaaaatttgttggtgtcacatcggatatttgactggatatcggaaaaggtttcggacataaataaaaaaactaatttcataactcgcctggaaaccgcgagacaaatcttttgagcctaattaatccgttattaggatatgtgggttactgtagcacttatggataatcatagactaattaggctcaaaagattcgtctcgcgatttcccccctaattgtgcaattagtttttcttttaatcttatttaatggttcatgcatgtgtccaaagattcgatgtgatgtttttgggaaaaatttttgggaaactgaatcaggcattagtttggatctcttgtgaagagaatgtcgatatatatatatatatatatatatatatatatatatatatatatatatatatatatatatatatatctttgtttttagtagtactgcttcctcctactctaaagaagtgcagtttgaactagtcaaacacatattaagaaaaaggttaaaagactaatatacctttcactactgttgacagtacactaacttggacccgatgtcgcgcacaagtcgtattgttggaatcggctatatcggcttatttagctcgactcagactcagccgatcctaaccgtagccgatctgaactccagccgtctttgtttccgaacttgatctccgcctccaactccgctttgatcaaatcctctttcttgacatagatgctaccaaatttgtttgttaacaactactagataattatttttctataagaggacctatataagttgtaggcggaccataaatgatcgtgcctttaaaaatcgaggctcattttcatatgcggtctaaaaatctatttatgcagacagaccacggcatgaaaagatgagcatattttttcatgtggttctcttaagtggctaaaactacacttatttagggctacagggagtaactgctaccatgaaagtgttagtctatacatgtttgttttggtttctatatttgctatgatatatttttcacttaaactctctctctctctctgtttaatgactaattgtagatattgatgagtgcacggatcagaacatgaataacaattgccacgggatttgtcgtaatactcttggtgggttcgaatgtatttgtcctgcgggtacccgaggcaatgcctcagttggacagtgtcagaaagtgctaacacatggagtactgttggctataggtataaatgcattacaattatgttttgtgtgtttgtatatatatgaagatgcttacttaatttactaatttgatctaaaaaaatcaggaatttgttcctcaacggttgttggccttctaattttccttggcatagaatggatcaagtataaacgtcgattggttagacaagatctcatgaataaaagggatgcatattttcgtcaacatggaggccaattattacttgatatgatgaaattagagaatcaagtttcatttaagttgtatgacagagaagaaattgagttagcaacaaacaacttcagggagagcgcaatcctcggtcagggcggtcagggtactgtttacaaaggttttgatctagatccagaaaacaatcctgtggcaataaagagatgcaagggaatcgatgcgaataggaggatggaattcggacaagagttgctcatactctcccgagtgagacatgagtacattgtcaaacttcttggttgttgtctgcagtttgaagttcctgttctagtatatgaatttgtgccgaataagaccctacactatttgattcatggccaaagcgatgcatccactagaacactagatatccgactggaaatcgctgcccagtctgctgaagcacttgcatacctacattcacttgatcatcctatttttcatggggatgtgaaatctgccaacatacttattggtgacaaatttactgcaaaagtttctgattttgggtgctcaatatttagggcagcggctgatgaaaatattaatgtagtgaagggaacaattggttatctagatccagaatacctcatgacgttccagttgactgataagagtgatgtctacagctttggcattcttcttctagagctcttgacacgtaggaagcctctatccaatgaggtgagcctcgcctctctcttccaagatgctatgaagaagggaaacattgatcatcacatagataaagaaatactacatgaggataacatggaactgctatacgaattcgcatgtctagcaagccagtgcttagttatggacagtgagaacaggccagcaatgagccatgtggcagacatacttcggcaattggcagatacggcgtcacaacaacacactggcacacttcagggtattcgctcactcagattattgggaaactcaagtggtagcatctcagagccgtgttattctcctgttaaaacaatggagtatgacagcaggaagacatctatgggcattgaatttgcaagataagggcatctgccatgtataagcattaaacttagttgcacaagcctatagaaagtttttgtctgagctacatttggcttctatgtcgctctgagattgttcaacatggaaggaatgagaacgtaccaattcccatgatagcgtaatatggtgatccgaacatgtaaaggtggtaaaacatgctttggcatggaattgtcaacactttgctgactgtacatgctatggtccaaaaccgaaaaattccgattcatttgtgctaaaacagatatgtccggacctattttctatgcttaatatcctcttacattctatattttcctcatcacacaacaaccttttattttccaacgtacgttttgccataacatgttatattcacggttggctttgcccattgtaacgcatgaatattttgctagttagataaaataaaaatttggtatacctatggcctttgcattaagtaacatctctgtttttctcttgttggacatttggtttttgctgaataatgtatggaaccactcatggcataacattccacagaatggcatagcctatctaaacccaacaacataggtcggcctcttggcaaccggcccgagatagcgaaactatggcttgctacgcgataagatcaccacataatgcgctacttctctcgattcacggaagaaactacaacgccgattggcacaaccatagctttgcgcatctggtccatatccaccagcagcggtgtgaacagagcatttatagatcgacgagtttcctgggtgaacagattgaagacgaatgacggagcagaaaataactgagtaccagcccagttccgtacacgtatgacctgatccattgtcagcactattgaggggagatacccgtagaccggataaatagggtattggggtacattggtacgaggatctatgcgatatggcatctagcaaacaagaagacaaggattataataaggattgtgctagttcaggccccttatcaggtatagccctagtacagtttatataatattgatatggaaaactatatagtacaataagagtagatgaatccgatgataccggcgagatcgtagtcgtgggattagacaagatctcccggcaagttggcttcacgtgctccggcttcgtagactatggtgggtatgctgccggtgagattcgatgccttgaaccctccagggggtacgccttttataccgtggatcaacttagtctccaagtagaactcggggacatcggactacacgcgatatagaagaaacccaaccctttccaagtaagacgtcattagtcacttgcctataaggatattttccatattatcttgtgatttcctttatcgtatacggaaatagatcatatcttcgatggtgtaccgtatccgcatattacataagtcataggataggagatatgccttatccgtaaccatgacagtagccccgacttcaacttaaatgagttcacgttgtcattcacgactacgcttatgttaacagtgaaatttggtaagcccttaagagaattatcacatcgccaatagttggattcctgctatattcggttaaggaaattaatctattaaaggaagcttatccagaagttaccgagttcaaggacgatgcggcatggcaagttatctattaattaggaagagtttgttagtttccttttatctttaggaaagtgtgtttagtgtcaaataatgactttatgtttagtatctccccatgggtcattgtaaactatctctcgatcaatacaactactctcggtgcatcgccaccctctttaccgaggtttttacttatcatccggtggaacttgacacctgacagagggctgcatcggttcagtttgatctccggcgaaggggtaagtactacgttccgctggacctggtgaatctatcggctacattgctgttgttcacggctgcatcgcttcgatctcttggatcgctctggtttcattgatttagccgatgacaacaaagatttcattgatttatctaatcttgtggattttatgacatcggacctccagtcgatgtctgctttaaccttcggatcaatacttattttatcatatcattgttagccgattggtctatactggattatattattgttatattatattatcatcagtcgattgcctcgacattgttatttacatcaagcgtcagaatctacatcggaattatagccgatagctcaaaactctattgctatcgactggtatcggcatcgactggaattactccatcggcttgtcagccgatcggctcattgatctgctgtttacatatcttgtcagtttgcaggatcaaactgactggcacgcccgtatctcatcaatattttggatctgcactagagctaagtagatctcccaggccagtgtgtgtttttcacatcaacacgctttttggtacgcccggtagaaccacgaattttatacctacatgtcttaagaagtcaatgccaatatcatggtcacagtggagaatttaatggaggaacagaggcaatagatggagcagtttgtagctgattttcaaatgcgttgtcttcaatgtttcatcatgacacaagaagggccaattcagaagactcaattccccaagccgatagttgaaatacttcaagatacagttgatgaagcggttcatctcgcattgtttaatcaatctagagttttcacggatacattacaaaatttgatcaaggtaacagttgatgaattaattaatcagaaaagccagctcagggggcagactgaagaacaagaacagtatcggcttgggggggcaagcacatcagtgtcagcatgacgagctacatcaacaatatcggccagaagaatataaaacacatcagaatatagaagattgggccgatagaattgcgaagttagtagaggagcagtttggacttagacctaaggaacagatccatgtgtatcggctgccatatcttgagtggtttgatagggttccattgtgttgatgcgaaaaacacacaccggcctgggagatctgcttagctccagtgcaggtccaaaggttattgagatgcgggcgtgccagtcagtttgatcctgcaactgacaagatatgtaaacatcagatcaataagccgatcggctgtcaagccgatggaatgattccagcagatgccgataccagccgatagagatagggttttaagctatcggctatgtgtttgatgtagaatctgatacttgatataaataacaaaggcaatcggctgatgataatgcaagaaagcaataatataatccagtagaaaccaatcggctaacaatgatatgatagaataagcactgatccgaaggttaaataatatatcgactggagatccgatgtcataaaatccacaagattagattaaacagtaaaatcattgttgcaatcggctaaatccaacttatatgcaatccttataagccaatgcaatgtccaaataactcatcggctgaaacctcgatgaaacccttattggcagtcaaaaagcaggctaggggttatggttctaaacacgacttagtagatcaaacttaactgatgcaacactaagtatgaaaagaaacataatatctagacaatcaaggcgttgactgattttttaggctgctgaagaaagtcgcgagcaagtaagcggaatgtcctgactctatgttctcggttttcgtgttgtcgtgacttggtctttctgataacttgtatatttgtcttcatagggcttctccggcgtcctccgcacacagagaggacaatgtcgcaacaagcgtggcgccagtggtcgtcgcagcccgcgcccctccacctgtcacccttccgccttcgcctcctccagcgctggctgccccacagacaggcgccgagatgttggctgagggccggcgtctccttgaagctgacgcttgagagctgcaactcgagcaggaactcgacatatgtcacgcccggaatttctatccaaaattccaaacgtttacatgtgtgtgaaccctcgtccaggaatcagctgaggcacacaataacaaattgataatagagtacaattattactctaattaataagcgaataaaatgtcattacagaggtagatagttcctctcaatcaataaagatctaagcagcggaaaaataagataaacggcgcagacgactccactccacaggcagcttgaccagggctacacctaatcctctacaccatcagcatcactgtagaactcttcctctgattaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaataattaaacaatattaatccaacgctatacaacataccctgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggccagaggtgtaccactgtacctacaagacacgatcccgcacatgttaccatgccccgaagtaccaccacggcactacaaagggggaaatcgtgacagtacccttcgcacaacacaatccaccacagcgcaccattcctggatcataatcactcccttataaacaaggcatggactccccagcgacccccgtgggcttatctccgccacttctcaatctggtgccccgcaatgatccatgctatacaaaaggtaaagccgttgcccatgctggcttgtggttggcacggttaatgtttcacaaccgaaactcgtgaaccggtccttaattgtcatgagcacgaccatcaaaaccatgtgctcacaacccacctttatcaagttttatttggcaaattaattaattaaccaatcacgattgaccatcgtgagcttccattaaatatccataagtgatagtgaagcatgatttatcccattaatgagctaatgtttctaagcacggctaagcaactataaataacatctagctgaaccaatccaatatatatggtccatgctagtcaaattataacccataggaaaataaagtcatcttcggccataattaaatgggaaaggctcaccacccaatgacattcgagaacaatgcataagttgaaataaatcaatagctttaaacaggttcaacatgctcaaagggttgtttgggggatctgtgtgacttgcattgctggccttggaactcttcaaattcttctcctgcaaaaacggactctccggaaacgtcggaatctaaacagaaaggagcaaaatcaccaaaacagcacacaaacaagcatgaacagtacatgtggttatttttaacatgtagatctcaattttggaaaaatttagagacttgaaccaactaaatccgagctaagatgaattagttatgaattttcaaagattaaatcggattaaatcatttatatggattttaattgaattatgacgcaataatgaattatttttgaaaaggacaaagggaattattgcgtcagcggctagggttcgcgaaggaccaggtgcacggcggtggttcacgagattggacggccgagatccatccatccaaaacggacggccaagatccatcggtccacgaccaggccacgggggacgacgacgatgacgtcagcagtgacatcgccaccggcggcggctcgggcgtgcatgctcgccggcgaacgacggcgcggcggcgcgaacggagagcacctacgggtagcggacggcacggcgaactcaccggtgaccaaagtagcggcggaggagcaacggacggcaccggcgatgaggaagaaacggcagcgaccttcggcttgacgacggcgacggtgttccggcggtcgacagcgacggcggaggggcggacgaggtcagcgacggcttggccatcacgacggcggctttcccgagcggcaacgacgactggagcgacggcggcgcacggctggagcggcggcgacgacggcggcgcgaagctacacggggctagggcgctacgggcggcggcggacgaagacgagggtggcgacgggtagcggcgggcttgggggtgcttaaaaaggggctagggcgcggcggcgaaggcccacggcgaccggcgacgcgaaggaaagattagggttcgggagagagagatgaatccgattcgagattgaatccgcgaatttccaaagcgatttagacgatgtttccaaaagggaaaaggtagagtggatcacgaagatcatttcccctctattgatttcaccggaaaaggaaaggggcggctgaatttggaaggagacgacggcggcgcggcgctagggttcgggcggcggccggccggaggtagacgacaggcctgacaggtgggccccacctgtcagcggcagcgagcgcgcgcgcgggcgggcggctgcgggccggcttgggccggggagagagagagagagaaggttttgggccgactttcggcccaaagccaaaagaaaacttttaaaaccttttccaatttaaattattcattaaatgcaattccatttattaaaaatacttccttagctcaaataaatcccagaaaaatctaggaattatagagttaagcaaagtatttaataaaattttatctggccccattgtatattggaatttattaattaaaattagatcttctcttctaggcttttaaaataaattctaataattccaattaaacaacaatttatatatttaggatttttagggtgtgacaacatagcacacgaggaccttcagaagatgaaggaactcgttgttgggaacgagtcacagcggcacgggctggagcagcagatgttggacctaggggaccacctggagccaattcgggatgccgtccacaagaacttcactctccttcatcatctcgcgggggaactcggcatcgaagccgacatcccaaaacactccgacgagacgatgctggtgtcttctctgtatgacctcatcaaggcgatggagaagatccctgggaagcacgccgccaaggtggccgaggacacctgcaccggactgcgcacaggcgcatgtcacattcttgcctgcgtcaagcttgcctaccctaatatcgacctcaacatggtcttgaccaagggggcagacgacacgagcaaggacgtgatgtcggaggtgtcggagaccatcctccctttttatgaagagtaacttatcttgcgcttttaatttcgaacttgtaaacacattgggtttgtatagtccttgctagaacgattctccctttttagtttacttcgagtgatttgcgctttaatgggcagatctggaggtgtagctataaatagtccactctctccatttgggagtgctgctggactgattggatcatttgagattcatgctttcttgtttccatctctccatgcgggtttgattcggatttggtgcgtgtgtgagagttgtggattcaagattgtgtgggtgcttcttgttgacttcgtgaagatttgtgagcacttgcatcatctccgggagatcgttttaacagaagacaatttggctaggaggaattggaatggtagtttgagatgttggttttgtatgaaaaatgaatcgatttaccatcttttcctacattgccattttgctagatttctttggagatttatgcaattctcgtttggattataccctccacatattatatctcatatgtttgggaattggcttgttggtgttaattaaaaaaatcaaggaacttatccttgttggaccttccactgtttgttgggctctctggcttagtagaaatgaaatggtttttgatagatcacctcaactacaaaggcatgatgatcatatcaagctaataaaagatgcgtatcataaacttgagtcgacgatcatgcagctctttgccaactttggatagagattcaccaatagaattctgtagttgtgggatctttaccttgtttggtttttattgtttgaaccttgtaataattggttgtagctattagagcaaaagtcaggatgttttattccattatctaaaaaaatctcactttttctcttatcgaattgcatcaaaatgaatattcatttagacacaattgctcttgatgtctttcttcatacttgttcacaagtgagcaactgttttctcattggtcatatgaagggtgtcatcgcaacagttgtgttaagaagcttttatggtccaggaagctaccagttgaagtgcttactgaaagttcaagtgccattagtttggttttggtgattaatgacaaattcaattacatgagactaatattgttataaggatgaaatgcgtggagatcaagctatatgtatcactctttctctccatgcacatattgatatattcatatataatattttcatgtgagactaatgttttgtttgagccatatcttgtttagtctctttacattgagaacatggagatgatgaaggtatgtttttattttaatgtctatatttgataaatgccttctattcttgtataggataagctctcaatgtttaatatcttgttatgtatactcttgcttcacacaaatattttgtatgcatacatctagggggagcaaatcctatactttagttatgcatgtaatcgatccaagttattcactttcatttaattgagatctttagatttgagcatatatttgagtatatgacacttctggtgttgattaatactcatcatttattcatatcctattatacatgcgatcggttggttaacatgtggaggttgacaaccagatcattgggactaataattttattgagttgaatgaaaaaaataggtctcaaggattgcaaaggtgttaatgctcaaatgatataattacaccaaatgataccaagaatgacaaagtgaagatattgaatgtaacatcctgaaaattacttattttctaattaagcatcatgctggttcttatgttcttattaaccttttaaacctaggaaaatataattaaagagacctccaaaaattaacttgcgtagaatctctctttgctatttaaagtctttcgtggtttttattctaaaattgatcttattaaaccaaggtatttactttgattcgatttttcactttaaaccttcttttgtaaaattcctctatttcaattcaattaaaaacccttttatgaattatggtcctagaaaccttcccatattacccttgaatctaaaccaccaaaaattctaattccattggaattaattgttaacccatcctttaatcttaaacctatcctttgattctcgatccaaatatccaaattcctccttttgatctaaccgccagtttaattcctacggcttgatcccttctcggcacaagaatggtattattacaaacattgtgaataattgctcttgtgctaaggaaatagattatatccttgtcattcaaaatctcatttagcccataattaattctctagatttctaccacatatttggggctaaaatcttatgtattccattccctccatttccctcccatattcccaactatatcttcaattttattcatatattcctctctcttatttgagtgcatcaaataaatctcattatatgccacctctaaaatattgcactcaaataatttgaaaatatctctcttgggaattatgtcgtccgagtcttcatcatcatcatcaatgatcagttttcttggcctcttcctggagctagcttgatgtgaccatggctactacggatacaacaattgctcacatcatcgatgaacaagatgatatcaaaatcaagtccttcaagtgctgatcaacaatccacggagaggtgtattgatcgctaaggcgcaacacaacgtctcgtacggttgtagtcggatcgtcaacgtttctccctaatcgtagttacctacaactcaccgaaagaccgggccaacaacagccttgagtgtcgagagaaactcagggttcatcaggtggtatcagagctttcgttgctcggtgagttttcatttttacctagaaccagaaaatagccaaaaaaaaatttcatacattacctagccatatttgtgccattgcattgttctatgcagtttttgctttgttgaatttttgttgcattgtcacgtcgtgttgctggtcttagcgtctagttcgtttagagtttcgagttctggtcacgttttgtaccacagtcgttgttgcctccatgtatctattgtcgtcgggacctacgaaaacggaatcggcttgctgccacggttctatttttgtagttttcagaagtttctgtcggttagtttttgagttcttgagttgcatctaaggtttctgttcggtggctatgccgtggttgtatccgtgatggtgcgcatgtgatgttgtgcatgaggaagaaggaaggagaagagtagattagatcggtttttggtagtagattggatcggtttctatttgaaccggattcggtttccttgcatgagagttttccttttattcggactccgtgtgccgtgtccttcctttgccgcccaccaccaccaggccgagatttctgagtcagactccctccctcacggctataccatgacatcccatacacttgggtgaaaatttttcgtgcgtcggattgaagatctgtttgcaaaaacgcaacctatgcaacgagagcatttcatttttgtatagttctaattttgggtttggattttcgtatttgagtccctgtaattttagtatttatatttgagtccgtgtaatcttacattaagatccttgagtcggtttttgttaaaaaaataaaataaaaatgagagaagaaaaggcagaaaggtgcataaaaaaagaaaaagaaaagccgcaccaaaaaaaaagaaaagaaagaaaataaaaaataagagaaacaaagaaagaaagaaggcaaaaaaaaatcagtttggtttcatatattaagagtgtgcttgagttgtttctgatgttatcttgtggtaccgtttgtgtctagactcgcttctctattacgttctagccttggaccagcacggtacttgactttgaacgatcattcaactttgcattctctagattgagcatttgctattcctttgctacatatttaagcctacctagagctccacagatttgattgtagccatacagcaagtgtttgccaaggcatcgatacatccaaactccattggggtgcttggttgagtcagtgtacgtcaccattccacttgctttggtaagaacttgtaagagcttggtgaaaagcttgagtgtgtgtgatatttcagctgccactacctagtagttgataggagtgtgcatattcttgtgtatgttttttgtttgctactaaccatggcaggattgtgcaaggggaaacaagatggtcatgctcaacatcaacatcttcaccatcaacgagatatagcgacttcttcacgcatcacatatgaggtacatgataatgatcttgcaagggtagaatctaaattgccagtttttgatgctaagtatgatccgcttatgttaattgggagctagcagtagacaaacaatttgatgagtatgatttctctaatgctcaaatgattaaggctgctagtaataaatgtaccggttctgcatcattttggtagtacacagttggcaataagcttgaaacttgggatgaatgcaaaacaatgatgaggaaaaagtctgtgtttgcatattataaacgtactctacttgagaaattagaacatttaaaacaagggtgacaaacctgtgcnggagtactttcatactttttaaatttggtatcacttatagtggtttaaaagaaagcaatgagaacacaatgactagtttttttttagagggcttaattctgatattcaggctgggcttattaatgtgacatataatcatataggccacttgttcatgctggcttgcagtgttgagagcaatgttttaaagaacccaaaggagaaacaagctatgcttgtgcctcctattaatgacattttgcagggagctcagaacattcaccatgaggagaagagcaatatgctcgggatgtcatctccatcgctcacgaaggaagaagagaagactgatgcacctacaatatctgaagagggcataaaaggtaaattaaatggtgctgatattactcaatgtgagtgtgcttctgatgagtcacatttgtccactatccatgctaatctagagcaaattttggtggaaactacttctgatttgcctttgtcacaagttgatttacttgctgttccttgtgataaagaagagttgttgataatgcttcacttatatccctaccacaactagtgaatgaaaatgctatttctagtgtttcattgtgtgctgattttaagcatgttgttcacattgctaatgatgttgaggaacgtaaattgataacttctttaaatacttttggctatgttcagttcgatggtttttgtgagctcaataatttggaggagaaattatttgctaagtttgatttgccatgtccaacaaatgctatttttcatatctttggcgaatataatgatagaggtgatgtgactatggctactacggatacatccgttgctcacatcatggatgaacaacaagatatcaagtttgagtcctccaagtgccggaatccgattcggccacctgctacactgctgacttcaaacggccgccgaatctgcatacgacctccgttttcggcccgtgagtacttgatggaaagctctcggagtcctctttccaatgaatccagcctcattgccaaattccatctcactcggcagcaactgaagaaacaatgtgctgcgacacctgtaatgggcctatgggcttgtaacttcgtctggtaccccggcccaagtggggaccatgtggggtgcgccccaaccaggtggaggacgacctagaggacctcccacctccttaaatagctaggtagccctttagagtttcttgggttttgatagattaaagtttagccattgctacttgcttgcagcgcgcgtgtcggctagaccgtccgtctgcttgttcttcggaaccccaacttatcgtgtgtattaattcctatttgcaattcggattgcttttatcttgttcttgcttgtttcttcgatttgcttgcaggaataaggttgatctgcaccggcaagatcaacaacccacggagaggtgtatcgatcgctaaggcgcaacacaacgtcttgtacggttgtagtcggatcgtcaacgtttctcccaaatcgtagttatcatcaagtcagcgaaagatcgggccaacaacagccttgagtgtcgagagtaactcagggtccattaggtggtatcagagctttcgttgctcagtgagtttttatcttcctataaccagaaaatagccatacaaaataattcgtatcatttacctagccatattgtaccattgcattgttcttttcagtttttgctttgttgaattttgtgttgcatcgtcacgtcgtgttgctggtcttagcgtctagttcgtttagagtttcaagctctggtcacgttttgtaccacagtcgtcgccgcccccttgtctctgttgttgtcggaacctacgaaaacagaatcggctcgctgccacagttctatttttgtagttttcagaagtttccgtcggttggttttggagttgttaagttgcatctaggatttatgccgtgtggttgccctctgttccgtggttctgtatgtgatcttgcatggccgtgctgatgcgcttgaagaagatggaaggcgtgcggaagatggaaggtagagattagattagttttgtttggttcgggaaggaaatagttgattggatcggctgaagatcatatttcctttcttcttatctctttcatgcgcaccaaatccgaacacctgccgtttccttccaccccgcacccaccaccaccatgacaaagtccgactcctttcctctactctcggtttcagtccgcaccgtgagttgctagacatcttggtgaaaacttttggagtgtcagattggagatccgtttacaaaaacagaatctacgggacgagagcattccatttttgtataattttaattttggattaggactttttcatttgagtccctgtaatttttgtattttcatttgagtccctgtaatcttacaataaggtccttgagtttgtgtttggtaaaaaaaatcaaaaaaaaggagaaaaaaaggcagaaaggtgcataaaaaaacaaaaaaaaaagagccgcaccaaaagaaaaaagaaaaaaaacatgaaaagaaagaagaagaagaaagaaggaaaagaaaaatcagttgtatatttgagattaatttgatatatcggagtgtgcttgagttatttctagtgctattttgtggtatcgtttgtgtctaggctcgcgtctctagtacattctagcctaggaccagcacggtacttaactttgaatgatcattcaactttgcattctctgatttgagcatttgctattcctttgctacatatttaagcctacccagagctccacagatgtgattgcagccgtacagcaagtgtttgccaaggcatcgatacatccaacgtccattggggtgcttggttgagtcggtgtatgtcaccattccgcttgcattggtaagatcttgtaagagcttggttaaaagcttgagtgtgtgtgatttttgagctgccactacctagtaattaataggaacgcgcatatttttgtgtatgttttcttcttttctactaacaatgacagggatacgcaagataattggggatagctgtgctcaacatcgatatcttcgtcgagacatgaggagtgatcaacatgacgattataaggtaagtgacaatgttctatgtaatatcaaatctgcactaccttatttcgagggaaattatgatcctcatgcttacattaattgggagctagcggttgatagagaatttataaagcatgtcttgtctgagaaacaaaaggttatgtgtgcctctagtgttttaattaaacatgattctaatgattggaaacatctttgtaggcataaaaaaatgccacaatcttggaaagacttgaaacgatatttcagagatgtttatgttcccatgtattatactgatattctgctcaacaaactgcaatgtttaaaacaagataccaaaattattacttcatactatcatgatatgcatgcttgtttattacactgtggcttagatgaatacgaagaagctacagaattgaggtttttacgtggacttaacaaagaaattcaggacatgcttgcttgtgaaaaatatagatctctttctcatttgttacaacttgcttgcaatgctgaaagtaaaatagaggaggatatgaaaaagaaacacgctatgtctttgcctccaattactaaccatttgcaggaagtgcgtaatcacgaaaaggaggagagagacatgaaagagccaccaattccattgttcacactcaagttcgagacacctcgatcatcagaagaggacatcaaaggtaaagtaaatggtactgaaattaatcaaggtgagtgcgttgttaacgaagtaaatttgtccacttttcatgctaaagtagagcaaccgttagtggaaccaaatgctagtattcctttgtcacaagttgatttactcgatgttccttgtgataaagaagagttgtgtgataatgcttcacttatatccatgccacaactagtgaatgaacatgctatttctagtgtttctttgtgtgttgattttaagcatgttattcacattgctaatgaagttgaggaacgtaaattgctatcttctttaaatactttgggctatgttcagtttgatgatttttgtgagctcgataatttgaaggagaaattatttactaagtctgatttgccatgtccaactaatgctatttttcatatctttggcaaatataatgatagaggaatatatttggtgcatagagttttcatttgttcggatttagagaaacatgttattgctaatcacactacttcgagtttctctagttttgattggatgaaacaggttattttgaatggactatgtgaagaacaccatatggaaaaatcgaggacggttttccgtgaaaaaggggaggatgatgtgaccatggctactacggatacatccgttgctcacatcatggatgaacaacaagatatcaagttcgagtcctccaagtgccggaatccgattcggccacctgctacactgctgacttcaaacggccgccgaatctgcatacgaccttcgttttcggcccgtgagtacttgatggaaagctctcggagccctcttttcaatgaatccagcttattgccaaattccatctcagtcggcagcaactgaagaaacaaagtgctgcgacacctgtaatgggtctatgggcttgtaacttcgtctgggaccccagcccaagtggggcccatgtggggtgtgccccaaccaggtggaggacgacctagaggacctcccacctctttaaatagctaggtagccctttagagtttcttgggttttgatagattaaagtttagccattgctacttgcttgcaacgtgcgtgtcggctagaccgtccgtctgcttgttcttcggaaccccaacttatcgtgtgtactaattcctatttgcaattcgtattgcttttatcttgtttttgcttgtttcttcgatttgcttgcaggaataaggttgatctgcaccggcaagatcaacaacctacggagaggtgtatcgattgctaaggtgcaacataacgtcttgtacggttgtaatcggatcatcaacatttctcctaaatcgtagttatcatcaactcaccgaaagatcggaccaacaacagccttgagtgttgagagtaactccgggtccattaagaggaatatatttggtgcatagagttttcatttgttcagatttagagaaacatgttattgctaatcacacaacttcgagtttctctagttttgattggatgaaacagattattttgaatggactatatgacgagcaccatatggaaaaactgaggacggttttccgtgaagaaggggaggatgatgtgaccatggctactacggatacaaccattgctcacatcatggatgaacaagatgatatcaagatcaagtcctccaagtgctggaatccgattcggccacctgctacactgttaagttcaatcggccgccgaatctgcatacaacctccgtttttgacccgtgagtacttgatggaaagcactcggagtcctctttccaacggatccggccttatctccaaattccatcccagacatccacaaaggaagaaataaagtgctgcgtcaccagtcatgggcctttggccttgtacctttgtttgggaccccggcccatgtgaggcccatgtggggtgcgccccaaccaggtggagcatgaccctagggacccctaggtcgtcctcccacctttataaatagttaggtacccctttagagtttcttgggttttgtttagatgaaagtttagccattgctacttccttgcagcacgcgtgtcggctagaccgtccgtctgcttgtattcgaaaccccaacttatcttgtgtattcattcctatttgcaattcagattgcttttatcttgttcttgcttgtttattcgattttcttacaggaataagtttgatctgcatcggcaagatcaacaactcatggagaggtgtatcgatcactaaggcgcaacacaacgtctcgtatggttgtagtcggatcgtcaacgtttctcccaaattgtagttacctacaactcaccgaaagatcgggccaacaacagccttgagtgtcgagagaaactcatggttcatcgtccctccaaacacaaattctcctctaaatcaaattattcaatctccatacaaaattagactttctcccttttgagtttgggccgcatttctcctttcctcctctcactcgcacggcccaagccggcccaaccagctgagccgccctttctcctctctgtgggcgcactcggcgcccaagccacagcgccgccgccgcccacggctttgtgcgccgtcgccgccgtcttgccgtcgccaccaagtcgcgccgccaccgtcgccgtgccgtgctgctcctcctccgccacccaacacagcagcagctgccacgtgctcgcgccgccgtcgacatccaatgggagcacagagctggcgccgacttcttcttttccacggcgccgtcgcgaagttctcctcgatcttctcctctggaaccgccttgcatcaccgccttttgccgcctataagtacccggcgaggtcgcccttttcctccacacacatccaagctcaagctcttcttctctctctcctccccatgccggccgtcggccgatctccctcgtcggagcattgccgaccaagccctcgcgccaatacgttcgcctcgacgagacaaatccattccctaaccttccccttcctttccccttccgagattagccaccaccgttacttcccaaaccggccggggcaagcttttgtcatcgccgttccggtctcctctctcactccccctgccggacaccgccctccccggacacgcgacgctcgggaacacactttgccgccggcgtcgccacctcccggccaccggagcaccggcgaccctctctccctctctcccctgtgactcgactggaaaggagaagagaagaaacgaacgaagaagaagaagaaaagaagaaagaaataaagaactgacaggtgggtccatgaacagtgcactttcatcttttctagatttaattcaaaccccaatctttagaagcccatatctcctaaaccatatatccgattccaatgaaacttggatctaaattcatctaaattcaaatccttcattttgatatcaaatttgctatattaagattttatttgaatttccttaatttattcaaataccatttgaataaatatttgatttaattaatcttatatttgaatttccaatttaaacttatatttgtatttcaaatatttccttttaacccaaaatacccttcagccactaaaaagctgccggttagaactttacaccttctatgtgggcgtccgtgcgatctacaggccccgacgtcgaacagttggttgtaaagcctggcaaaacccaaacccaaggtcgaagtgctgctcctggcaccctacgcctcgatgcgtacaacggtcggagcttcactattccttcgacctccacagcacacaacatagttcgctcttgaactctgtgtgatcctagccacttcgccaccactcacggtcgtcggagtaacacttcttgtacaaacttccgattcctctagccgttataatatccatcgacaccagctagagaagataccaaacctagtcgttatgctactcaattctagcatcgactagtacacaaccaaatcctagtcaataccttgctagtcaaattccagtcgtcttccaatttccatatcagctacaatattacctatataccactttccataattttactcacccccaccatatattctccatctacccagaacctatacatataatatagagcctggctaatatattgccctactccacaattggcttaaatataaccaaaccctaggtgtaaacctacctaaacctaccaccagccaatactagccacatactcgcttaaccagttatatcccctactctccaagatattaaagctttcacatgaaatataagcgagaatagttgcttaatcccctctagcctccaaccatttagaatctatacctgaaatattagccaacaatccctacaccttataaaggagatatctataccctaaacccagcctttctcgctcttcatcattttcttgctattttatggcttttattgaagttggttcttcctcttcttcagtagagtctattatatttggatggcaacctgtggtatttcgagcatcggataatcaggttgcctatctcggatttatttgcgctggagcaaggcaagttattattcttatccttgagcataattaccctatattctatatctctattctatgcattagtcatacatgatttcaaatgcataacctaaacatagcaaaccagatatgctagcttttgcttagccctgcctagttagactgcataaaatataatgaacttagattggaacagtacgatagaaatagttgatttccgggtggctagtactgtttcaaccgacataagactgcccaaatacttatgaagaacgaacgggtacgaccacagctctaagtgcaggtatagatctagcattatgttattaacaatgtggtacctatgtacagtggttctttttaagtcctcatgcaggaggaaaacttatgtcgagcggggcaatattgtgatatttaccgaggcgcaggtaaatatttgtttgagataaattatgatgactagtctgtttggcatggtgtcatacaatcaattctctctaaatacctcgggaatgccataactcctcacgctgctgataacgttacgttcagagcgtatggggactagagttcatggaacaggtgccactattgttagtaatctaatactaggccatgacgaaactgatgattatcagcaagtcgtgggctgtgggtaaagcgtacatttactgcagtatgaatattcatgaatctattcgaatagccgtgctcacggattgagtatcgagactcatatggtatttggttagaaacttaattctaaactttattaaatactgttgcatttaaaacattacatgccttcttcctctatattctcagccttctgcaagtaaacttagctctactcaaatattaccatttcatgcattcaatattgattaatataatagcttgctgagtacgttgtactcatccttgcttaaccccacctttttcagagtccatttgatgttcttgccgaagccgggagttcaatcatataagttagtctcattctaacttagttctcaagcatatactagatagtttaagtctatagcaaaacattagagttggctcatcctatagcttctactgtaatagttagccacaaacttctaaatgtcctattattttataataacatctcctctggagccttgattaaatgtatgcaatgaagatccatattattgaacctgtatcaatctactgatccagggcttgatacagttttaataagtcggttaccgaatcattagttttgggacccgacactgaagatgtgggatacaaagttactactatggcaagacggtgaaggacaagcaatgctcggtcacgatggaccatgcggcggtgaagggcaagcaaggggcttggtgccaaagaaccaaatccggtggtgaagggtgagtgacggctttgtcatgatggaccgtgcgaggccatttgaagctacaagtaatcgcatcaatcatttgaggaatatatggtgaaacggttttggcattggtatcccttaagacaataaaagaaagatgaaaagaaggcattcctgttgacataattatcttcctatttatatttgagtttaggaatgccgtactattaagagggatacaacgtcgaggtgtatatgccaccggtttcaccccctaacttgaataagccattataaatatgcaaactgcaaatttgccgctgaaattagtttgcattgcttccgtttgacattaccatctaaactggtatgattaaaagggcaaaaacaaggagcatgaaaagaccatctttcccctagccggaatagatctcgcacccctctctcttgcgggtgtgcaggaggaggatgtggaggcggccaggtgggcagatggcgtgtggacgggcggtgtgttggagcatgacgccatgacgggataatgtgtggaccgcggcgtgtggccaggcagacggcggcagggcggcggctagtgtgcgcgtaggtggcggtcggagtcctcaccatgacggcatcggagtaatatttttgaggtaatcttgcgggaagtgcgagtcgacggcagccgccgcgatagcagctgcaacaggagcagcaatgcttgcggctgtagcacaagcatgcgacaacagccgtgcttgtggcggccccagcagcattgtgtggcatcagctcactataggcatgtcgttggagcagcagcagcaggtccctgcgacagcagcaagccagcaagctggtagagctacagcaagagcagcaacaatggcggacaaaggcagcagcagctgtagcagggacaggggcatccttgtcctatttgttttgtgaaaacccatagtctaacgatgatattccgagccgtgtatccaatatgtacgtgggttccaaccgttttcgatggcaggcatgcaattacgttttttatagtggtaaattcacaataccgattcaaaccagtgctaaatatgcaattggcccaaaatgagttgagtagtcctctgagtgagctttacatagagtccaagatcatcaaaaaggactcccgagcgaaaagttatggtcgttttactctgtgctttccggaaattccgaaaaattatcggaaactccgaaaatttttgaaaaactccgaaaattttcgaaaattccaaaaatggctgcgaatctgagattggcttctgtaaatttttggacttatctgaaaatgcatttcggaacttccgaaaatcacattcttggcctccaacggctagtttttgaggggctcgggtatataaactcctccatccctcctttgagtggctactgttcttgggaagtattagacatattcaaagccaaatagtcatccccatttccctacctttgtggtgcctctttgtgagagggatttaagaaggggagagagttggattgagagactaagaagttgagagctagtgagcttcgctccatactttgagcactcgagttcatagcaagcaaattttcgattgtgtttgttactcttggggattaaggtctcctagacagctaggcgtcgccggtgagcacccaaggttgtggtcggccaccgaatgtttgtgaaggcttcaatttctcctccgcaaggaaagaaatcaagagtaaaaccgaggagtgcatttgtgcaacctcgtgaggaaagggttgaaatagggctggcccttgtggctcctcaacggagacgtaggatccgtgaatctgaacttcgggaaacgaatcacgcatctcctctcttggtttgcacattcttgcattctctcatattgtgcttgagcttgtttttatccgttctacttgcatggttaattaatatagttggtgaccttatatcttggatagataacttatttgtcaccttttgttcatatacattttgtttgttcgagctacaagttcatagctagtgttttattccgttatccgctgaacttttcggttgagaccgaaacttccaatcccatacctaaagtttcgatttgaactgaaagatctcatcattctaatatgctatgaagttgtgataatttttaggaacgcctattcaccccctcccctctaggcgacatcaaggtccttccaattggtatcagagcgagatctctcatttcgggcttcaccgcctggagagaaattatcgacaagaggtgaaatgttccttgaactccttttgctagatggttcaaattacatatcttagagtactcgtgtgcttaatgtgtttagggccatgggtctgcatatagagtgagttgtagatgtgagtatttctcctcctaatgataaagagctatcatttgaagaggaaaagaaatgcacacatctcaatgctaaagctactaatgttttgtttagtgctttaagtgaagatgtgttcaaaaccatcatgccacttgaagatgctcatcttatttggacaacactaaaggaaagacatgacaagtccaaatctgatggagatgatactcttgtggaagcatcatttggggattgctctacttcatcgcctcatcatgacaagtctcaagtgattatctcctccgaccaagaaggtctcaccccatcatatatctcaccaacatgcaactatgagcaaggtaataaattggtgagtaaggttgatgatcttccaactctcccattggactccaacaacactgataatgaaattgatatatttgattgtgttgttgactcatacatatcacttagcattaaatatgtgcatgtggatgatatggatggatgctctacttcatgtagtacttgtgaaactaaccttttgaaggagaaaatgaatggacatcaatgattaaatgaagaatccacaccatcaatttgttcatcttccattgccgaagatcatctgtgctttatgggtgatgatgatgactccgtggttgatcacttgaacaagacgaacacaacaatggtgatcaagctcatgaggattattgagaagtaacaagcatgtctcattaagaagaatgaagaaatcaagggtctagccgatgaacacaagaaactcgagggatctaattcttcattaattatgaggtatgaaaaattgataaatgaatttgcttgtgccactaattctattgcatgtgtagcatctttggagaaggaaaatcaagagctcaaatattgtttggagagaatttaaactagaatctccccgcccagggaaataaaatgtgcgggcgtgccagtgtactaagtacacaaataaaatagacaaaggaaaatgtatttattataattcttgatgaattaaaacaatgcaaaatccttgatcaaatgcgctccacggcctataggcaaggtggatctgccttggcgattgtgttctcctggttctcggggtctcggaagacacccggttaattgctctcgcgggttaaacccgtgagatacctccgattaagctgcgctggtcgtcgtcgtcagtcttcgcttcactttctcccatgaatgattgtgatggtggtgaagatgtagacgtgtgtaggcgccggcagcggtccacggcctcatcggtccgtgcgccggtgttggtgacgtcgccttgatgtagacttcacttgttcatgccgtttagcctcatcggtcttaaatggtgtacttatagtggacataggtttttttggttgtaagcactaggaggctggtacaactcttctagtcttcttgaccgtcttggtgccatgtgagcaatgggagaatagtcaggagaacattgaccaatcattttgctcgattatcagcgggataggtctctggctcgatgtagagatacatattgttatggccttgcgtcgaccaatcactgtgacactcggaatagcgctgcttttctggtttctagcacactggctgaatatcattgtggtacaagagtaggccttccaatcattgcagtgcacacttaagattaagtggtttttgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaggtgtctacgaaggcacgaaacacgcgagcgaagaggaaagcgagccgtcatgaacgaacagggagcagtcgcgcgaagcgcttcccaaaaaccttattgccgccttctcccggtgcagaacgtcgaaggcagaggttccggagacctgctctcccgatcgccggtgcacgccggcgagcgagatggagtagtctacgagcgacggcgcagtacagagtaggaggcaaaccctagattgattttcgcatatgctgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgcccggccaggccaggcgaggcgaggcgagcgagcgcgcgcatgtgtttcccctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagtcaacagaactcattaaggcatagccaacctgccttgcagctcacgagagtatatgcatcttcacttggagagggtatatatattgatactctcctctagtttactaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacaccagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagataagaatgatttaacatcatttatcacctcaaggtttgtcccaaatatcagtatgtcgtcaacatacaagcacaaaataactccctcacccccaccatggcgatagtacacacatttatctgcctcattgactgcaaagcctgtagatgtcaatgttttgtcaaatttctcatgccattgcttaggagcttgtttcagaccatacaaagacttcaacaatttgcacacttttccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgacaatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactaacatcctcctcagagacaagttcatgtgtatgttcagtttgttctggtggtgtgattgaactgggaattatttcagatggttggttcgaaccactatgtgtatccttcattgggaaaaagctctcaaagaagatagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggtttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactttccaccacgatcagacctaagcctttttatctttctgtcaagttgattttcaacttctgccttataaattttaaaatagtctagagcctcgtctttcattttcaacaagtacacatagcaaaatctagtagcatcatcaatgaatgtcatgaaatatcgttttccacccttcgtcaacaccccattcatttcacaaagatatgaatgtaggagttctagtggtgccaagtttctctcctcggcagccttgtgaggcttgcgggttgctttgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttgaccacacacaaagcaaatcctctcatcctgattaggattattgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatggaggtagtttcgcaataatgcacccagccacaaatttgtcgggtaagacacacttaaggagttcgagttccttagccatggtttgtatctcatgagcctgttcgactacagagcggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttaatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaggtgtctacgaaggcacgaaacacgcgagcgaagaggaaagcgagccgtcatgaacgaacagggagcagtcgcgcgaagcgcttcccaaaaaccttattgccgccttctcccggtgcagaacgtctaaagcagaggttccggaacctgctttcccgatcgccggtgcacgccggcgagcgagatggagtagtctacgagcgacggcgcagtacagagtaggaggcaaaccctagattgattttcgcatatgctgcgtgaagacggcaggtcggtttatatagagaagggtccgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgggcacgcgcgccgcctgccctgcccggccaagcgaggcgaggcgagcgagcgcgcgcgtgtgtttcccctcttctctccaccacacatgcttcaagtgactaggagggcatcctctcttttaaggaggtccccctctcctagaataagcaaggtggtactaaactccacatgcatgccatcccatgaggtgggcttttgtgattttccaaagaattaatcttcgagtgggctaaggcccattcattaattccaacagttttaggggatgttaggggcatagcctagcctgggaacgatgagacgtgttccaggaactgggtggccctcttgtatatgcgccgacaatcggagccaaacccaaattatgttgggctgtctccgatcgcagtggcttgacttgggagtactgcgtcgtcggtcttcgcttcacgttctcccatgcatgatggtgatggtggagtagatgtgtgtgggcgccggcagtggtccacggcctcgtcggtccgtgcaccgatgttactgacatagtcttcatgtagactccgcccaccctgccgttcagcctcatcggtatattgttgttgaagacatgtatggaattgtgtagcttggatgactcgacgccatagcaattgcgtcggaattaaattataaaggtatgaatgatcaacacggatgatagctgaattagtcagggcttgaagatttaagggcggagcagcaccaaatgagtatgaatttgccaactcattttaacttgtcactgtgtacggtagcatgcatatacaggtcttgtttgcttgcttgtcatcgtgtacagtagcatgcatatacatgcattcatacagtgcgcatgcacaatacaatcatctgagtaatttcagcgcggcggctgcaaacgacatgatggcatccggggcatgatgaccttcggatggcttggtcggcagcttcccggcagcatagtgacgccggcagcgaagccaatgatttaatagatgtcaacggcgatccgcagaggctacaacgagcgtggaggacggagggcgtcgccgattagtagagtctcagtcggacatccctgcccagcaaggccgcatcatgacaggtgccagcaacaggggtccgatgatacccatcgcggcttgtggatgatatattaacgacctccggatatcagcaaccagcaccttggcgacctggcaatggccttctccggcgggcagctgatgatgacggggacgagcgttagccggcaacgcctcgccgtccatggacttgggcggctcagcggtgtccacggcaactccagcgagatggttcgggacgcagccggagctgatgacgccttgcgggcaccgagtagtggcgctccggccggcgttctcttcaagcagcaagacaatgtgtgtagaagatagcagtgttgatgagggcgagcggaaagtcgacggcgttgcgtagaagaggccgcgaccggcaaggcgacgacgtccaagcatctcggcgacatcgccgcgccgtgcagaaacatcgtctcaaccttgacggaggcttgcctacgacgtcaactctggcgactctggcgactctggcgatggcggtgcatccggcatcttctctgctgaggatgcatcatcccagcgtgcatgcgctgaaatggagcaaagggatgaaaagaaaataggctagttacccatggcagtgaactggagcagcatcgtctgcctggtgatcgtctcctccttagcgcgcttcctcagcgcacgcgcctcctcgccggacaccgaggtacagcagccgatgttgccggccgcagtgcacgcacgttcccgccagacgccgagatactccagccaagacgacgtgcgtgatggttgccgatgagcagcctgtccttgtgcttctctgtgtttctctcatgtgtctctgtgtatgtctctctacggactactgccaaggctgggcatggcgcagcgcctggcggtggcggtggcggcggcgtgaactgcaggccctcgactcgtgcctctgtactctctctgctgcctctcggtgtttctctcatgtctccccccgttgtgaatttgcttggccttctatagcagctgcaggtcggtgcatatgcatgcccgtgcatggctttgccaaaaaatgctgaatgcggagattataatttgccatttaattgtctagctcgcttctatacttgtgtccttcaggaagcttcctgttgattaaagtaggaaatagatgtgctattttccatctaaccgtgatactgtgaatgatgtatttccattaaaatgatatatcctgaaattataacatcaagaggagatatgatcatatgtatttccatgttgttatactgatcaggagcgatcatatccacatctagcagatttgtgggcccgggtagataaatggcacttctggcaggtccggtgagtagctaagtactgatgatttgctgcatgtgtgtgcttatcggcaattagctatgactaggtactaattccccttctttaaataatcatggaatctttaagtaatcatggaatgcacacatgaaagtaaatcacaggcaaacaaccaagtattccttgcgcgtgacttgcccattagttctcaactacagtactccgcacagttcatttttataatccataaaaaagcgcacaaaatttcgtcgaacaaatatcaacatgaggacacttattgctccaaagcaaacatttccccgagcactacatgtgatttggattgtgtaggaaaaagggagaatcatatggatcatggacttgtggacaaggctcaaccttctcaagataaccgtgggaacatggtgaagaagcttgagaagggatcaaccgtagcttgcaccaagtcctgtcaagaaaacaataagtccaacaacaagagtaaggggcaaattcaaagttggatcaaaactctcattacttgcttcatgtgcaagaaagtgggacactatgccttgatatgttccaacaagattgatgaccaagtcacacttccaaagaggagaacaagaagaagcaataggaagtgctatggatgcaatgagaagagtcatgaagttgcatcttgccctcacatgaagaatcactttgtgtcatcaaggaagaagcttaatatcaaggtagcaagtagcaaggtagcagagaagatgcaagatgtggtgaagaaagcaccatgtaaagacaagaatcgactttgctacaattgccgtgcaaagggacatattggtaacaattgtcccatgggtaacattcctaagccaaactcctcatttgattatgatttgcctagggatgccaaaaaggacatttgtgctattagggtgattagttcaccacatgctagcataaaatccatttgggtacctaagtctcatgtgacttacctttatggacccaatgttgttgaagaccaaaatgtgctaaaatgagaatataggtacatggagaggcattgaggtatggttcacgcaagaaaaggtggatctcaccaactttggaatttgaagccaaccattgcaaaattcacgtcaagaaccaatgtcatctcagtaacatgtatctacattgaattatcttgtatttaaccttgtataggttgtattgcattaacaaagcatttaagaatttacattccttgtatatatgaaagtcatcatttatgcatttttgagcaagataggttgtggtgagtgtttagtactcaatcatattcatgcatatcacatcccttatatgtgctcaagttggctaagtgctagttggtaatttcaaaataaaccttttaggcaaaagtgaaaattttgaaaactatagcttttctatgaaaatctaatcggaaattattttaaagtgtgtttcaaaagtttccaatatttttatttttcaaagaagagctaattttcaaagaaaatgaatttcaacccaaaatgaagttctaagtatcttgttttggcttttaacttcaattttttatacaattaattctaaaaggaatttgggaatggtttcaaaatgaaaaagatagggttggctaattcaaacatttttgtattcaaagtttctctaaaaggccaatcaatcaaaagaaatttagattccaatcttgaccaaaatactatctagaccataaatggccacttactagcacttaaatgagttgtcattgttggggttgtgtaaacgcatcatgctagctcaaatgagtacataacattcattcatactcatttctctccaaaaccatctcatatgtttgtgtttgcattttggaagaaaaatgtttaaaataaggggcaattgtatttctgcccatgctttacgattcaattgtgattttacccctgcttttaagggtttgtgattttgcccttgcttttttgaactgaagcagccgcctgcccctactctgttaagtaatggtaacggtgttaaatgtgtggtgaatggacaaatttacccctggacatgttttggcatgcacactgtatatgtttcaagttaattttgtgcgaatttcatatgggacctaaatgttgacaaattttgtaaaagttaacataacacaatattgtggacaattttgatggaattttagcaataattttaacacagtttataaaacaatgacagaacacaatattttggacaaaattttgacagagattcatcaataatttgacagcacaatatcaaggacaaaatttcagcaataatttcaacacaattttaacagatattttcaagatgtcacatataacatgtgcaagcatcacaaagtagcacaatactgaacatcacacattaatatccaacaaaagccagctagtagggagctttgacagtacggcatagtcaacataataccacaaattacatgacaattaagcagtacatgtctaggaaaagtaaagtagtacatgccgattacatatggagttcaaatatcacattgaaggaccaaacaattcagctagcatccctccccatccacttccccttcccttcccctttcccttccacgtccacttccacttgctcgtcctcttcccctacctcttccccttcccctccctcttccctttgttggtggtctttctcctcccatattacttgcactagcaggacttgataagatggaagtgaaaatgtgttaataaacatgtttttatgtatgtaaaaacagcaaacaaagagtaaagatgaatgactcacattgatggttgagtgacaattggttcactgctgccctctcctgtttgcctccttttttgactagctgtgagactaattgtagtagtgaatagttgtgcatgtcaacatgctgtgttggcaaggttttgctctggaggtaggtcttttgcccgccatctggcaagctgaaatatgacccactctaataactactttcaattcgctatgaatcggcctacaataagaagaaaccaaatttacaattagctaattcgtccaaaagacaattagctcattcaccctaggaacctaagtgcatccataactaatacagagcataaatcagttggtatggatattaccaaaagacaaagcatcatcaattggtatggatattccgaaacaattagctgattcgcctagggacctaagtgcatccagatctaattcacaaacacaaaaatagaagacaatacatgcaggcttcttccatgaaaatctcctccatggcaaggatttcctttaacagcgccatcccgccaccaagcttcactacacgctgctcgctggccgatggagccgtcgctcctctccgctgcgcaccggccgccgcgcctccctgcgcatgcaaccgcggcgccgccgcaccgcgcctccctgctcgctggccgcggggacgccgcacctccctgtgcgcctgcccgccggtcgatgccaccgcaatgccgtcgttccactctgccaagcctccctgtccacgcctgactccgcccggcccggcctccctgcctgcgcccgactctggcgctgctctccaccgctcctccctgcctcaccgctcctccctgcctcgcgctgaccgtgagtcgccgccgccgcttgctaagagctagggatttcgatttggcatagtgacggattggggacaagactcctgcttctttcatttgaccaagggtagaatggtgtttcacaaatgataaaaatattttctttcttcttttaattcgaaaatttcgagcccaccaaacttctgtcaaaactaggggcagacggctgcttcggttcaaaaagcaggggcaaaatcacaaaccctaaaaagtaggggtaaaatcacaattgaatcgtaaagcaagggcagaaacacaattgccccttaaaataaagcttgtgtagctttttgctcaaatttggtcttttcttccaaaccttgacttaatggagttaaagtgagaaatacatcaattgggagtggtcttaatcatatttttatatcccatgctttcaaaatataaaagatttcaaaatttggatatatagccatttcaaatagcctttttggtcaaaagtcaaaaatctcatttaagaggcaaaaatctgtggaaatcctctcaaaagtacttcaatatgtatttcaaatatttttcaaggtatttgaagtaaaagttctaatttctaaaatggtttagcaaagtggccttaaaaggatcttatatgatcttgtttttgctcaaaatgatttatctccctaaatcaaaatctattgtgtttttgaaaaagtttctaatataaaaatttgagggttggtcattccaaacatttctctagttgaacgttttcttaaaatagcaacgagtaaaatccatcaccggtccctaaacttgtaccgatgtgtcatcctggtccctaaactcgcaaatcgaccgttcaggtcctcaaacttgttcgactgtgtcatcccggtccctaaacttgcagatcactcatttagatcatccaacttgttcagttgtgtcaccccagtccctaaagaggacggtctaaaaaggggatatcaaaaaataattcataactttttcatgtgacctctaatgaaga

SEQ ID NO: 79283 - DNA, 17952 bp, Oryza sativa
ggaattttctgacatctttgtggagccaaaaggtttgccacctcaacgacaatttgatcacaccataccattgctgccaagagcacaaccagtgaatgtgcgacctatatgtatacaccagcacagaaggatgaaattgaagctcaagtaactgaaatgttgcaaaatggcatcatccagcatagcaccagtccgtttgcttctccggtgttgttggttaagaaaaaggacaggtcatggtgcttttgcgtggattatcgacacctgaatgcgataacggtgaagaacaaataccctttgccaatcatcgatgaattgttggacgaattggcgggtgctcagtggtttacaaagttggacttgcgtgctgggtatcaccaaatccgtatgaaggttgaggacgagcataagacaactttccgcactcataatggtcactatgaatttcgtgttcttccttttggattaactagcgcactagctacctttcaaggagtgatgaacaacatactgtgctctctcctacgccgttgtgtgctagtgcattggggcccaaacatttgggtttgtccacatacaagaaagagagcttggcaataatgttggcagtggacaattggcgaccctatttacaacatgctgaattttctattcggactgatcgccatagtctggcatttctagatgatcaacgccttaccacaccttggcagcataaggctcttactaaacttcttggcttccagtacaagattgtttataagaagggaatcgacaatggcgcagcggatgctttatctagatatcctgaatctgaggtcttatcaactctgtcagtttgtgttcttatcgcggttacttgaattgttatctgctaactctaaaggttcttctccccgtcaagttttgaactggcgatgggtgcgcaaaggggcgaagtaggtggaacaggtgcaagtctgctggtccagccacgattcgtcggttgttacatgggagaatcttcatgaactccagcaacgttttcccaatgctgaagcttggggacatgcttcatttcaagggggagggaatgtcacgacacctgacatgcctggaggtacagaacaggaagtcgagccaaagatgcatatgaatgctaatccaccgatgctgcgcaagtctactcaggagagtaggcctaatagtaggtattattcaagtgaatggacccagtacaaatgggctgggccatgtgtgagggagtgaggtccatggcacgatgctataagagaccgacagggagttgagacagaatcgaacactgtagaaacatattctgaataccgaattcaaatctctccctgttctatgctgttcttccccaaatcccaaattccttgctacttctaccctcaattctgttcaattcttccttgttgaaacattttaaatctagcgccgtgacaatttatccccgttcttccttgtcacagttctctgcttgggcaaggcagagacgcaaagtgcgtgggcggcacgcacgccgggtgtggcggcgtggtcggcctacggtgccctgcgaggggtcgctggaccactccgctcgtcaagtgtctccatggtggcgttcatgcgggtggagacggcctgacgcaacggttcgaggtggctcgggcggtggtggtggcgcaatgaattcgagagcaagagcgcgcgattgaaaggggagacctgagttcgagataaggggcgaaagaatggattagccagtgaacactcaccttgcggcgaccaggatacagcgtgccatggattggggtcggggccatcatcggggcggggatgggcgtcgttgtgggcatggacgtcgtctccttctcactgtggcatgaggttcatcaagtcatgactgcaacgacgacgtctcctcgtagtcctgaacggcgaggcctcctctttgttccgactgcatggcgatggctcggttgcgggagctagttgcactcccgtagccgaaccgatgggcggggagttggagagggatgggggaggcctcgaggtggccggtgaaaggtggggaggatgaaaggcttgaggtgaagaagggaaagaatgggggaggtgggtgtgtagatggcagcaatggcatcctctaattttttggcgcgcgatgagctcggccattgccccttttccagggatgtaggtcccctgcagtactacatgtgcaacactgctcactaacatgtggacctgcagttctgcaggggatctcaattgcttttgcagagcgaggatggcatgggcaggagtcactggggtgaggccggcatcagaggcgtcagggagaggatgtcatggcaccggctaggcggcagggatagggttcatggcgacatgcagcaaggacgggaaagacgaccacgggtgattgggaaggcggctgactctctggcggtccgttaccgtgctcgtgtgcggcatgcccatgcggtttttcgggtatggcggtggcgttcgatcttgctgtcaaaaggcagcatcggtgtgtgccaaagaattatgggaaaaaaatatcattcctattatttccataggttatattttcgttattttctacgtatacaatttggcaccaacttctcatgaaaaaaagatgagtaaattgcattggcagtacaagaacttggaaggtgggtgcgattaggtgcaaaaatttgaaaaccaagcatagcggtacaagaacttgacaggtgaatgcgattaagtgcaaaaacttaaaaaccgagtatagcggtacaataacttggctaggtgggtgcgctcatggtgcaaaagttgccacgccattgttccacctcagcgaaagtgccacatgagcatgcattgaccatctcattttacagaaaagtccctaataacttttatattccaattacttcttcagatatgtccgttttcctcctgtatcacaatgatcaaaccagtccatcttctcatccaaataaattctgccaactccaaaaaaaaaaatccaccacgatacagttcgactctagagaatccccttcttcctcatgacctgcaatacaaaataattggttgatgtgttataccgcataaggaaaataatacactaagattatttgcagattattcaactaattatatctgctgacaagggtacaacacatctagcaagaatttctcattgccaatgtttctcttatatcatatacagttacaggaaacaccaataattacagtaaaaccaatctagtggctagtaccattagatcacttcattgaattgtaataacaaataacaggatattcaagtgaaaacccaaaaaaatgcagccattgtacagatcaatgaaaccttaacttcgaaatcatccatcaaatgaacgaaaaatagaaatctacaaccatcagcaagtgatttaccataacaagctaggagcagatgctccgaaaactcgtcgattcagaaccatcccaaagcttgcggtgaccacgtcgacagtagcaaattgttggcttgaattggtttggttactggtttagggcttgaactaatctagcacacgaagccctcgccgccgccgcgatgtaacggtttccctcgttgtcgtcgtcactgccgccgccaccgtcgctgcgccgctatcgccagcaccgcagccgcctctcaattaggaacatgtcaagaaagatggaaggagatatgcatacgtttgttctgtttgtcgagttaaaaaggaaatgtgattggaacaaaaaaaaaaagctatttggggttttctataaaatgagataggtctttcatatcaaagctgatgtggcaattttgctaaggtggaatagcaacgttacaattttttttacatggctacttttgcaccatgagcgcacccacctagccaagttattgtaccgctatgcttgattttcaagtttttacacctaatcgcacccacctgccaagttcttgtaccgccaacgcaatttactcaaaaaagattataggccgatagaaattaatagatagcaagtggtgtatacataatttctgttgcacgaaagacgattaaagtgtatggtccgatccaccaaccgtagatcatacatatctttttcacattggacatgctccacgacaggcccaactagagcaacaactctaggttctaggcttacataaacaaaatactagttgatgaatgtccctcccttttaaattgtgctcgcccaacatcaattatcgatgtgtcacacatcagacctagcaatctccctgtcacatcaacccatgtgacctcgaagactggttaaccaggtcttcttctccatcaaaaccttggctttcatacaacttgtgaaaatgttcaacccggctaaccaaccatgggctactcatatcacattgggtctattccaacacaggctcaaccggagtcaccactttaggtcctattcttaaacaacccaaaggactagtcttatgggtgagaattgccttcaccttttaagctaagctcttctatcatcaattatggatgtgagtctaaacccaacaaaaacaatctgctgctattggttgcttaaaaggcatataactattcacatatggatgccatactgccatcccagtcctagacaacgatttcttaacatcataattaaaatagagttttctgtcacaatactattaggacgactatgtcaatttcagtcactaattgacaacattgatggaatgaacatttattcagcaaattgtcgcctgagttacagaggcgaggtggtccagttgtcgtcttacactcccgcgcatgatcaacttatttagcccgtcgtctgagcttcgctcgtagtcactcgcttctcagttctctcacgctggccatcatgcaccacgccgtcgtcaatgttccggtggcggtcgccgctgccatgctctacgccctcctcgttgcctcccacctagctccaggaattggccgcctcctcgccctcaccccggtgcttgcccttctcctcaatatcacgttcgctatcccctgctttacggcgcccgcggcaccgcggccttcttcctcgtctggctgggtgagttcaagctcctcctcctcgcttcgggccgtggcccgctggatccctccatccctcctcttgcgtttgtcttcagcgccgctctcccagttaagctcatccgagtgccctctgatgatgccgtggtcacgaagcttgcgtctatgcctatcatgtctctggccatcaagcttgccgtcatggcggtggccatcttctacctcctccacaaaaagaacgagatccatggttatacggccttcaccatctacgtcgtcctcacgtactgcttcctcgacttcctcatgccgtgtgttgccgcggtgggcgccgcgcttggcatggagctggagccgcagttcgacaggccgtacctctctgcctcgctgctggacttctcgggaaggcggtggaaccttatggcgtcggcgatgctccgcccggcggtgtacgaccgtgttagggcccgcctcggtgcaccgggcggcgtgctctccacgttcctcgtgtctgggctgatgcacgaggtgatcgcgtactacatctccttccgcgcgcccaccgggcaggtcacggcgttcttcgcgcttcacggcgtgtgcatgtgcgccgagaggtggtgcgcgcgcaggtgcaggcggagcccgccacgggtcgtggcaacgctagctgctcatcgtggcactggtggagaaaccatctttggtcggtcggccgaaattcacaatagtcccggatccatttaaaaccgggactaaagatgatctttagtcccggttggtggctacaacgggcatatgtgatctttagtcccggttggtcacaccaaccgggactaaagatgatctttagtcctggttgtagagatgtcagacgttgtcagggccctcgggatctttagtcccggttggtgtttccaaccgggactaaagatcacggcgatctttagccccggttggtaacatgccttcttcctcctccagcccgagagcaagcttcaaaatttctcaaagaaagaggggaggtcatgccaaaatttcttgtgaaattttttttaatgattatatacaaatcggaagtgtctaaaaggttagtaacttcatcctccaatgttttttgttgttatattacttttggagctatgtttcacacatttttttttgtctccaaaactttgttgtaagttgatgagagagaaaatttgtgtggggaagaagaatatatagaaattttattctcatagtttaaaatatgatggaaattaatcttaaaaaatagacaacaaactaaattgaaaattaagagaagtacaacattaatattagtttagaacttcaaaaattgttaataagaattgcttgtcgaaagagtttttaattattttatcattactgtttgactgtcattattgtacgaaaatttatttatgtacgattttttttcatttgatgtagatggatcggcaatggatgtacgctgaccggcggtccaaagagtttatcgagggcgtgcattatcttttgagagtggccgaagctaacaagcgtaacggttttatttgttgtccatgcaataagtgtaagaaccagaaggagtattctgcatccaggattattcatttccacttgtttgagtcggggttcatgccaagctataattgttggacatcccacggtgaggaaggggttgaaatggaagaagatgaagcggaggacgagaacattcccgactgggctcagtacgctggatttgaaggaaatcaaacgggcgaggtggacagggatgctggcgataacgacactgcagatgatcttggtcagatgttgcaggacgcaaaggaggactgtgaaagtgaaaaggaggcccataaattagagcggatgttagaggaccacagaacatcattgtccccaggttgcgagcgggggcacaaaaagttggataccactctggagttcttgcaatggaaggcaaaaaatggtgttagtgacaaggcatttcgcgatttattgaaactcatcaagaacattcttccggagggaaacaaattgcccgagacaacgtacgaggctaagaagatagtctgccctctaggattggaagttcagaagattcacgcatgtccgaatgattgtatcctatatcacggtgaggagtacgagaacctagaagcatgccctgtttgtaaagcactacgatacaagattagacgagaggatccaggtgaagttgacgggcagccaacaaagaagagaattcctgctaaggtgatgtggtatttccctataataccacggctaaggcgtttgttcaggaacaaggggaatgcttgaatgatgcgttggcacactgaagaacgtcaacaggacgggaagctgagacaccccgccgatggttcgcagtggtgaaacatcgatagaaaatttaaatactttggaaagacgcacgaaacatacggtttggtttaagtacggatggcatgaatccttttggagagatgagcagcagccatagcacttggcccgttacgatgtgtatctacaacctccccccttggctatgcatgaagaggaagtacataatgatgccgattattattcaaggccccaagcaacctggtaacgacatcgatgtgtacctaagaccattggtcgaagctcttaaactgttgtgaaaaaaggaaggtgtccccgagtgggacgaagataagcaggaggagtttaacctacgagcgctgctgttcgtaaccatcaacgattggcctgcatttagcaacctttccgggcagtccaacaaggggtacaaggcttgcactcactgtatggatgaaacagaaagtacgtatcttaagcactacaggaaggttgtgtacatttgtcatcgtcgattccttgttgcaaaccacccggcactttgaacataaggcagaccaccgtacgaagcctaaacatcgcagcgggaaaacagtgtttgctatggttaaagatcttaaagtagtgtttggaaaggggcctggaagccagcctatagagagcgaagatggtcacgcggcgatgtggaaaaagaacactatattttgggagttacccttttaggaattcttggacgtctgccatgcaatcgacgtgatgcacctcactaagaacctttgcgtaaaccttcttggtttcctaggtgtatatggaaagtcgaaagatacactagaagcacgtaatgatctgaagcatatggaacaacgcagcgaccttcacccggaaccaaaggagaaaggaagccattacttgagtccagccagctatactcttagcaaggcagagaaggaaagtatgtttgaatgcttggagagcatagaggtaccgtctggatactccacgaatataaagcgaataataagcacgaaggagaagaagttcacaaacctaaagtctcctgactgtcacgtgttgatgacacaactgctaccagttgtaataaggggtatccttccagacaatgtccgggcaacaataacaaagctatgtgctttcatgaaagcaaatttgcagaaggtcatcgatccggatagattagaagcccttcagaatgatgtggtgcaatgtcttgtcagttttgagttgatatttccaccttcatttttcaatataatgacgcatctgctttgtcaccttgtcaaagagatcggtattctcgggcctgtgtacctacataacatgtttcctttcgagaggtacataggcgttctgaagaaatatgttcgtaaccgtgctcgtccagaggcaagcatcgccaaggggtatggaacagaggaggtcatcgaactctgcgtagaatttattgaagaccttcgcccaatcggggtacctgaatcatgccatgaagggagactacggggaaaggtggttctcggaaggaaagcaagaatgacggtagacaacaatttattccgtaaagcccatttcacggttctgcaacaatcttcattggtggctccttacatcgaggagcacttggctctagttcgcgccagaaacatcggtaagtccgatgcatggattacacggcatcacattgatactttccccgcgtggctacgacaacatctcatgggtaacgagacgattaaccaacaactggccttcctggcgagaggaccatctggctcgatcgcgacattctagggatatgagatcaatgggtacacattctacacgagagccaaagacatgaagagcacgaaccaaaacagcgttgttcgtatcgatgccatgggacacgatggaacaactggcacgtattacggtgccatcgaggacatatgggaagttgactatggtccactcaaggtccctctattcaggtgccaatagattaggttgactggtggaggcgtaacgattgatgacagtgggatgacaacggttgaccttaacaaggttggatactcggacgaaccttttgtccttgccaatcatgtaacgcaagtcttttacgtgaaggacatgtctagcaaaggaaagaagggcaaagggcctgacgagccgaagcgccacatggttttcccaggtgttaacaaccaaaattggtaatgtcagcatcggaaaggaggattagatcgaagtggagtcgaaggcggagatcgattcgagaacagagcaagaatcggctggagtccagatcggctatgatcaggatcggctgggtccgagtcagactaggtgagctgatacagccgattctgacaacacgacttggtgtacaacatcgggttgagtcgatatgtttcaagatgattgccgcacatggatagagtcctgagaagtcaattgtatctattaattaggatgttttatgtaattttcttagagatatatttagggcaaaagtctgccgcaaagacttatggtatcttagagtttgttagagataagagtcgtgtccgatatggacatagtttgtaattttcgggtataaatagacctcgaaactcatgtaaacaattaacacatatgttcaatacaatttggcgcatcgccaccttttaccttttccactttattttatcatccggcgggacttggcacctgacgcggggctgcatctgtgttcgatctccgactaaggggtaagtccaatgttccgccggcccgggcaattgtatcgtctacgtcggtgtcgttcaaggctgcatcagtacattcgacctcttggattgctctggtttagatgatatatttgtctacctatttatcatatgtctctattaatctagtcttagcatatcaatttagctctatcggctgcttctcgctttagggtttctgccggtatcggctaaatcgcgttgctagattagattagcctaggcatctaccaccctgaaaactcagtcaacggcttgattgtctagatattgtgtttcttttcatacttagtgctgcatcagttaagtttgatctactaagtcgtgcttagaaccatattctctagcctgcttcttgattgccaataagggtttcatcggggtttcagccggtgagttatctggacgttgcatcggctcataaggattgcatatacatataagttggatttagccgatgacaacaaaggtttcactgtttaatctaatcttgtagatttcatgacatcggacctccagccgatgtatgctttaaccttcggatcgatgcttatttatcatatcattatttgtcgattggtttatattagattatattgttatttcattacatcgttatcagccgattgccttcatatcattatctacattggacatatagccgattacttaaaccctattgctatcggctggtatcgacatcgactattatcggctatcggctggaactactccatcggcttgtcaaccgatcggctgttttgatctactatttgcatatcttgttagttgcaggatcaaactgattggcacgctcgcatctcatcaagatttggacctgcacaagagctaagcagatctcccaggccagtgtgtgtttttcgcatcaacaccaggcaaaagaaaaatcgttggagtagaggacaagactgacgaggattacaatcagttggatgggcaaccccctttcacggtgacgattgaccctagcatcctcctatcaaatgaagacaccccttactcacgtagcgatcacaaggaaggaacaatagtgaggagaaagtacgtgcggtcaaccgtcaccgccgatgtattgccataattattgtgtacacgatgtaaactattttggatgtattgaatatccatataaatcaattgttgtatggcatatgttaattatgcatgattattagaatttttaacaattttaaatcatgtgtgtgttagttatatgctagttatatgctagaatttttaaaaatcatgcatatgctaattatatataattattagaatttttaacaagtttagatcattcatgtggtatttatatatgttaattagaatttataacaattttaaatcatgcatatgctaattatatatgattattagaatttttattaattttaaatcatgcatgtggtatttacatatgttaattagaatttttaacaatttaatatcatgcatatgctaattatatatgattattagaatttttaacaagtttaaatctttcatgtgcttattacgtattatccacttaatttactacagacaacaagaatttttcgaagtaattgtcattaatttttcgtctttaaataattttaatgcattatttactattttagaaacacatatgtaatgaaattcaatattcagtgctattatctgtagtcccggttcttaaccctaaccgggtttaaaaagaatttggaaatagcgggaaaatatctttagtcccggttgttctcaccaaccgggactaaagaactaggagtatatatattcccgatgcgcaccctcgtattctccaccaacacttagaagttttttccccgatctcgatcggcttctccttcgccgccactgcctagggcatccccgcgccgacgccgccgtcgtatctcgccgtcgtctcgcaagcgtcatcgtcgccgcctcctccgccgccgcatctctatggtgagagccgccgccgccttcctctctctctcgacctcgacctctctctctctctccaaaccgccgccacctcgttgccgacgccgctgcctctccccgagggggatcgagcccggggtgttgcggcggctgccccctcccagcttggggttgggccgcccccaaacccacgtggctacccccgaggggggtcgagcccagggtggcgcggcggctgccccctccaagctagagggaggaggccgccctcgcttggggtcgagctgccccgaccccctccacgtatcagcccacgtgtacagggcctaacgcccacctaactgcatttaaagcggtctatgcaaccgtgccatgccgcatttaatgcggcgtgctgtgcatatgaccggtctgtgaccggtggaatgaccgatgggacggcgactgtgtaccccggccctgtcagtgtgtcacgcggcgagcggcgtgcttcgtcccgtcgcatcataatgatgaggggcttcacagcctcttacccgggtcagagctggtccaaccactctgaactaacccgggttcccattttctggtgtgaacgagaacccggaagttctcatccattaaatggcgaatgacaagggcgccttgcatgatttgatgggccccgcgcagtaaccgacgtgcagatagcttctgggctaaggcacaagacatgtaatgaatatagagaatattttcccttctccctaggtagcactcgcagcacatgtggtatccccttagagtataaaagttggaccatgcctagcgaggaagggggatcggactgaggatccctgagccaaagcttgtctaaccctagcttgcataccagggattcagggactttttaagcacagaagaatcatacacacaggagtagggtattacgcttcgtagcggcccgaacctgtataaacctcttttgtttcatcgtcttggaggagcctccaagatcaagatcacacacagtttcgctcaccaaatcctcgaatctcacccgctacccccggccgaactctcaaagggggggcctcacagcctcccgctagagagggtcaccccttgacacgaggggacaagtgcggcggccagcgagccgcgagggaattgtggtcatgcatgctttatggatggaatgatggatcaatatgtgttcttactgaaatttttatgatgctattctaagtattcatgctattttttatggtacatataatatttgttcttgctgaattgatgattgtcttgtatttttggtgcagattggatggagatgctacctaatgtgggtccccggaagggtcggggacaggggcctgatttggccccacatctccagtcaggaccgggggtagggagtgaagtcgggggtcggggcggggccgttccagcccaacctgaccccgttgccaacccgaagtgtgttgccctctagtgtttggaatgacttagagttccagtatgagtagtagtttacccgttggggccggatccccgcctcaacggagcaggggcaaaatcttccccatgggtaatgcggggcagggcccaaacttcatgccggggatagggaagcatctccacctatggggaccctgtggggccctaaaggtctactattagatgaaggtggcctataccaaatcaaacccgcacctagcgtccacattaatgaggatatatcaagagaaatccggaccttatcctcaatgtccatggacccgatccatccgttccattacagccacaaccctcgtacctcaacctgtgctaaaggccccaaacatcggcacatcgggcactcgtgttatattgagcgctgccatgcttcttctctctcacacaccttgctgtgggccatggacgacctttgcctcgaaccatgccaccaaccgccggaacagaatgtcgccgggcatcggcctcaattatgcaccaggccagtagcttctttctctccatcaccacatcatttctggtcccgcacctcgtcttcgtccgctggtttccctccgcatggggcctgctgtggccggagccggggctgggtgaggcagccgggggttggggattgaggccattcttgcccaacctgtcccgtcgtaaactctatatgttctagtgagtacatactgaataatgcctttccaatggcaattggcaaagtagtgatgcgtctggcggtgaactgttcgtttaaatttgtctaattcagctttaagaaagtaccactacaatttggaacgggtctacacggccgggctactagcacattccttttaatgaatcatgactacgatttgttacgagtaattaagctataacacgtccaagtcggctttaaactatgtagtgactatatatccaggagtagaattacatgactcatatttaattaatcaagttgcataagagacgataaccacacccagtctacctgataaggcgaagaaaacacgatgacacgagcactgggcggccattggggcaacttgatgtaaagaagtcgcttgtcagctttcgtcgtcgcgtctctgtctagatttcaccaatatataatatttctcataacctattgtcaacaggaaactttaattacatagtatatagtactgactaaatacaaagtaacaacgtttccagcttgttgtcttctgtcggtacagtctgtacagatctaactagaatttgaccttgattgcacttcaagtttcaacttatttgcaagatttgtgagcacattgaaatatgagcgggtgctgatcgattttgaataccggcttagggaattttttttatcggtatcaccatatatcacacctacagttcgaatccaaaatgttgaattgaaggaaagggatcctctgacttaactgctgtgcagttgagtcactgacatgtgggccatagtaaagtgggacccacatgtttgcatgtgcattttaagttagaggatctgcttcttgaattgaaaagccggtcgatcgatggcctgaatttttaattttgtcgtggctaaagtgtagttttttatttgatctgacgactataaaatattaatacatcgtatatatattataaatgataaaatgtagtcatgcgtactagtacgtgcaactaattaatatataataatacacaatagacagtcataaactgtggtaatagcatagtcaacactaagaaataataatataatgttccacaacaaatgataattcatcctaacctatcacaaacactagggttgcgaactgggtgttcgtttattcattcataaatatgagtgtgcacgtatatatgagcaccgctgtatgtattgtatttcataaaagaaacaaaacgaattattgcacaattatttcaaattttaaaattcatatctgaatagtatgttgttaccaaatgggtattaacatgccaacattaaggtttcgattacccatctgtacctttcttttagattatggagaagtaagttttggtctatgcatcaatatgttggaattaatgaatgggtctcaacccattcgaagatttttttctttgaaaaatcataaaagcctacatcataagatggcatacatggcgagtttagtacaccttgtctattctaggagaaggagacctccctataagaaaggatactctcttagacactgaggcatgtgaggttgacagaaaaaggggaacacacgcacgctcttacacgcctggactggcctggcggcgcgtgtgcacaacatacgcatcaaattatctctatataagtcgagccgccgcctccacacaacacatgcgaaatcaaatttagggtttgccccctctatactatgtcgtcgctcgtagtctacaccatcccgctcgctagcgtgcactggcgatcgggagagcaggtctctataaccttcgcctttgacattctgcactgggaaaaggcggtaataagatttttgagaagcgctgtgtttctgtcatttttgcagcgggcatggctagcaaaggcctaaggctagccaaaaaacaatttttttttgtggattatactcatctgtgacgggccataacttaatgcccgattgagatgatggtcatctgtgacgggctgtagctaatgcccaattgagatgacagtcatctgtgacgggctatagtttaggcccgattgagattagtattatctgtgacgtgctctagtttaggcccgattgaggttagtagtcatctgtgacgggctctatttgtggcccgattgagataggtcatctgtgacgggctatagtttgactggtagtctgggtcaaagctatcggtgacaggctttaattagggcccgattgagataggtttatcagtgacggccgtttgcccaattgagattacttttcacatcagtgacttctagcctgtgatggacgccgtgcccgattgagatggggcttactgcccgtttgagatgagggtatccgttccagtgattgcttgatttccttcacttttttttaccaatatatatagttgattggaactatatatatttttgatttcttatctatacaaataatacaattgcagctaactccaatattcggtgtttaatcgaaatgattggatagactgtcatactcggcttctaattagaataaaggttgttgccagttctatacttctattccattatttcctcaaactaacgagaaaattgaaattcccatgctctaaccagcgaaaatgcacaccatcctcctagttagtccaagtaaagttacacgagcattttcagcaaaataacaagaaactaatgaagtcaactccagcttgcgtaacgtagcatgctaataatgcacgcgaaatttcagactccagttgttaattttggttgtttaattaccaaagcgaccgggcatgaagttgacttggaaagtcggaaacaatgtgtcagctcgttggcacacttatctatatccttctcagataagtacggcatattctgtccttttcatgcctctcgtccgttcttttgtcgtacgtaactcacggtagtcatgtgacatttcttcttaaactccgttgcattgccatcaaagcatgactatttctagtgtcagactttgtcaaccgtgggtgtggtgtgtggtctgctcacggagttaatttctcacttctcgcttgtactcctacaacagatggaaccaaggccacacgaagcaatatatgcattttccagggaacttttactatacctccagtggaggtgataatattaatagtgtggtagaaattggtgccggttctttataggtggcggttcttaccatccctccaaccgtttctgtatccattgagtaaaaaccaacacctatgttttaagttctggtttgaaaggatgttcgtacaggactataggtgttgggttcttcatcaaaaccgacacctacaataccatctataaagctgacaccgatgactttagtgtcgaccaattgatgccgacaccaaaagtaacacctacgtgaccttccgaaccggcacctataatacttcatatagtagtgaagtcctggtgcgctctcgtcagccgcccactacgccagattctcacacctgtgacgggcataagtattggtcagtgataagggtcacctttgacgggtcctacgggatcccatcatcggtgagccatccggcggcgacccatcacagttaactaatcacctgtgacgcgccaaaaatggaac

SEQ ID NO: 79284 - DNA, 16528 bp, Oryza sativa
catcactacctacaaattcacaatttttcacgcaatataacttgtatgctacaagtgagattcgaactcaagacctcaacctccatatagagctcccttaccaactcacctacttaacacatattgactactaacccaatgttattattttgtctatgcttgtctgaatcatttaacatatatttaacaccctaaataacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctgtgacgtgtgttagttaaagacccgtcagagatgagtggtctcttttgtgatggttcataatactacacccgtcacagatgacatgtcatctgtgacgagccatggttgtgacccgtcacagacgatctgtgacgggttacaagtgcaagccgtcacagatgacttcacatctgtgacgggtcctccctggtagccatatattgaagaggatattttttcggcccgtcagagatgacttatctttgacgagttgcgttggcccgtcacagatgacccgtcactgaagcccggatttgtagtagtgtgaagcagtctccacgtgtatggtttgataggttcaggcatgcagtgtgtgatatggggtattctcagtgtaatggagatcacactgtcttttacaaacatagggggacacacatcaccatcttggctgtgtatgttgatgatatagtgatcactggtgatgatgtagaagaaatcaggtgtctaaaggaaaggctgggaaaggcatttgaggtgaaggatcttggtcctcttcgctacttccttggaattgaaattgctcgttcatcaaaggggattgttctctctcagaggaagtatgttttggatctgttgacagatacaggaatgcttgggtgtcgtgcaagtactacgcctattgataggaatcaccaattgtgtgctcaatcaggtgatcccgttgataaggaagcataccaaagactggtgggacgcttgatctatctttgccatacaagacctgatatttcctatgcggttagtgttgtgagtaggtatatgcatgatcctcgaactggtcacttggatgttgttcataagattctcagatatctaaaagggactcctggaaagggattgtggtttatgaagaatgggcatctaaatgtggaaggatattgtgatgctgattgggcgagtagtatggatgatagaagatctacatcaggttattatgtgtttgttggtggtaatcttgtttcttggcgaagcaagaagcaggcagtggtggctcggtctaccgcagaagcagaatacagagctatggctttgagcttgagtgagatgttgtggatgaggagcttgttcactgaattacgagtgctaagaagtgacactgtgatgcttcattgtgacaatagatcagccatcagcattgcaaacaaccctgttcagcatgatcgcactaaacatgtggagattgataggttcttcattaaggagaagattaatagcggggtgcttaggttggagtatattaagtcatgtgaacagctagctgattatctaacaaaggggttaggtcctagtgagattcaatcaatatgtaacaagatgggtatgattgatatctttttcccatcttgagggagagtgttggtgtaaatatgtattgtaccaaggacctatctgtaaagtgttatgctaatagaatagatgaggaaggggtgagctgagtaggctaaccctaaaaaaattccccaaattgaacaatagcaaaaatcagccgtacaacctgaccatgtgagtggttccttggatcggtataatcctctgcctgacaggcgacatttggatcagtcaacaaagtgcatcattgcactgggaaaacgctgcattattggacgcaactagtggagaggaaccaatcagctgctcgaattctcgtcctataattcatttttaagataatggattaagaaactcggcctctacattcatgagagaatgcacacagccaatctcgtgatctcatcctataatttggctgcgtcattgaaagaatcatatgaaaacgtcgattttgtacgtaggatgctaccaacaggggattgcacgaagaattaaagttagcaagatgttcgtatttagtccctactatatttatgtggtttgcttttcgtctctattatcactatttatcagacagaactcaccccttaatctatcaaaaccatctgaataatggtttttactacttaccagaataatccaaaactctaccttgcaacgttagtagaagaagcagtaaagacaagtacactagcttatacatggccggtttggaataaactgctctctcttttactgatcgacagatcgagtattcagttacaccattcgatccaataattcagggaaaaactggaaataagtaggagacagttgcagcagtttaatcagctcgagacggcatgcatctgcatataccatccaagctaatactagtagaaagtacgtacaacggacttacggacacgtactgtgtactaccatacgcgtcctttcaagttcagaaaggacactgaatttctgatcaacggtccatgcatgatgcatccccgattacaatttacaaatatgcaacacattccatgcaatccagtcattataatgttcgataatcaaaacaatcattttcgcctatttttcctggaaaaacttctattaaaagttgaggtcagagcatcagcaacttgtcgattgcaagtgcccggccaagaagggtagaataatcgtcagaatcttcagttagctgatcctgatcataattcataccgtattcataatagaataagtaccttgaagaaacagcgatcgagcattcgagccggtccaggtgaagctaggctaatcatgtgagtattgcataagcagattggaagagaagcagcagcagcagtggcgacatttgtcaggttcgttatggttgggtagccacgcgaagttgtgtactttgtgtacggactctacactaggcaatcattagtggtccaggtcagaaaactgaaaaaattaatatggtcatcggtggcgtacttagctcattaactatgatataatgttcatcattggtagtaatctaaatcactggagaaatcagctgagaaaatccgtaataaatttgctattcgtatgattttagtaagagcaagtttaaatagtatagtcaattgttagatccaaatcagtttaatatccaattcatacaataattacctataaacatatacaacactattaatgtctggtcccacttgtcatatatacattgcgtcttagagtctgtactgcagctgactacaaatctgtagtccgctactcatctcttccctcttttatctcgatatgtgttcatagctgacttataatctgttgttgtagctgctccaaccgacttgtgctttggaacggaggaagggggtgtttagatccactggcaaatcttttttccctgtcatatcgaacgttgaacacatgtacggagtattaaatattgaaaaaaaaactaattacacaatttgcgtgtaaaatgcgagacgcatcttttaagcttaattgtgtcatgatcagacaatgtggtgctacagtaaacatttgctaatgacggattaattaggcttaacaaattcgtctcgcagtttacatgcggattatataatttgttttgttattagtctacgtttaatacttcaaatgtatgtccgtatatttgatgtgacctgacaattttttttgccagtgaaactaaacacaaccgaactgtctctgatacctacagcttccgggcgcagtaaaagccctcctccgcacgccggcggcggctgcatcgatctcctccacttgagacttgagagcagtggcggatccaccatggggtctatggggtctcgagctcccactacctgtgttgtaatcatgggagtccccataaagaccccactaaaattttctgccatacattcattagaagagggggctataaatttatatagtttgtttaaactctcctattaatcctcctagatccgccccttcttgagagagatggcaacgacttcaatttggaggtgccagcaccacaggcccacagcttagttggttttgctggccactcgcctccccattagatttcaacctaataatacaagaaaacgatgtcctcactaaagactaaactctagctactgtcatagtacatacgtaccgatcaacacctctgttatatattcatcgtatactttatacaattattggagctattagcacactatcagtcgccgtctcaagtctcaacagaccaaattatcaaagcgtcgacgctgaattctttgtggtaataattgctggtggtatcgcatccgtattggtgggacaatatctagtgttagtctaagcacaattagcagtatagtatatgaatgtgtaatgtggatagctagacagatggaaaacaaaccgtcctttgatgtatactctagatcactaatcccagacgtaaagaagaacggcaagcttatgaaaacacgcagaattccagaaaagtttttcttttgtgtgcaatggctacttggctagtggcgcgcatattgattgatcgtattgtagctagatcccattatatggtcctacttgtactatgtccagtagttacccagtcgataccaacgggacccgcgatgtcgtatctcgtatgtgttccaactggcatgacatgattattggaagcgacttctgctatgttggtcaccacttcaccagatactcctcccgtctcgaaaagaaacaacgattgacttgattcgtaccgcgaatttaaaccttgttctttttttagacggagtaagtaggcaattccgcaattaaattagctgagcagtgcactgcgtgcatacacttatgtcttccgcatgcgaaaacaaaaatcacaaaaataatataaaattccccaaaatcaaaacctgaaaccatacccccccccctcctgctccatcgccggcggtggccgatcccatgcccaccagccgtcggaggccgagcctgtcgccggacccactgcagctgctcctgccgtcatgctagatcaccccgctgcctccggatccacgtgcgcactcgctgggatgggggaagggggtggagtggcggcccaatctgcgtgggagggagaggggatgccggatctcaccgttgccacgcctcccgcctcctgcctcccgcccgcccaccgccctgcactgatggagaaaccctttgtagtcccggttcgtaacccccctttagtcccggtttccaaaccgagactaccaatccgggactaaagatcgctatctttagtcccgggtgaaataaccggaactaaagatcaatctttagtcccggttggtaaccccaactgggactaaagatggctcagccgtcccggttggtgttaccaaccgggactaaagatcgagctgacctttttttttcatggccctgttgctgcatggtttatatatatataaaccatgcatatatatgtttcagtacatatatgcatatataatatatgcatatatatattatattatatttatatatgtttcaatacatatgtacatgcataatatatatgtatttatacatatatatgttatgcaaatgcatctgtgtgtgtatgaccaaaatatatttacattatagaaaatgtgtacacatgcatatagaaacatatgtagtcatgtattaattacaatccattatatgtcctagctagctacgatttcgatgtagtagtcgctagctcacaagctaaggacctatgaattgtgtttccgtcgtagtagaattcacccttgggatcaaagatttgttcgttgatgaatccaaatgacggaaccgataccaagccctacatggagtttaaagctatgattcgtagtagcaattaacataacaagattttcttaattaacagaggaacttatgacggtacctatctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtataggaagacagtaaaattaaactaactctgtgttgtagggcaacagtatgaacatcttgtaatgctgcaccttcaggagatggacgagattgtcctctgtggcttgcggatattggtcgagcattgcgacgtttactttccgagggtcgatgaatccagtatcgaaaactccccgccgtcgggccttttgaatctccattctacaacgataaaagggagtatattattttctatagtctacttatatacaaggacctaattaattaaaggagacgtattaagaaatctaactgaacgatatacttacaaaatccagcaactcataatagagacgtcgagggcatccagttggtatagttcgtagattcccttgaaattgatccagagaatgtcatctccttgcaagaagtccatgtccctgatcctcgctccgatcatctctctaccagtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattcttctatcgtcatttctttaccggtcactaacggctcaatctcctggtttggttgctctccaagctgagggactggtttggactttccagaagatgctttcttcagcgttcgctcatagtccgatagcttaatggcctccttggcaggtgcagacatacccctgaagaagttcatgacactcgggtctataggaatcttcttttctggacttcgaggcttgaattgtctcttgacttctgatgccatgtaagcgtcaagctcctcttgcgtgcaatcgtaccccgggtccttgttcttggcggcgtcagctttcgccttcttcgttgcccttgtgtgggcaggcggtggagcttggggggcccttgactttgaaggtgccggaagaggagcttgcggaggagtcggtgtaggagctcgaggaggagtcggtgcaggagcctgaggaggagtcggtgcaggagcctgaggtggagacggtgctggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagcttgaggtccacgtacgttccttcgaccaactcaacttcgaccttggagtatcctgctggaatcggcctgcagtggtaagtacctgaagggtccgttgggatggctatgcccgacgccaccttcatgtggtgagaggttatttattagtaatcaacatatataagcaacaactagcggaatgggcaaatctaaaatatataaactacgagcttacctttattgataagttcttgaaaggaatatgcagctcacatggtgtccgttgagtgatgtcatcaacggggcaggtggattcgtcctgggtttgcatggcgtccatgctctgtgatcctacctgccccgttgaggcgcagctgctacggtttcctgacgggctcaccattgcaggaggaatggtcggctagggatcattggaccgatgtgcggccatgcgttcatcaaccttccttgccacctcctcttgcatgctgagctcgtagctcgataccctgaactcaagatctgcaatcttcgcctcggtatctctcttgctcctcatccgactcttgtacgtgtggatgtcctccttgaacctaatcttccaaggaatcacccctttccctcgtgttcatcctggatgctctggagtctgcagggcgagtgacagctcgtccctctctctatctggtcggaacgtgccctgagaagaggcttccactgcgtctgttagtcgacgcgcagcctctcgtatctgatcgccgaagaccagtgagccatcagctgggttgagcgttccaccgtaagcatagtactagaacttcgatcgttccggccaattagcggtggccggttcgatacccctctcaagcaagctagcctccatctcctcccacttcggcatcacgacgctatagcggcctgaccccaagtggtgatggtacttcttcttggctgcattttctttgtttctttccatcatcgcctgcccttgttcactgtcttatatgcaacgaactcgtcccagtgatcccttagctttgggaatgtgtcgaagttcggtgtctgccccttcaggatatatttcttgtacagctctcccttgaaactctgaaactgttctgtcattttcttcagagtccactttttcactttgtcctctgtacccgcgggaagggtgaatgtctcgagcattgtggtccacagcatctctttctccgaatctaggacaaagctctcatgatctccgcgtgcccttgttcttcgccagtacaccgtactgacaggcacgttatcccgcacaacccaaccgctgtgacgtacatagttcttggcggcttctgccggggcactaggtcgtccatcttcttccacttccattacgatgtgccgaccctcaagcttcttcgcggcacctcattgcccacgtgccctcctctgtccaacggagggttgacttccactagcctcctcctcctggttcccctccacatccctttccacgtgctcctcctggttcccctccgcatctctctccacgttcccttcctcgttcaaatactggtttggatcctcgtttccctcttcttcgttccagtactggcttcttccctccgcgattgaatcgtacaatatctgttcatcattgcgatcagccatctgttcatacaggaaacatctgctaagtcatgagacatttatgttttaacaatcttatattaaaactcaaataatcttatatgctaagacaaaaatagccatgtatgctaagtgtaactgtcgtatattagaaccctacacaatcttacatgctaagtctaattacaaatctaataatcttatactaaaactcaaatagtgatatatgctaaatctaggtgacgtatattataggaccctagctagtcaataattatatactaagtctaattacaaatataataatcttatattaaaactcaaataatcttatatgctaagacaaaaatagccatgtatgctaagtgtaactgtcgtatattagaaccctacacaatcttacatgctaagtctaattacaaatctaataatcatatactaaaactcaaatagtgatatatatgctaagtctaggtgacgtatattataggaccctagctagtcaataattatatactaagtctaattacaaatataataatcttatattaaaactccaataatcttatactaaaactcaattagtcatgtattctaagtgtaactgtcgtatattagaacactacacaatcttatatgttaattaagtctaattataaatctaataatcttaattgcattacaaatataacaatcatatatatataattacgtcacttgcctgggcgaattccttcgagggctagctctaccactccggcttgagggacgactccgacaacgtcttttctgcaagatacaaaaagatgtattaggataaacgcgaagtaacatatattgcatttgacgttcacgtttcgttcacgatatcgttcacgttcgcgttctcgttaaggtcacgtttcattcacctacgtttgttcgttcacgttcattaacctgcctataattgcatttcacgttcacgttcgttggctcgttcacgttcgtccgacaacgttcttgttcacgttcattcaccttgttcttgttcacgttcattcaccttgttcttgttcacgttcgttctctcgttctcattcacgttcgttggctcgttcacgttcgttcgctcgttctcgttcacgttcattcaccttgttctcattcacgttcgttcgctcgttctcattcatgttcgttggctcgttcacgttcgttcgctcgttctcgttcacgttcattcaccttgttctcgttcatgttcgttcgctcattcgctcgttcacgttctcggtgtggcggcagcgggacggcggtgtggtggcagcggagcggcggcggcgtggcgccgcgcgcggcatcggcgtggcgcggcggcggcgtgcggcgtcgcggtgtctcgtggcgcggcgtcgtgtcgtgacgaggtcggcgtcggcgtctgaaactcggcggccggcggcaaccgagagggagagatagagatcgagatcggagagagagatcgagagggaggcggcgcgcggtggctctcaccccagagatgcggcggcggagaaggaggcagaggcggcggcgacgacgacgagcgcgagacgacggcgagatacggcggcggtgtcggcgcggggatgccctaggcagtggcggcgaaggagaagccgagagagatcgatcgggtaaaaacttctaagtgttggtggagaagacgagggcgcgcatcgggaatatatatagccctagatctttagtcccggttgttctcatcaaccgggactaaagatcttttcccgctatttccaaattctttttaaacccggttagggttaagaaccaggactactgataagcgcattgaatattattttccattacatatgtgtttctaaaatagaagataatgcattacaattatttaaagtacaaagattaatgacaattacttcgaaaaattattgttgtctgtaataaattaagtggataaaacgtaataagcaaatatatgatttaaaattaataaaaattctaataatcatatatacttagcatatgaatgatattattaaattggtaaaaactctaattaacatatgtatatacatacggcatgatttaaaattaataaaaattgtaatcatcatatatacttagcataggaattatattaaattaaattgttaaaaactctaattaacatatgtaaatgccacatgcatgatttaaaaattttaaaaattcgaatagtcatatataattagcatatgaatgatagtaaattaaattgtgaaaaactctaattaacatatgtaaatgccacatgcatgatttgaaacttttaaaaattctctagtcagttataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccatacatcaattgatttatatggataatcaatacatccaaaatagtttacatcgtgtacacaataattacggcaatacatcggcggtgacggttgaccgcacgtactttctcctcactattgttccctccttgtgatcgctacgtgagtaaggggtgtcttcatttgataggaggatgctagggttaatcgtcaccgtgaaagggggttgcccatccaactgatcgtaatcctcgtcagtcttgtcctcaactccgatgatttttcttttgcctgggagaaccacgtgacgcttaggctcgtcaggccctctacccttctttcctttgctagacatgtccttcatgaaaaagacttgtgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtcctcgatggcaccgtaatacgtgccagttgttccatcgtgtcccatggcatcgacacgaacagcgctgttttggttcgtgctcatcatgtcttgggctctcgtgtagaatgtgtacccattgatctcatatccctggaatgtcgcaatcaacccagacggtccccttgctaggaaggcaagttgttggttgatcgaatcgttacccatgagatgttgtcgtatccacgcggggaaagtatcaatgtgatgccgtgtaatccatgcatcggacttaccgatgttcctggcgtgaactagagccaagtgctcctcgatgtaaggagctaccaatgaagattgttgcagaaccgtgaaatgggctttacagaataaattgttgtctaccgtcattattgctttccttccgagagttccctttccccgtagtctcccttcatggcgtgattcaggtaccccgattgggcgaagatcttcgataaattctacgcaaaattcgatgacctcctctgttccataacccttggcgatgcttgcctctggacgagcacggttgcgaacatacttcttcagaacgcccatgtacctctcaaaaggaaacatgttgtgtaggtacacaggcccgagaatactgatctctttcacaaggtgacaaagcagatgcgtcattatattgaaaaatgaaggtggaaatatcaactcaaaactgacgagacattgcaccacatcattctgaagggctaatctatccggatcgatgaccttctgcaaaattgcgttcatgaatgcacatagctttgttattgttgcccggacattgtctggaaggatagcccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgtcgcgttgttccatatgctttagatcattacgtgcttccagtgtatctttcgactttccgtatacacctagaagccaagaaggtttacgcaaaggttcttagtgaggtgcatcatgtcgattgcgtggcgtacgtccaagaattcccaatagggtaactcccaaaatatagagttctttttccacatcgccgcgtgaccattttcgctctctataggctggcttccaggcccctttccgaacactactttaagatctttaaccatagcaaacactgttttcccgttgcgatgtttaggcttcgtacggtggtcagccttatgttcgaagtgcttgcctttcttccgtaccgggtggtttgctgcaaggaatcgacgatgacccatgtatacaaccttcctacagtgtttaagatacgtactttctgtttcatccatacagtgagtgcaagccttgtacccctttttggactgtccggataggttgctaagtgcaggccaatcgttgatggttacgaacagcagcgctcgtatgttaaactcctcctgtttatcctcgtcccacacggggacaccttccttcttccacaacagcctaagatcttcgaccagtggtcttaggtacacatcgatgttgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtctatgtttcgccactgcgaaccatcggcggggtgtctcagcatcccgtcctgttgacgctcttcagcgtgccatcgcatcattctagcattccccttgttcctgaacaaacgccttatccatggtattatagggaaataccacatcaccttagcagaaattctcttctttgttagctgcccgtcaacttctcctggatcgtctcgtctaatcttgtatcgtagtgctttgcaaacaaggcatgcttctaggttctcttactcctcaccgcgatataggatacaatcattcggacatgcatgaatcttctgaacttccagtcctagcaggcagactatcttcttagcctcgtacgttgtctcgggcaatttgtttccctccggaagaatgttcttgacgagttcaataaattgccaaatgccttgtcactaaccccattttttgccttccattgcaagaactccagagtggtatccaactttttgtgcccctgctcgcaacctgggtacaacgaagttctgtggtcctctaacatcttgtccaatttatgggcttccttttcactttcgcagtcctccttggcgtcctacaacatctgaccaagatcatccgcaacgtcgttaccatcagcatccctttcctcctcgcccgtttgatttccttcaaatccaacgtactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagctttggccactctcaaaaaatagtgcacgccgtcaataaactctttggaccgccggtcagcgtacatccattgccgatccatctacatgagtcgaaaaaaaatcgtacaaaaataattattcttacaataatgacagtcatacaataattataagataattataaactgtttcaacagtcatacaataatgacatatctttattcatacaaaaatcataaaatattacaccaaataattcttatttactatttctaaagttttaaactaattttaatgtgttttacttcttttaattttaattttagtttgttttctagtattcaagattaactttcactatagttttccttctcaactattttataaaaccttctttagcaaatcaactaaatttctatatattctttcttccccacacaaattttctccctcatcaacttacaactaaattttggagacaaaaaagtgtgcaaaacatagctgcaaatgtaatatgacaaaaaaacattgaaggatgaagttgcaaaccttttaggcacctccgatttgtatgtaattaccaaaataaatttactagaaattttggcatgacctcccctcttttttgaagaaattttgaagcttgctcgggcagctggaggaggaagaagacatatatatatataggggtgggactttagcccggtgggctaaagatccccgagatcccaaccgggactaaagttacgatctttataccaaccgggactaaagttacgatctttagtctaaccgggactaaagatcccggagggcctgacaggccctgacagcatttgaaccgggactaaagatgatctttaccaaccgggactaaagatcaaatatgcccgttaccttttttaaccgggactaaagatcatctttagccccggtttttattgcatccgggactgttgtggaattcggccgatcgacgaaagatggcttctccaccaatgctcccgcccgccgcgttcttgccaggcggtggaggaggaggagctaatgagcctcccgcccgctgctgccgcacctcctacccaccgccggcacaccacccgcccgccagtggaggatgaagtgggagaggagagaaaaatgagtggggagagagataatgtgagagggtatgaaaaaatgaaaggtgac

SEQ ID NO: 79285 - DNA, 30351 bp, Oryza sativa
cttacattgtgaaacggaggaagtagcaacaaatacctgatgttactaaaatactaataaaagctttacatacgcgtatataatttttatggtaatatactaatgtctataagcaattttctcatcttttgaaagtgcccgtaggggaaagatatgtgtacgtgtattcataggggtgagtgtgcgtaagttgtgagcgtatgcgctgtagtatgtttcaaaaaatgtatttttagaagcatctcaaaatataatatttttggacggaggtagtggaacagcccgacaggtaggtcccacatgtcatgccattacgggctggaccggttcacttcccttcaaaagcccaaaagcccacttatttgtttctaaggcccatggacaagtaggcctgacctgccatcccaaaccccaaaccccgcatttctctttctccggcggcaagcactcgacctcgtcggcggcgatgacccgcatcaccgcgccgccgccgccgtcctcgccgccctcatccccgcctcccctccgccactcccccgctgccctgggcaccccgcgctcccgccgccgccactcgccttccccgtccctcgcgctcaccccgtcctcctccgcctccgcctccgcctccgcctccacctcgtcgaggcccaaggtgcggccgtcgccgaggagggcctacgccgcggctcagtgggtggcgctcccctctcaccccgcattctcccgcggggacggcggggagggcctcggcggcggcggtggcggcgccgcgtgggatgcgtcggcgtcgcggctgtacgtgtgggacccttcggcgcgaggcgtacaccggatatgcgtgcgggttcgcgatgcggaggcggggaaggacggggatgatgtcgccgtggaagccgccgtgccttccgaggtgaggtcgtttcctcttgtggttgtgtcagttctcacttgtaaaagtgatgcaattcctttctagacactgaactggaggcatttgtttgagttttcacgtttgtgaattaggtcaacttgcaattcactaacaaatgttgtgctagtgagtgcaaaaaatggaattcttagtgtcgcctagggggtttgtagtttaaaatgtgttgcaggaaataaacatatcgtgtcatgctatttttgatactggaggtagtaattagtagctgatgttgcctatgctgtccagatgttgatgccggagactgatcttggttacaaggtcactcatttatcacttaataccgacggttcatcgctactacttgctggatcacataacataagtattctgtatgtgcatgagagggtttctgaagatggtgataaggtcatatgcaggtacataagtccactatagctttatcttatgttattagtattgtactggtatttttcccgaccatcttgcaattatttaagctgcaataggttgttgcatatatacatgcagcatattcatagccgtgaacactaagagtaggtttctctgagtactcttatcatcagggtattgaagaacgcaactccaaaattttatttcaccttgctctttagatttatgacctgaatcattatttctcttcctttttttaatatcattactcatatcttctttctttcattgtattgacttgtacatatggaccttacaacaggactgtgccagttgcttctcagatcttacctagcaacaatgatggcatcaaagtactgcaaacatcgtggcacccttttagcagtagtcattttggagtcttgacatcagatgctgttttcaggtttgataaatgagtatcgatgctagatggaggaattccactttatctatgcttccttgctatttattggatttgattggaatggaaatacgtcttttacatccacacttaaattaattgaagacaacacttgcttttaaaaataattattgcatgacccttttatagaagttttgttattatttctgcaggttatttgatctgtcatttgatttagagcaaccagagcaggagttctatttgcaaccaattctacctggcaaatgccagaatgcttcatcaatttgtccagtggcattctcatatgggagtgatcatctgtgggatagattttcggtatgtttcttgaatattgatcccctaaatattgtagaagtcatctggaaaaaaatatagtaaatgatctacagtgtctttattagctgaaaacaaaaccagaatgatttttcatccgatgggattgttttgtaatttagcaagcaatatcatagcatagttaatattaaaccacaaaataggatattagagtcctacccgaattagccttatagaatctactccctccgtcctacaaaaaaccaacctaggtggggatcgctccccacctaggttgcctttttttgggacggagggagtacttgtttgcttcacacatgggattaaccttgcagtttctttatttacatctgtagcaagatttagggtgtcacaagtcatattactacataaatgaacttggcagctgattgcatggtttctacgcccaaaccctttttttctggaacatctaataatgtttgtccccactattcatgaaagagttactggaatacttttgatactttatgcatcactttctttcatgtcaccttttcaattggttgtttcgacatatgtaatatttttagtagtttcggcatacttcgtatgtttaatggctcatttatgtgcttaatttcacatgtaagcctgtccttttacaggttttcatcttattcagcgatggttcaatttttgtgctctgccccattgttccatttggaaggtaagtattgcatttatttctgccctcccccacccctcttttctctctattgggaagaaggcttacaacaatttgacagcatgatggtcctaatttgttaaaacaaaaaaaatactgtactaattttgtttatgggaaataaattatggtccctgcagtttcacactttcactttgtagtcttgtatttatgaaatgcgaccttaatgatatgatcatatggtgccctttctttatctgcatattggttttgactttattttttttccctgtgatgcagcgattacaataagaagcatattcaagaaatatatgaagatgttaattcatttggattgaaatcctcaaaccaaaatgttgtcaccaactcacgtttggcaattgcttggttggaagcaacgtttcctgacttgtcacgtcagccagctgataatagtgcattgatgtctagagctcatccatacgcatcattagatgattctctaactttacaggtctgcttctatttgacttggtgaaatattgttcgaaccaaaagctagtggactatgctaatgcaatgaccagagaaatgtgaatttggtgctcatgcagctggtcataatcaatccattgttttttagtatatgagatttattgttttgtaggagttaggagctgattggtttgcgaccagacatttccacaacttgcatgtagcggcggtgtctaccgcagacatgtaccgcattcacatgtctgcatgaaaacttttgtgctagtacgatttgctgccacagtttggaattggtagtgcgccccagggttcacctttctgatcgaaaaccgcaaaagccgctcggttttcgtgaaactgttggggattggtttgtgaaaattgagtgtttttagatggttttcatacggagttgaccaaatttgtcagattttacccgtttttgcttagtttttggtaaaccgaaagtggttttcaccttgaaaatggaaatgtgaaccctggtgtgcacaagatttgcgcttcattggctcaagaatggccataattactattgtactcagttttggtcatgacctaaaccatggattaagttgtccagatagttcccatgtttttctgggccagttcgcaatggctatgacagaaagaaaggaaaacaagagacagcactaactaaaacttctgtcttacaaaatcatgtatgatttttttgaccggaaaacattaggggaggctatttgactttattactctaggtctacaaaattctgtaaattagtttctggtactgaatatggaatttcttgaattaataaacaaccgcaaatctggtacttaagatatttttttattaccattttttttgtattgttgtaatgtattgatgtagtttgtactttgtgaaagagaaattatcaaaatactagactagcttacttggtaatttttgtagaactggacaatcattcttgatatgacatctgataatccaaactatagctacctattgtcaatgtacatgtaactatcttctacatttttgtcattagtaaatatgatttgattgatactccatgcagggacctctttgtagagtttgcgaagaaaacaatgaacctgaaagcaagagcaactcttgtgaaggcaaagctgtgggttttgtgtatagttctgttggcaaagattccattcttgtaactgcctggggtagtgggcaactccagattgatgctcttgctgatgaaattcaaccacagtggagcataggaattcctacccgccttaatgttgattcacatgggcagataaagagtgttgctatgatatgtgactctaattcagaagattcttgggccatgcgatcgtatcgcccgtccagtacgggatcaaatgtgaagagtaatactgatgctgtctggatggggcattctcctcctttgctaagactcgcaattgtagatttagcactagcaaaaacttccaatgatagctctttatcattgtttctagatccccttgttccagagagattttattgtgcccatggtgggggacttgacatggtcacactgcacttcctgccattttcataccctgaaatggcatccactccaccctctgtgcatcctatcctcactacaggaaacaatgaggcaaattctcccttcctttctggttttgttaccatagcagatgcatatggccatgtgcagttagtcagcattacatgcccaggtgagtgctttgtggtggagatgaagggttggaaggaaccaacgcctcttcagcttgacatagacagcaagagcattaaggacgtggaatcttttacaactggaatgatcagtaaagagctcatcgcaggtccagatccacccatagttccatcttcatcaagcttgaggtcattgacccctgactctattgaaggaaaatccactcttcatcactatattaaagttttccatgagtactacgtggagtatgggcataaggtaagaaactgtcaccatgatactttgcatataactcttatcatattcacatatttccagacctcagaacatgtcatttgtcattgttggtgaatggttagcggcaactagaattaataggacctgcagatgcccaaatccccaaacctattagctataaatgtaccatcactaatcagatgagaataaatgggagtataggcaaacataatgatcaagatattattttaatgattcttaggttttcattgagctcaaggaacatggggattacctgaagacagaaattgaggacaagcagaaacgcttgcaagcagtgaagcaatcacttctatccatagaagccaaagaccaagatataaacaaccggataaatcgggcctttaaggtatacgatttgttagaaaaacgcatcgagggcttcaagatacttcctgcggcaaacaagaaaccattgtcacaagcagagcaggagttcaaagcacagctaggtctgtagttgagaaaggtgatctttaaactcttcgaaacagtttcatttgctaacattatttggatccgccttttcttttttgcagataggtttgcagatgtggagctggatgcgttgtgctcttcaatcactgctctgagtgcgaggatgaaacgatttgctcacccggccattggcagtgcggctggtacaggaatgtcaacatggcagacaccaaaggtcggaagaagccatgtttcggactcccagactgtcgttactaaaatcttcgcttgagaagctctctctccttaatgaggagaacaatgtaaagctgaggctcattgagcatgaactcaagaaccaggagcaataggtgatgtcttgttcataccattgtggcggattgtagctacaattctcaacactgacaagtttttttttcttttggcaggtctttcagaacaactgtgtattacaagtcctcacagattctgatttctcgagcttgttatcgcccttttgaatcaaatcgctaccagtccactgtctactgtgggtgtgtgtgcagagtgcaacttcaggtgttactctgcaaggggacggcatcatgaacaagcctgttaacactcgaagcgcgtatcagcgtgaaggaaatcatgtaacgctacttgcaatgaccaccagcatgtgtatccaatagcggttttgataacttgcccactgtagtagtttctcatcctggggattatgggcgtatttaagtcttgatttcttcgtgcttcactgaatttgcacggtcagaggtccaaaccgaacttcaaagctgacgaggttgagaatgttgctcggtcttgattatcaacatggctgcatgatgttaccagcttgtctgctttgacgatgtaaaccagttgggagagttctgtgcgctaatttgcttgcgtctcgtggtatggtttttcagttggctatattttgattcatggccaccaatattagttcttacgatactgtttgttccggcaaatcttctgctttagtaattactccctccgtccttaaaaaaactcaaactatcctcttagtacaatgaatctagaccacccataaatctagtttttttttgggggacccaggggtaactggcaataacagttttaaaatgttaccccaacatccccggagtaatcactgaacaagaatagggatggaaggcaacactgttgcattgcttagaagctaatgctcactgatttcgttttctaaccacaaaactcctgtaacagagaaaccgcagagctaaatgtttctacctgaacattaatcttccccaaaacaagaatacgaatatacgatgaataagaaagcacgctcatcttctctgaaccttctgacgcggcagctcggtgttcgctagctatggcgccttcctcgctggctttgcaagcaaccaatggtgaaaggaggaaggaaggcgaaagggtgtgttttgcaacaaatggtaagcagatcgcaaccgaagattgcaacaaagcaaagacgtgctcaaatcttaatgacaccttagcgttggagaacaatgcaatacaagcatgacaccttagcgttggagaataatgcaatacaagcatttcaagttctgataccttatcgttggaaaacgatggaatacaagcattgcaagttcaaagcatcacaggacgcgatgcaggttgcggcttgcgctgccagtcgataccccaactcaaaagacccatcgtataatctccatcaaagttctctacggacgattcatcagttattttttttccagcaacaaatttccgcgcattacatactcaaaaaagaataagcaacgtatacagtaggaaagaaaggatttgcgagtccagatctctattacaagcctcctacatttctaccatcacgaggtgtactcgaaaggttgtggtggctgcggctcgtcgtcgacagccatggcagatgaggcctgttggcctgtggcagcagcggcgctaccagtggtcgcagccacagttgagggggcatcggtgagtgcgagtacctccgcctcggttggctgcatgtcctggaggaggatgaatccagatggagcaggtttcaccgggacatatcggctgccctcgataaacttgatgaacttctcttgggtagggatgacgcgtgctgggtttgtgaggatctggaaggttggttcgggttcaggagccttcttctccgccgcgttatcaacctgggaacaaatgaagttggttatgtgctgaacagcagaagagttgacactggatcaacaaatccccacaaccagaaagcgagcagcagagtagaagctgctgctttctgcaaagtttgttatcttggattcaaacacaataggtaaaagattaaaaccaaagagttatactaaacccaatcattagaaattttgaattatagctatcattacctgcattgcatcggcatccttctcctgagttttggtggccttgcttgaactagagccagaagcatcttcggttgctttctcctggttagctttgctttctgcatccttctttgccctagatttcgccttggcgtatgttgacaaaatggctgtcggcagtttgacagctgaagtcgtagtctgttgcgttgtcggtttgggatactcaaagagggatggtttagcatgtgacaagaactcaaacttcggtactttaagatcggagttgagtccaatgaaggctgttggcgagaaggccaagctaataaaatacaggagaggataccagtaccagaactgactgaaaacagcaaggccaaccacagcagtaagcttgtcgtgcttgttccttgagagaagtttgattgtgacattcctgccaccagcatctagaataccagaagccagtatggcacccattttgctcatggtgtcctcatgtttgtcaagaatgatcttttccaattgacgcctgaatgttccaacacgagaatcaaaggattcattagtctgaatcatgaccatcgccatagcaatgagagctccctggcgaacaaagtcaacaacatctgatgtgagaggctccaacaaggaaattgcatcacttaatccacttcccgcgcatgatatcccaacagctaaagcagcaccataacggacatgtgggttgtatgattcagagagcagggacacaattctaggagtctgcataatcacaaaaaagaagtgagttgtggatcaaagctatcagtgtttgtttattctaacaattagctggaaatattatgaagagatgctgcttgatcaaacacataatacgttaaagcatgttcacagcacaaatcaaatttaatgaaggcgaatcatcaaattaaatgaagacataaaaagtacaccatttgatagtgcacatacctgctcaggttcattgtatagaacaaatccaagagccataactgcagtcctccgaacatcgtcactgacgtctgatacagcaaaatgcagcagctggtgtatggctttgttatttgcagttcccctgtaggctagagccaatgcatacatgccaccgtaacgtaatatgggatcttgatcccttgtcatttgttcaatcagggtgtcagcttcctcttccctgccataaactgtcaacgcaatgccaagtgacaaacccctggaaagagagagatgtcagaacaagagcataacacaatataagaaattaccctgacagtaatcaaacaacactgacctaataatcttttcatgctgtgtatcatgagcataagcaagcatctcactggccttctcactggctgtcccaaccataagcaagcccattccaataccagctgcttcaccagccacagcactgtccgtgtaaagaacattttttatgtcctcatatatctcctcatctgctgttcccaaagctgcaagcccaaggcccaaacaggctccgtgctggatcacctatataatttgcttagaagtaagcaaaatatgcatgacatgaatgacatgagattaaaaagacaggaaaggaataaaaggacacctcagcactggtattgcgaaggctttcacgaaggaattgtttgatcccttcaccatggttagcatgaatcaaacccagggcatatagggcacctccttctgagtatggactaccaccaccaacggcaccactttgaggtaggtagggggccatcaaagctcgcccttgttgaagatggcctctgtgaatgacacctagtccagcggttgcgctgaatttagcccaattggttgccctgcttaaccactcctgcaagaaccaacatgagacaagaacaggacaaaggccaaaatgttgcataacagtaagacaacaaatagaaactaaatgtaccagattctctcttaggaaggtgtctacagttgttccagcatgcatgattgcattggtacatattgttgcactgtggcaaacactgttcctcatttccacagcctgctttattgttttcaaaattaaaagatccgacctgttgagacaaacaagttgcatcaaatcagcaccaggcatggaaatttgcaagactggttatcaacggttagcaagtactccctccgtttcacaatgtaagtaattctagcatttcccatattcatattgatgttaatgaatctagacatatatatctatctagattcattaccatcaatatgaatgtgggaaatgctagaatgacttacattgtgaaacggaggaagtaaatagtacgctcagttagcaagtaatagtcagctcacctattgtggctatacaaaaattgcagtgtcaactggatagatgtctcccctgacagtattccttttattttcgcaagcctatcagcacgtgctacctcatttggatctactgtgtgagaactaccatttggtgtagctgtgtcatctctcatctgaacatccccagctggttctgtgctgcccgtacccgcattagcagcttgatcatccggtaaagccgatccactatcagggttagactcaggagtttgtgaagccagacgattcctcacattcaaaaggaaagcttgattttcattttcaacgagatcaaaggcaatttggtacgcaaggagagcatcatcctggatattaacatataatctttagtaagttaaactgacatttaagtaatgccatttaaaagagtaaagagacccataccttgcttccagaaagcagcttgtccaatatgtttgccacagtttcaggctcgcccaagaacattaagcattggcaaatactcaggtaatctggatgtggcaatgtttggtatatcttaacaagacagcgaagaacctgtaaagacagtatattggagatctggtcagttggaatatattttagtttttttagcagtacttgctgtatgctaaattgggattccacctctaaaatgataattatattccaacctgacagaagtaaactaagagcagagaatttgatgttccatgaccctacctcaaatcgatattcacggtggttaacatattgatgggaaaggttgatacaatacgaaagagccccatgaatattgtcacatcgaacaatcgccgactccagtttgtcaagtctcctgcattcaacagccattcccatggcctgctgatatttaccgtcaagaatacacctgcaataaagaataatcaacagaatatcagataatgtaaacaataggtgaatgatccatctcatatgctgacatatcaacaataagaggattttatcatacttctccagcattctctccactatggcctctaatctggggtccacattttcttcctcctcggcgcctttagaagctttcgtcctgaaactggcatactcgtccaatgcttttgctgaagataggaaaatcaggaattcatcatggtgagtagatgacaaagaaatattagtctggaagcaaacatcctaatggttgagaacatcagacaactcctcacctaaaagagcatgagcataatcagaatcctcggaaatgtcaaacagaggcccagcaccaagtgcataggacagtgcatcgtttagctccccaaggtagtaaaatacctgtgtgatatacaaccaaaaatcagtaaacgagataaaaagctcgttaaaatgtatacataattatgtacggagtgctaccttagaaacaacaagtgcagcgagctgcctttgttcaaaatcctcgtcttcatacatgctctcactgcaaagaaaaaggaacagtagaaagcgattatacaggctccatgatgtaacttttttatattttctcaacataccaagtactccttttccttgctcatcatttagcatgttcatgatttttcaaatatttaaactttgtagattttgaccagcagttagcaagtttagtgaataaaattataccattatattcatacttcaaagtcctttcacatcatactgattttgtaggtactagctactaacaaatatattttgtaaataaaaattgtatgaagcttcgcttcacaaaatagaccaagctagaacagtttcataaagaacataaagataaacacactagctgtcaaaaccacaaacaatacatcagtaacaactagctgtcaaaacttatactgcaactgaactatctgttccacctcaacagaaccacattggcccccaatagaaataaattttgacagaaaagaataaagcaggcaattttttccttgctatatgttaaaacaatccctatagttccaattaactcatacgatttcacttagtacacataaaaagaacaatagttgcagaatcagaaacctttggaaccctgaatgtttaaaccctttggatttatcattcctcctcagttaaaaccaactgctgttcaatacaacagctagtcctaagagaaaaattttcagaattttacactggggtaccaattcaaacatacggatgaccagcaagaaaaatgtgaattgcactccaaatcttatagattagtaaggtataacagcacagagccgcgcattaaactaccgaattccctaagtttacaggtcagaacaaaacctaacctactgtttccaattgcagatcgaaccgaaccgagtccaagctagcgaatcacgcaacatcagctgcaactagggaaacttcccctccacgatactcatcaatcgggcaatcgaatcaacacaccaacaagcctaggcgtagccacggcaccgggacggatcgaacagctacagcctccacaacggcggccgacgccgaggccgaggaggcggaaactaggtagggcggggggaaacccaagggagagatggcgggggagcggttgggagagggggcgctcacatggtggggatgctggtggagatctccgggtagaagaggtgcacgacggacttgaggctggcgagcgcgtgcagcttgagctcctccgccggctcctgcagcatcgcgaggatgccgctcgcggagctcaccgtggccaccgccgccgctgccatggccgcctccgccgccgccgccgaagaggtgggaagtgacgagggtttggtttttttttcggttttgggtgtcgcgagttggcttcgagacgagggcgacgatgcgagaagggaatcaagtgcgggaggagctctacgcaaatatagagatggagcgaggggtaaatcgtaaaggtaataatcacaccctgattttccccctctgactcggataaggagcgatttgattaaataaaatagtatagtagatttttgcgaattaatgctgattaatcgcaatttagcattggtaatcgacacgaagaacattagtacatgccagtaattaattagtctatcaaccatcatcaatggctcaaaactaaaaaaatacggcggtgcaagtttaatttgcaaaatgaaatgattcaccaggatataattaattaagttttaattttaatttttgtataggtaaatatgatttttataacttttctatgaatatttttatataaaacatatcgtttagtagtttggaaaaaaaaaatactcctaataagaaataagaacaacaaagtaaatattagaaaaaaataaccaattgtacggaccctttacccttacttaatactctctccgtctcatttcaagtgcaaccataagtttttcgcctaattttaattgtccgtcttatttaaaaaattttataattagtatttttgttattatgagatgataaaatataaatagtattttactcgtgatttatgttttaaatttttttttaaataaggcagacagttaaagtttgacgtgaaaaaccatggctgcaatgggttgaggctgtcaaagagtttattggaaatgacaaaggaccttagtttaatatttaacaaatgtagtcccttttgtgaatatgtacaaggggatatttgctaaatttgctgccgtccaattctcccgttttaaattgttcagtctcttttatcatcctctcccctgatttttcctgccaaatccgcgaaggctacgtggatcgaggaaatgtcgctgttttcaggctctccgttgagaaatctcagagagttttcagctgtggccacattcgattggtcgaagtgcttgtgaagttgtggtaagtgcttcggatcgctgtataggttgttcaaatctgaaaaagccgttcagaatccaatcacgctacagttctgagactacctcgttgttgcctggtatatgaggattgcggtcgtgatgtttttctattgctgttcgtgaaaataagatgatattcttctcttaaagtcttgaggttgagcctgcacggctgcacgctaggtgtttgatgaaatagctgcgtggatagctatatgagatggtccatcagttcatgagtgcatgagttacataaatctttggaacatcccttgccaagattatatatagtcacatatgaatacttctattgaaaaaaatcattacataactattttgttgttggaacttggaatgtgcacccatagattccatctgttaatcttgcattcagggacacagaacgttagctgttttttctattgagtgttgagtcccgtagtactagatcttaaaagttttttttttccagtgccacattagcactagatctgttggacacaatatacataaacgcatacatcattgttgtcagtatatttgaagtataaatatctcagatgtttacatcagtactttcttgcgcacaggttggatggagatcgaagttgcactgcttgcaagagaagacccagttttgccctttctgttggcactcatcgcatacataagccttagccatgtccaactcaagctcatgctcatgacggtgatctctcactcggtgaggcaggctgtccctttcctttttgagaacttcttccaactcataagctcttgattctgtaaaagggaatgccattgcaccatattttgaaattattctccttccgtctgttttgaacactttaccatctggtccaagtatcaagagtgttgggatgcctttgatagtgaagattctactgagttcttgcacagttgtgtcagaataggggatagcaaaccatggcattgcactcaggcttgcttggaattcttcctcattgcggtccatggaaatgaatatgacctggaaattcccaggtctcaaggctttcagctcatcgtacgcctccctgagttgtttagtgaaggcacggcaaggtgggcaccagtgtgctccaaagtacagtccaattgtcttgccattaaggtcagatataggagtctgaaagagttataatagaaggtgaaatggtaaagcaaagccaattgtacctgatggggatgaggaattcaaagcaatttccgcttgtgcatgttacacattaagtttgttggtccatgcttcctttcaaggatcatagtatccaaaaaaactgttgtgctgcacctgtagctatattcctttattttttatctcatgtagcttcataaagcttcacctaattcatattttgttggtttcattgttttgtgactagattactattattaatctagcattgccagtttactcagtttaatggttatacaatcattaagattttgatgactgtgctcatatattagcttgtattagtgcaatctgttggggttcttgctagcaggttactgtcatagcatgtatctatatactggcaccatctatcaagtctgcatcatctagccttatattttacctaaacatacgcaatgcataaacaagcaaattacgaatttataggttatgattttggtcacctttatgccatctgcacttatgacatattctctttccttgcatccaagaagttgcagaagattacctccttgtctcctggcatcatccataccctccagttcacttctcctctttgcaccaaaggggtaggcatctactccatactcctcaaccagcttcactgcatcctcttcgactcgaaatccatgagatagcgttgttgacagaggaatcaatgctgggatatgctcaatgtcaaattgcacacataatttttgccttaggccagtgtcaaaaggcaaggcaagccatggcatgcctttgaagtagtccaagaagctgatctcgtcgcggtcaagtgatatgaagattatctccatattcttgcaagtattcctgagtttcctgtagatttggagcaactttggggtaaagttcctgcatggcctgcaccagtgagccgagaagaagaggcagattctcttcccttcaatggacgacagaggtatttcctgtttttgatacacaatgacaaatttaggagacaactaattcttctctttctgaaaccaaaagcaaacatatttttgcagtactgcatagtgtgaagttttaatactgatactaatttggaaaaactatgccatgttagcagttttatacttaagcagagatctcagatttgatcatgaaacagaacagccaatccctggagtacttctatgtattgatgtttatttgctatatttaaatcatgcttggatgccaaatagtatatccacaagaaaattagagaatatttattcagaacaacagaacacaagctaagctgaagatcagggctatcaaatactatgatcagtctcacctttcctccattggagagaagagttccaactccagccaactgtggtatgctcacatatttctcgcctgcttcaacaccttctgccgtctctcccatgtctggcaatgacaacaagaaaagaaacagctgctggagttttatggttttgtcgtgtgagcaccgatgcttcaagtggtctgttccaacatggcttcctagggatggcatctttggcagctagtgtgtgcaaattggttaggtaatattctactaatatgctcccagaatcccagcagttggggtgaaaaacacaagaaggttggataaggataaaggttggtatcaagaacaggagaaggtgaaacagaatgagtgatcatccttccagtcagcatggatgcagatgatgtggacagccaccttgtgccctgtaatttccctttttttctgacgcaattgcctacttagaatagaataccttatctagttatctttgatatatgagaaaatgtgctcttgaatagtactatgaattagtatcacatatttcattctttatcttgagaaatctgatgaaaaaaaaggagtcaagagtcaagacatgatgtggccttgattgggtcaggcccagcagggaggaggctgtaggcccaagcccaacaatctccatgatccgattgcttttacagttcatcagccatcgctatcgcaaattcgcgagtgctccgccgcgcgtacggtctgtcgtgtgtgtggttctcttgtccactccaatggatttctggtggatcagaggaaggcgacgacgccattgtggaatcgcgtgcttagctcgacacctggtggagctgctacgcaaaggagcaccttctcatcgtgttcttctcctcgaggtgtttcaggctccgaaggtacaggattcttcaggttgatctaccgataatcggagtgattcttctccttcttgttgactgtttatcgttctttgttgcgtgcttcattgcaacagcacgtgctggaaggagaggaaggaagttgtgatgctctgtgattctctgggaggtttcttggctccattagccgtactcggggtgatgtgatgctgatgttgtatgggcacctcgaagatgtggtatcttttccatgaggtttatgagctgctgcatgctgcgcccaagtgccaacactgtccggctcactgttgaggagactcttcagaagagggttcatgcatgcaaggtgtttgttgttggttcccaaaggaggagggtgaggaattgggtggtgtttgccaagaggaggaggaggagtagcaagaggcagcgttgatggaagagttggttctccgatgcatgggtctggcctgattggagcacagatgatgttcttgatgcctttgatggagaggaagagcttcctaatgatgagaaatttaaagagtggaagggaaaggtgaggccattgttgagctgtggtaggcacaacaggaggcgatgaattcagaaggacgatcatgggaggatcggattgactcaggcagcttggctcattgaatctcaagtccaaactaaactttatttggaagggaaaaaacacaaatttcaggtgaatagtcttttttttcttctcccaaatgaaattgagtttgaacttgagattttgtgataatatatgtcatgcctatacctatctctagcatttttttcatgaatttagagaacttttaggtcaggttttcatgggttttcaccttttcgatggtttacactggatattttcccttttagttattcttgtattgtatattttagcatgttgtaaagtgctaacgattcaacaaatatgcaagtgtccacatcctattgcctgacatcatcataggaccaaatttctgatcttacagatattttactccaaaaatagaagataatttctccttttgcgtggtagcaccttgtgcatagcaggaacttttcattcacgatataccgagaaagaactgaaaatgaatgccagtatctcttctttcaactggaactagtctgtgcagaagccatccttatatgaacctcatgagccattgaactttatcacgattttactattaatttttttttgacgggaaacagcaggagaggctcctattgcgctatattaaatatataataaaaaggttacaatatttacaaagggacaaaaattaggaaaagtcatatatccatgattgccaatctagtttatctatctcctttgctctgtgcatattaattgcgtcatcctttctctgaagttctcccttctacaattttgcataatcattcggagtcaagttggcacacattagtagaagtggttctcgaacactatggccttgaagctgatcaagctgcaattaccatttttgtacgtgtggttccaattgttatggatgtatttgtgaagatatgggtaggttttgcttgtcttttgctctttgttcgttccaggatactgcagtaagtttcatttcttcatcagtaagtttcattttttttgtcaacctttgtgcggccatagaagatgaatggagaacttggattgcagcgggcttgattgtagcttcgtaagcggcggaggcggccgtgtgctgtagccttttttcttttctgtcttctcgcccttagttttcgggggcgtgtttgtaataatgcacattcttgcactctttcttaatatactctggccggcatccttttgctggcccggcaaaaaataatacattttcatgattaggcagttgaaattagatttggagttaggattctatactttcaatagctttttctaccaagcaattgcaacttttaagtgattgtgccgtttgttgccaccatagtgactgtgagtgaaaatgcattccaatgaggcctgcctggagggaggagcgatggggcgtgaggctctcacctaccacccggcggaccaccactccggtgcccgccggccaccatccaagccgcagttcggctcgtggcgcgacgtcgtgaagaaagataggggccttgccgccgctgaggaggcagcttggacggaggtccggcggaaggggagcacggagcattcactgcgggcaggtgacccaacctccaacaaacaggacagagcattcaagccgaggaaggagttcagcaaccatgacagggcattcaattcggagaaggagatccctcgctggcttctggggcgctgcttcaagtgcctaggattgggtcatcgcaagcttgactgcaagggagagacaaggtgtttccattgctggtacccgggtcacctagcgtgggcgtgtccggagaggaaggcggtctctgggggcaatccggggcggcagtgcgtctgggcgcagagaggtggccgtctgggagaagagaacaacaggggaaggtgaagcaggtggtggtaagggaggtgccgccggcgaagtcgaagatcgtcaagccggccccacaggcgacagaaaagggcgcggtgatagccatggcgggtgctaacctgggcgggtaccagatctgtgcggccacgccgccgcagttcgtggaaaagtaccgcatcggcgagcccgactcgtggctagaaagggggcgggtggtgctgtcctggacctccgggatggagcgccatgagaggtacctccaggaactctccctgatggcgtcggtgctcaagggacggccgcccgtctcgccggcagagcttgcggagacaatcgagctgcacacaggcgtgcagcagcgttacttcagggtggaggtcacgcgcccggaggatttcctgatctcgtttcggaaccagagggagaaggaggcggtcctgcggtgttcgaaggcgctgttctgtaatgaggtgcctgtttcgttcaagccgtggaacagatgctgctgggcggaggcctcggctttccagttcttcaccaagatctccctcgacggccttcccccgcacgcctgggaggaggaagccatgcacaagctggtcaacagcttggacggtcagcttgccgagctgatcccggcggcggacgcgcgctgcctcggtctcttcgcttggttcaagaatccgtccgaccttccccaccatctggacgtggaaatcccggaacgcccggccgcagggcgatggcgggaggggacgagcgcgacaccaccttccccgccgcgggagaagccggccctcacctatccggtcatcatccacgtagaagaagtcattgaccctacgccgttgcatactccgccgacctccttcgacgacaactccgatgatgaagacgtcacccggcggaacactttctcctgctgggcaggtcgctacgatggcgctggtccctggccgacggaggtgggaggcggtcatgtctacggcggtgcgaccggttcggcgggaggtctaggcgcgcgctcctttgcccccatcccaggggaggtctcggccccgccaaggcggttgcttcaacgcctggcgaccatgccggcggcggggcagtcggtgacagaggagagccaggatgatgctgtcttgacagctgcggtggtgggggtcattgacatggcagcggcggaccgggttctagaccgggctgacattgttgttcaagacatggaggcgggggaggtgttggcgtcacagccgcattcaccgacgttggttttgcaagcgccgggtgtgtggttctctccgcaagcggtgcaagcagtggagcaaccaggggccgacgtgggaatccctaccccgctggcggcgcctgtggttgcaacggcaaaggcgcttatcgttctggacgacgactgcagctgggcgctcgtggccggtggtgtgtcgcctctttcatcgccgctccaactctccctggacgagttaaccggcggtgaactgtcggcgctcggcacggagaatgatggcgaccgtgctgagctcagtgatgaggtccgggaggccactgtggaccacgttcacgttcacggggacgacctggcttcagggcaggaagtcgcattaactccgaatgggggatatgcattaacgcgtgttgcgtcggcctcgccgcgtattagagcgagccagtcgtcttttggcacgttggccaagaagctctcttttgaggatacgatggctgaggtgtcgctcgtggagcatgggtgcgagcggccagcattgaaggcgactggcgacgcgctgagctcaacgcaggagagcaggagtgatcgtgggtttgaatcggcggcaaaggcgggagagttccgtgtctatgtgcggaagcaggcccagaagaaaccgagccatgagcaacctgggccggaggggatcggcctcatgggcttggcaggccaggatctggggcaggctgacctgggacgggctgtggctggcgtgggacaggaaatgtcggtgggccaagttgtatgtggcgaggacgagccacctcaggcccaccaagaagaagtggcccacagcgacgacgagcggccggtccaggaaactgagatcgagagcagcagggaggcgctcagcggagagatgatgctcccacctcccgcctcgccgtcgacagcactcgcccgcgcgcggccaacctcggaggggtcgccggcgaacacgccgctaccccccgaggcggaccagattcttcagggcttcctcgcgtcggtcgctactgagcctcccccctccctgctcgggaggaggccgccagcgtcagtccccaaatccaagcctcgtcggcgcaatgtgatccctgaggggttcacgccgtggcgcagcccacgtctgcaacaacaagggaacggagctcgtcgccattcaacttcaaaagcgcagaaggtaacgatgaagaagatgggcatcattgaagaggaagaagaagcggatcaagacaccttccagcagtacactaccgtgtttgatcagccgttatcgacccagcacatgaaggcgctagcggagctgctggatgtggatgttgcgctggaggaagcagatgttccaccgccggacctggcttcgctggtggcggcgggggtggaatcccctgcttgagcggcgttccggcggcgtgcggcggtggtggagagttttccctgtttttagtttccatgtctcgtcttagtgtgctagtgtggaatgtgagggggttgaataatcctgcaaaaagaagagtggtaaaggagtctgttgttaattcgcatgcgtctgttgtttgcttgcaagagtctaaattagaggtagttgatttgcttgtaatccatgaactgtgtgggctggatttcgatgatttcgttgcccttcccgcgtcacataccaggggcggggttattgtggcctggaaggggtccgtattccgtggatcacaagtgcatttgggacaatggtcggtgacggcgaagttggagtggactgcaggcaaccattcatgtttcctcacttcggtctacgggccacaagatgataacgagaagattctgttcttggaggaactcgccgaaatcagaggaatctgtggggaggtttggcttgtggcaggtgatttcaacttaatagcggcagcggcggacaagaacaactcgcgggtgaacaggcggctcatgaatgctttccgcaacaagattaatgaacttgagctcaaagaactgtatctgttcgggaggaggtatacctggagtagcgagcaacaatttcccaccctggtcaaatcggacagggtgcctgtctcaacggaatgggaggatgcgtttccggacgcgcacttgcaagcgctgagttcgtccagttcagatcattgtgcgctactgctttcttgcggggaaaccccgcggggtagaagaaggtttcgttttgaaactttttggacgaagcttgaggacttcgatcaggtggtggcggattcctggcagcagacggttgagagcacagatccctacgtcatcctgtacgtcaagatggcgcgtcttgctatgtctctctgttcctggggacaaaagaagatcagtcgctttcgcctccagctccagattgcgaatgaattgatcttccgttttgatgtggcgcaagagaaccgactcctttcccctcttgaacgccgtttcagggcaatcctgaagggccgctgcctggcattggcgtcactcgaacgaatcagagtgcgccagcgggctcggatctcccagctccgggagggagacgccaactccaaatacttccatatgaaagtgaatgcgaggcgccgtaagctattcatcccagtctttgagtatgaagggcagacagcaacctcgtaggaagataaaattgctctggccaaggactattttcagggaattttgggtgtggcggatcccgactcggctgagctccaattcaatcaaatcttccctccggcgccgaacctgcaagagctggaagtgcctttctctgaagaggaagtttggaaggtgataaaagagatgccaaacgagaaggcgccgggaccggatggattcaccgggcttttctaccaacggtgttggcaagtcatcaaaggggaagtgctggcggcactgacgaaatttcactctgggaatcatcagaatctcgacaatctcaacacagcggtgattactctgctcccaaagaaggatgcgcccacgttgatcaaagattacaggcccataagcctgatacacagcttttccaagcttgcaacgaagattttggcgtcccggttggcgccgagaatgggcgatctagttgctgaaaaccagactgccttcatccgtggccgatcgatacacgaaaacttcatttttgtcagaggtttagcgctgcaattccaccgaagaaagaagcctatgatcctcctgaaacttgacatcactaaagcgttcgacacagtctcttggtgtttcttgctgaacttgctccgaaacagaggctttgggtccaggtggcgatcgtggatagctgccctgctcttaacttctgaaaccagaatcttgctcaatggccatgaaagtgacagcttcaagccggcgcgaggactgcggcagggtaacccgttgtcgccgctactctttgtccttgtcatggatgcgctgcaaggcttgctcgccaaagctacttcctgggggcttcttgccaagctggacactcgacgttccatcccaaacacatccatttatgccgatgacaccattgtgttcctgcaaccaatcgagagggaggcaacagcggtaaacgccattcttcagcttttcggaaaagctacagggctcaagaccaacctcagcaagagtgctttgacgccgattaggtgtgatgatgatgtgttggtcggagttcaacagctgcttgggtgtagggttgagaatttcccgatcacttacctcggtcttccactctccctgagaagaccgacgaaggcggaagtgcaaccgattttggatcagctgtccaaaaaagtggccggctggaagcccaaactgctctctcccgacggccgtctgcgcctgatcaaatcggtgctgaccgcgctgccagttcatttcatgtttgtgcttgtgctgccaaaatgggcaatcaaagagtttaacaagaaatgctgagcgttcctgtggaaagggcaagaggaggttaatggcggccactgcctagtggcttgggatatcgtctgcagcccgaaggagtgcgggggattgggagttaaaaatctggaattatttggccaagcgatgcgaatgaaatggctcgctagacgattggagcaaagaggaaggccgtggactctgataaactcagtaccgacaaacgacatcaccggtctgttccaatcagtggcgtcgtttcaggtaggggacggtaaagatacggacttttggagggcgaactggttgccgaggggctgcatctctgtctcctcacctttgctcttcacacacctgggcagaacgaagctgactgtggcggaggcgctctcgcagaatcgctgggtgcgcgacattcgagggagtctctctgcgctggccttatcggaatattttcgtttgtgggatgagattcaggaggtacagctgcaagaggatgcccaagactctatcagttggaagctcactcctaacggagttttctgcacagcctctgtgtatgagatgttcttcgcggcacgggtgcgatctcaatgtgcggaattgatctggcaagctaggggcccgtctagacttaagttcttcatgtggctaatcaccaagggcaggtgcttgacagcagacaatttgcagaaaagaggatggccgcatgaagatggttgtgtcctttgcaatggcgatcaggagagctgtgatcatttgttgctgggttgccctttcacgaataggatctggggtctgctgagaacgtggctaggaactcctttccccctgcctggcgatgacgactgggagttcgcggactggtggattaaaaccagactctgttttcagacgggctacaggggcgcttttgactccctttgtatcctcatctgctggttcgtgtggtgagaacgaaacctcaggatctttgaacaaaaggcgagaacggcagcggagctcttcagtgatattaagaatgaagttgcagtgtggagggagaccaacattttgagagaagtcggctaaagagcccgctggtggcggattgttttgttttcctttcttttcggtttctctcgactgtttaatgtcgatttgtaaatgttttcaaacccttccttcaaatcttaatacaatttgggcggcctgccttgggccgtcccagctaaaatgaggcctgccttcattcagaatagaaaccaaacaaacacagcatgtaattcaaataacaagaagagagtgcacttcgatatccttattttgtttagttgtttttcagatatatggtttccttcccaagctatcacctactgtactaaacattctccgagaaatgaaacggcattagagaaattttccaccagggattttgtctcttttgagaaaatttctcagtgagggtcgctctccagctatgcacttgctatgtcatactttattccctactgtgttaagcatgctttgtaatctcactgcacggatcattttgtttcgagaaaagaaatcacccagaggcctaggttaagaccctggaaaataataactaaagaaaaggttatcggtagatcacttaatataattacatttagatatttggctcggatatttctgtatagcactgtactgcttggaaatcattagaaaatttaattatgtgtcgctgtcaagaatcgtatctttcatttgaccagaatcttgagccattatttgctttggttaatgcttttcctttgtacaggccttgtctcgaatggggactctttggatatgccatggttggatgtcgcaggtgtcagggtccacctgacctcaatttgtctgtatagcagggcaacatatatacctgtctattccaagttccaacaggatatatatcagttgatcatgtgatgctagaataatcttccttctttccaattcactgtaatgcaaaacttctgattttctgaagcagctgttgctatatatacatgcataacaagagctcaagtatacagtcgcaaactctgttgttattctgtggtttcagcaagtaaaactgtaacactgtaaactgcagaagttcgatgcgacaagtggttcaatacatcttcgtctactacccgtcttgaaaatgatccatccatccctgctgcatcctgattgcttcagatggtggctacctgcccgcctgcctgccattggtgtcgcactaacttcaccagtttagggttatagttacttaaaaaaaattggaagtttgaagaaagttgagagttttgcactaacttcaccagttcagggtgttagtttctgaaaaaagttagaagtttgaagaaagttgagagtttggaaaaaagttgaaagttagtgttaatttctgaaaaaagttggaagtttaaagaaagttaggagtttagaaaaaaagttgaaagtttatgtgtgtaggaaagtttttgatgtaatatgatgtgatggaaagttaggaatatggaagaaactaaacacggcctgttcagatgcaaatatcatggtgatccctcccatgggcttgcaacgaagtttacgcggtctctgatgaaactcgttggcgagattggctggtttgattggcgagattggctggtttgatggtgtccctacgtgtaagttcgcatgtttctcacggccatctctttcacactcacagtcacaggacccggaaaggcaacgcttttgtttctttagcacggagcaatccccgccgcggacgcaccgcacatggttgatttttttaaaattttttgaatcatttaacttttattttaaaaataaattatttctaaacttattttcaaaatttaaacagcacgtcacctgcaccaggatagttgacgtgaccagaatgtttattttttaaaattaaaattaagattaagaatgtttaaaaagttaaaaaaaatccacagggttgcttccgacaaggaataaatcacacacaagtcaagtcgtcacggtttttcttctgcttttaccttagcctcgaatcaaagagcttgcttgcttgcttggtcttgaccttgattacagcatgagaggacgatggagacgcggattactcacggctttcacactcggactccagattaacagttttattattattatttttttgctactccaaactttcctcccaagaataaggtcggcatcagcgtgagtagtgacaagatggttaacaacaggaggaagaaagggacggtcaaagggcaagtgagcaagttgatgacattgtcgtttgagttcgattaataataattaagaaaagaataaaaactttaatcagcttggtggctctaactgcatggttggatagaatatagatccaaaaatattggttacatgattatgttaattactacacaattatagggcctataaatagcttagaaaaacttgtttaaagcaatgctgacatagaaatacttaagagaaacatataattttgaaagcgtcgcatgaataatctataccacattcaactatttagaacgcgatacttaattatcctagaggtggaaaagaaaagacttttgagttgagtagccacattgggtaccctaagtggaagaaaagaaaggccagagacaaatgggactcaaaaatatattttttagttacaaaacgaacgcgaatggtggttgtacttgtggtacttttgtgcaatctaaaacctctctttaagggacattgggtgaagaggtgagatgacaaggacaagcacaagatgcagcagtagcataactaatggtctgtttactttgatggcattttcaatcttaccaaattttgatacagttataaaaaaaagtggctatatttagtatactgccaaattttagtaactatataagaaatcatgtttttggtatagttgccaaatatttgctaaattttgttaaggtttttttcatcaaagcgaacaacacgatatactagtatagaactggatttgatttgatccttgtttaagctaatgataaacacggtgccctcgttcccaaatcgcaattgtgttcgtgccaatagccgtagttgagagggacaagggagtttggggtgtgtgtttaggtaatacgtgaaacgtgaaggggcgtattgcaaattttatggagcatatatagcgggggtaaagttgctcacaattcgctcgatttttttcccaataaatttgcccgagttttcctcttttggttccccagtttcagtttaagctcttaaaccctcgccgggagatttcgccgcaagattctcattctccgcgcctatttgcttgccagttgttgatcttggagatggcggcagctcagcaggcgcaagattcagctggttcgttgctttttttccccttttatttgggttgcttgttgattttggagttcttttttttttttgcttcactttgcatatcttctgtgttgaatttgaggagttgggtgggagtttatctgtgaaggtcgcgatcttggcggtgtttgttcgtgtggggatcgtggtaaatttgcgaattttcatggttttctggtcaaaattaaaattagcccaggactgagattttgtacgacgctgctgttctgatgctgtaaaatctcgaccttctcttctctctcttatttcttttcgttttttctttatttttttgttagggttgattggagaatagcaattttagatgccatttatccccaaaatcgattttgctgatagtgatttcttca

SEQ ID NO: 79286 - DNA, 97752 bp, Oryza sativa
gacatcggacctccagccgatgtatgctttaaccttcgaatcgatgcttatttatcatatcattatttgtcagttagtttatattagattatattgttatttcattacatcgttatcagccgattgccttcatatcattatctacattggacatatagccgattgcttaaaccctatcgctatcggctggtatcgacatcgactattatcggctatcggctggaactactccatcggcttgtcagccgatcgactgttttgatctactatttgcatatcttgtcagttgcaggaacaaactgactggcacactcgcatctcatcaagatttggacctgcacaggagctaagcagatctcccaggccagtgtgtgttttttgcatcaacacaaattggcatgcccgatgggacacattagaagtcagcaagcggtttcttcatggtcgagaaaccaccatcatcaccgtcctcggctagcccaggttctattaaagagaagatccagaagttaggtttgtcagaggttaatgaagggaacattgtgaccatcgatccagagaagttcacacctgatcaaaagaatgattttgaagcgatgatgtagcaagcacgagaacagttcttgaactcgttcatgcagacccgcaagggagcacttgttcagaagtataaaataaaggtggttcctgatgaccccgggactagttcttccaaggatgacgaagggaaacaagctccagatggctcggctcaaccgagtgacaaaggttctacagatggttttccagcaaatcaaggtgacaacttgcaaggagtgcacggggttcaaggcgatggttctcaaggtgttcaaggtgatggtgttcaaggtggaggtgttaatcaagacggcaatgcagcacagttgcagttcaacaactttcaagattaggttgactatgctgtacaccatgctttaatcaatcaatttgggatattaactaatactttggcaaacatggtgaagtcaatggttgatggttcaatggccgagtatcaagctacaggactagtgtacttaccaggaggggtattccctaattatcggccattaatcaccgataatcaaccagtcatccagtcgattcctcttaatgcaccatcggctcagccggcagcactggtgtcgcttcctgcacctgctccaccaccttcggctccaggccaaagaataaatccctggttgttggtaagggaacagccacagcatgctggacagaatgtgaatcggctaacgcaagaccaggttgcatctatgttcttacctcctcagcacaccattgatcaaacccagcagcagccgattcaataaacaccgccaaggcagcaggttgttcaaccagttcagtcaacactcccaatccaacaggttgtgcaaccagttcaacagacaccacccagacgacaggtcttgcagccaattcagcaaacgccattaaggcagcaggttgttcagccgattcagcagcaaggctctatgaatgcattggctgggtttgcaacactgggtggtcagcctgggcagcatgctgcaaatcaagttattccagagcacttggttcatcacgtacaaccagatggcacagtgattcctcaagttattcctgagcatttggtgcacaatattcagccggatcttcaaaattactagggggcaatttgaattatcagtatcagccgccatcaccccaagttcagtatcagcaggcatgatcagctcaaccccaatttgttcctcaatacaaccaattcgagcctatgacacagcaatctcaaggaacacctcaacaacaacaatgggccgatttgattgcagatgtcatgaaggagctgtttgggcttaggccgaaagatgctggaaatttgtaccgacaaccctatcctgagtggtttgagagggttcctttgcccaatcggtttaaggtaccggacttttcgaaattttcagggcaagatagtacatcgacttgtgagcacattagccgatttttagcccagtgtggtgaagcatcggctgtggatgccttgaaggttaggttgttccagttatctttgtctggatcggcctttacttggttttcttctttaccatatggatcaattaacagttgggccgatttagaaaaacagtttcacaactatttttatagtttggttcatgagatgaaagtgtccgatctgacatcgatcaagcaaagacataatgagcctgtgcatgagtacattcagagattcagagagatgaggaataagtgctacagcttaagtttgactgatgcccagttagccgatttggcttttcagggtatgattgctccaatcagggagaaattctcatctgaggattttgacagcttgtcccatctcgcacaaaaggtgaccttgcatgaacaaaggtctgtccttatatgtatgggtcggatgatgaggatgatgattctgagatagctgtggccgaatgggtaaggagcaaaaaggttataccgtgccaatgggtaaagaacacaggaaaagaggagaggtatgactttgatatcaccaaggctgacaagatttttgacttactactccgggagaagcaaattcaacttcctactggtcacacaattccatcggctgaggaattgggcaagaaaaggtattgcaagtggcataattctgggtctcatacgactaatgattacaaggtcttcaggcaacaaatccaagaggctattgaaggaggcaaaatcaaatttgatgacactaagaggccgatgaaggttgatggcaatcattttcctgttaatatggtgcatacagctggccgaacagccgatgggggccgtgtaagaggttttcaggtaaattcgactaagattatcaacaaatatcaaaggaagtacgacaagcaacaggaaaagcattgtgaagaagatgatgatggctttaatcctcattagggctgtgagttctttagattttgttggaatgaaggcatgaggctgccatctattgaggactgtcctgggtgcagtgatgttggagagagctcgagccgatcatatagtaggggcaatcggctaaggcagatgagaattcctattcatcaaagattgggtccagtaaaccaagatcgtggataagaggacaatgaaaacatgaagactcaatggtgtccttctggtatctttatgaagaatcaaaagaaaagggttcaaagattgaggaacagagagcgcttttaggaagtcgagcaggaaatcaaccatcggatgaagaaaacaaagccgaggcaggagtggcgtgctaagaatcaagttctggtggccgatgaagccacagccgatgaagcaaaaaggttggctaaaggaaacagcgttgtaactgcttcggtcaacatggttttcacgttgcctaccgagtttgggatcaagcaagccgatatcgatgaagttgaagaagaatcggctaaattgattttgtcgccagagcaggtagtttttgagaagccagaggggacggagaatcggcatcttaagccattgtatataaatggttaagtcaatgggaagccgatgtccaagatgatggtcgatggtgggcctgcagtaaatttgatgccttacactacattcaggaagttgggcagaaacgctgaagatctcatcaagacaaacatggtgctcaaagattttggcgacaatccatcagaaaccaatggagttttgaatgtggagctgacagtcggcaacaaaactgtccctacaacgttttttgtcatcgatgggaagggttcttatagcttgttgcttggaagggattggattcatgctaattgttgtattccttcaaccatgcatcaatgcctgattcagtggcaaggcgacaagattgaaattgtgccagccgacaggtcagtcaatgttgccagtgccgatttagctctttgggagacggatggtcttgattgtttatctggaaaagattggggtggagattttctaaaagtgtccgattctgatatacagccaattgaaggagaacccaagctattattttgagggcgtcgtggagggttcagatgtctacaacaaggacacagtagatgatctcgatgacaaacaaggacagggttttatgtcggccgatgatttggaagaaattgatataggtccaggtgatcgaccaaggccgacatttattagtaagaatttgtctgcagaatttagaaccaagttgatagagctgttgaaagaattcagagattgcttcgcttgggagtattatgagatgcctggacttagccgatcgattgttgaacatcggctacctatcaaactaggggttaggccacatcaacaaactccgaggagatgcaaagccgacatgcttgaacctgtcaaggctgagattaaacaattatacgatgttggttttattcgtccttgccgatatgctgagtgggtttctagtatagttcctgttattaagaaaaacggcaaggttagggtgtgcattgatttccgagacctaaataaagctaccccgaatgacgaatatccaatgccggtggccgatcagctgattgatgttgcgtcagggcacaaaactttgagttttatggatggaaatgcgggatataattagatttttatggccgaagaggatattcataagacggcttttaggtgccctggtgcaattggcttgtttgaatgggttgtgatgactttcggcttgaagagtactggagctacatatcaaagagctatgaattacatataccatgatctaatcggctggttggttgaagtctacattgatgatgtggttgttaagtctaaggagatagaggaccacatagccgatttgaggaaagtttttgagagaactagaaaatatggcccgaagatgaacccatgcgttcaatacaatttcggcgagccccccaggtccgaaatatttggtaatgtttcgaatttgctgtatatcgactccgagcaagttttgcactttaccgttttccgaccgttacacccgtgctttaaatactaaccgtcaccctcgagaaatctttaccccgttacttccgtcttcaccgccgaagccaaccttctcctttctctctccggcgattcctccgacgctcgaggcgatccccaagcgacttcgtctccggttagatctccgcctgcgacgatgtcgtcttcctccagcccgtctaccgcgccatcagccgagtatgctgaggtaagttctcatcggctagatcccttttcctcgcataaaatcgattcctccttttctcattgtgttttcctcttcccaatttctttggatttgcagcacatttccaacctagttgcgatccccagcctgtcgcacgaaaaccactattttcttggcccaatcggcaatcttgaccccactgattttatcatcggtgaaaccaacagaatcccctttagactagccaaccctaatctaggtcactggaagaatactttcaaatcttggtcatctcttgagaaaaccacccctgagaagagttggaccacatggtaccagtgcatatcggctagtaagaaggttcattggaatgagatcgggatcggccaagcgcttgctctcaccatagccaaatctgctaaggacgaacctctgatggctgccgccacctatttctggtccaacaccatcaatgctttcttgttcaaccgagggccgatgactccaactttgatcgacattaccatgatcactggtttagatgtgacttcatcggctaatcctatgagcatgaacacaaaaaatcagttttattttagaactaaaagcataggtggctggtctggctatgtggcagcatatacgggccaagggtctgttacttctcgagagcatgtagctttcttgctaatgtggctagaaaagttctcttctgtggatccagctgtggccctacaaccaattggcaatttgtagctgaagccctagaatcaaagaaacaatttcctttgggcaaaatcctccttggctatctgtaccaaatgttgaacaatgtgtcggccaagatagccgtcggctcagtagttggtgcaggtggaccatggtggctgctgtaaacttggctgaatctgatggtcatgaaagttgtcaatctgccatctgtgacagaagctaaatttccattaccagagccgattgtggaaaatgatggagaagaacgcactcatcgcagatgcatgtcatacggagaatatgcatccacaccaattgatgctggagcaaaactatcggttgagctgctcaaagactggttctgcagcttctatgagggctttcagaaagatgcactggtttggttcccttatgaagattcagcagatcttgaacttccatcagactttagatttgaagacatcaattatgaaagatacaaaaagccagggaagttctcacagctgcaatcagcccatgcatcttacccgtaggcattcaccagggaagaaacatccaagtctcttacgagttttaccacccaatgagctcggctagacaacttggactgggccaactcccaatcggcttattctttgtcgacaagatccagtgccgaggagaaatttcatcaaccttaatgatggatcggctgctcaatctccaaggacctcctctaggcagtattgaaaatattgagctggcaggtttcaagagcagaaactttgacagatggtggggcgaatggaagctgcatttatttcaccaatcggcctcaatgtacatgacagatctattccctgatgttataccccaggtaaattttgtcattactaaactgcataacggttagccaattcattacttgactaatcttttgttcctgttttgcagacaacagagtcctcccctccacatcaaagcaataatggtagggacattgaatatgccccaggactaattccaaatggaggtggaccatcccctcctgtcattggctatgatgcccccaagaccttaactcttcttcaaggactcatcagagaaccagccgatacaggtaagaaaagaagaaccaggtcatcggcagcagatacattaactgtagctccaaagaagaaagccaaactcaagaaacataaaccaaccgatgatctgcctgtcctggatccatctattgagcaagctctggatgaagaagacattgatgatgatgttgatcaggctgcagccgaagtaagcgatacagaaaagacaccatcggcttcgcctaagcaaacacctccaactccttctgcccctactcacttcttaagagtaagcagctctctttgatcctttttgtaatcacctcattttcagccgatgaatcacagactttatagttgcagaaaaagaaagctgctgtgaagaagaaatcggcaacaacaattcgcaaaccggttccaccagcaagttatttaactctcttattaattaatcccagccgattttgtctaacacttgtctcttttacagcctcctcctcctccttctcctcatgtacagcaatcgtcaagtgaccgaactccatcggctgtaggaagtcatcatattgagggagaagaacaaccagctgctcctgctatcccagtaagttttccccttgatgcaagaaattagatcggctatatttacttagctctcaatcttcctaaaattgtccctgcaggttttagctgatctcttctcttttgacatcagagattatctcgatgaagcagaagaagatactttgagcaaagctctagcccccttacccgatgatgtgaagaaaacacttgaagatatctctcatcggctagaggcctcctctttagatagcttggtggtgaactgttagccaattaggactcggctacatgagatccaagctctaatcccagatgagcttgccgatatccttactctagcggtctatcttgaacaacatcaattcaagctagaaaaagccaagttaagactagccgaacgtcgggagcgcaaggatatcaaagctacaatccaaaccaatcgacagcttgttcatgaagagaaaaccaaacttgatcagctatctgagggcccgatcaagtccaatattgatcggctcgaagctcgcaagattgagctcttggcacaacttgaagaatgcaacgacgagctaggtatggaacataaaaagctggccgatctcccgaagtccatcgaagagcagaaagcaagactcaaataggctatcaagaatgttgctgatctgaccaaatctttgaaagtcatccctggaaccgatgctcaagatgcccaagctattgaagaagtagaacaaattaggcaaagggctatttctgctatccagcaatacttgtctcgatgactttttgtgtaataggccttagaaattttttgtaatcggctaacatactttagtactttactgtcttaacaatcctttgtgttgattaatacaacttctaacttcgctcaaaaattttcattttcattttttatacatacgtgcccccctaattttacaatgtcaaaagcattgataaaattataaaaacaactaagggcgatatagtaatatcggcaaaccacaactgattacaatatgaaaaaaaaacaagggcgatataataatatcggccatctcaagacgatgaaaacacatcggctatcatgtatcggcaacatcagccgatcatgcattaacccaaacgcttgggtaatatttcttcaagtatttgccatttagtgctctgccatagacttctccatcaagtccttgcaatatgtaagctcctttggatacagctttatgaatttggaacggtccttcccaattcggcgaccacttgccgaatttgctatctcgagtcccaatcgacaaaatcaacttcaatacaagttcaccttccgaaaaatctttgggtactaccttcttgttgtaatgccgagtgtcacatcctgatttttgtttcaggatttataaattatttaataaattattaatagaatttttattaaatgttctttaatttacaagtgaagttaaatgtgggaaataaaatttcctaaatataaagcatggatgtatttaatttttattaaattctccatgattaagtcaactctctgaaattttctcggatttttcggagctcaattcctaaatgatacaaagaacagttcagtaattatttgatcaataatgatctaattataattgttaagagcttttcttgtttaaaaatccgtaaattataaattgttgtttaaaaggaattattagaaatgattttaaaagcctaaaagagaagatctaattttaatttgctaaatctcaacataaaattgggctagataaaattttgttaaatactttgcttaattctataattcctagatttttctgggatttatttgagctaaggaagtatttttaataaatggaattgcatttcatgaataatttaaatagaaaaatgtttttaaatcctccttttggctttgggccgaaagccggcccaaaacctctctctttctctctccctccccggcccagtcggcccagtccgccgagctgccgctctcctctctctctctgtcgctgacaggtgggtcccacctgtcaggttcgtcttcctcgagccgccgccgccgcccgaaaccctagccgagccgcgccgccgccgctttccaattcggccgcgcctttccttctccggccgaatagattgaggggaaataatctcctcgatctcctcttccttttctcttatagaaactccggtcaatttcctttggaaataggcggattcgagtttgattctgattcgtttttccccgacctttccttctcgtcgccggcagccgtgggccttcgccgtcgcctccgagcccccttaaaaggacccccgagctctcctctacccatcgccaccctcgccttcgcctctcgtcgtccgtagagctctagcgccgtgtagcttttgcgcaaccgtcgtcgccgccgctccagccgtccttcgccattgctccagtcgtcgccatcgctcgggaagaccgccatcgtggtcgccaagtcgtcgccgtcctcgtccgccgcttcaccatcgccgaagaccgccggagaaccgtcgccgccgtagacccgatctatgccgccgcttcttcctcgtcgccggcgctgtccgttgttcctccgccgcttctttggtcaccggtgagttcgccgcgtcgccctctacccgttggtgcccttcgttcgcgtccttgtgccgtcgttcgccggtgagcttgcgccgtccgagctgccgagccgccgtcggtgctgacgtcatcgctgatgtcacccctgacgtcatcgtcgtcgtccgtccgtgagccgcggtggatccgttcgatctcggccgtccgttttggatagggttgatctcggccgtccgttcccgtgaaccgttgccgtgcacacggttcactgtgaaaccctagccgctgacgcaataatcctccttttccttttaaaaaataattcattattgcgtcataattcaattaaaatccatataagtgttttaatccgatttaatctttaaaaattcataactaattcattgtaactcagtttaatgtggttcaagttgcaaaaattatataaaataaagatctacatattaaaattatccataaattgaattaaatttatttagttctttttaaatgggctttaaatagatttaatcttgtaaaattcataataaattcatttgaagtcagaatgaggccgttcaagtctcataattcatctaaaaatatgatctacatgtttgtttactttttatgtattgtttatttggtttttattagtctttttcttcgttttgcgtgttagcttgtcgtttccgtcgttgtgaaggttcgcgagtgcgtcggaagtgttcaagaagattaattgaagaccgaatattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttaatccttgataccttgagttattataatttgaatagttgagctttatatattggttcagctagatattagatgtgattgcttagccatgcttagaaacattagcacactattgggataacttatgattcattattatttaatgatggtttattgatagttcacgatggttaatcgtgattggttaattaattacttgccaactaaaacttgataatggtgggttgtgagcacatggttttgacagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcactggggagtccatgcctctggtttttgaggggatgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctttggccagagtaaaactattcgaatagccgtgcccacggttatgggcgagttgagcaatgtttttcgtgattagtcccacacctctcaccgtaactatggatgttatactgggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgccagtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaccgagcaactcattccttctctttagtaacttttgcaagggctcgcaaacgtgactgaactagatcaatacaatttcggcgcatcgccacccttttgctttagttttatttcgacgagttcttgcattcgggttgagctacatcggtttcgatcttcaacaagaggtaaaacttgttatgacagcttgcgttctcgggattagtgcttccatctttatgacactctaatcctgtttatgtaattcgtcgagttatcatatatcttacataatctttggcaatctcgctatctaacctacaatcggctaacatctatcggtagagggcagccgattaggttagacaccgaagttgacttagattatatgagatatctaccactctatgaaacttccagcggcttgattgtctagatattgttcttgtttttatacttaatgctacatcagttgagtttgatctattaagtcgtgctagaatatcaatctctagcctgccatctggctgttgattagggtaacatcagagttttagccgatcttatctgatttaactacatttactctatgtgttttattgacatgttaaatctgccatttatgtaaagatcttatttcatttaagtatattaggcttttgtttggtatattctattcgttttaatatcttaacatagagttgtatcggagtattagccgatacatgctagatctatatgatcggctatgctacgaacatatataatcctggtattaatatatatttcgatctaagtgatttatactgtctcggcatggcgaccgatctatcccaatcgcttgatttaagtatatatcgacataagaattatatatttctaatatctatagccgatcgagtagatttagttctttattacctatttacaaccgccgatcaatttacatatgacatcggctcaaagatcaatgatatgtcaatggcacttagccgatcggctatcgtttataggtttaaccgcggtttctttgttttgatatcttgttgattgcaggatcaaatcaactggcacgctaacatacccgaaggcgagttttggacctgcactggagttaagtagatctcccaggtctcgtgttttacgtcaacacgcttttggcacgcctggtgggaccacgaattttatatccacatgtctgaagaagaagtcaatgccaagatcatggtcacggtggagagtttaatggaggaacaacaatattggctcagggggcaagcgcatcagtttcagcatggtggagcacatcagtatcggctcatgaaagccgattgcaagaagcaaaggaagatcggttttggagttatcaagacaagaaattttgaagcatgaattctcatactccaaaactgctgcgcatgtgttaacagtgaaatttggtaagcccggagtagtcatcggcttagagtcagcatcggcttcgaagtcctgcgattagccgatgagagttgtcaagtcgtcagttgtgggattattgctatattcggttaaggaaattgatctactaatggaagcttatccagaagagaccgagttcaaagagaatgtggcatggcaagttatctattaattaggaatagtttgttagtatccttttatctttaggaaagtgtgtttagtgtcctataaggactttatcttttccttttatctttaggaaagcttctttcttgtccgacaaggacttgtatcaacccatgggtataaatatgtacacccggggtctatgtaatctatctccacgatcaatacaattcggcgcatcgccaccttttaccttttccactttattttatcgtccggcgggacttggcacctgacgcggggctgcatcggtgttcgatctccggctaaggggtaagtccaatgttctgccggcccaggcaattgtatagtctacatcggcgtcgttcaaggctgcatcagtacattcgacctcttggattgctctggtttggatgatatatttgcctacctatttatcatatgtctctcttaatctagtcttagcatatcaatttagctctatcggctgcttctcgctttagggtttctgccgatatcggctaaatcgtgttgctagattagattagactaggtatctaccaccctgacaactcagtcaacggcttgattgtctagatattgtgtttcttttcatacttagtgctgcattagttaagtttgatctactaagtcgtgcttagaaccataatctctagcctgcttcttgattgccaataagggtttcatcggggtttcagccggtgagttatctggacgttgcatcggctcataaggattgcatatacatataagttggatttaaccgatgacaacaaaggtttcactgtttaatctaatcttttggatttcatgacatcggacctccagccgatgtatgctttaaccttcgaatcgatgcttatttatcatatcattatttgtcagttagtttatattggattatattgttatttcattacatcgttatcagccgattgccttcatatcattatctacatagggcatatctgccgttacttaaaccctattgctatcggctggcatcgacatcgactattatcggctatcggctggaactactccatcggcttgtcaaccgatcggctgttttgatctactatttgcatatcttgttagttgcaggatcaaactgattggcacgctcgcatctcatcaagatttggacctgcacaagagctaagcagatctcccaggccagtgtgtgtttttcgcatcaacaccaggcaaaagaaaaatcgttggagtagaggacaagactgacgaggattacaatcagttggatgggcaaccccctttcacggtgacgattgaccctagcatcctcctatcaaatgaagacaccccttactcacgtagcgatcacaaggaaggaacaatagtgaggagaaagtacgtgcggtcaaccgtcaccgccgatgtattgccataattattgtgtacacgatgtaaactattttggatgtattgaatatccatataaatcaattgttgtatggcatatgttaattatgcatgattattagaatttttaacaattttaaatcatgtgtgtgttagttatatgctagttatatgctagaatttttaaaaatcatgcatatgctaattatatataattattagaatttttaacaagtttagatcattcatgtggtatttatatatgttaattagaatttataacaattttaaatcatgcatatgctaattatatatgattattagaatttttattaattttaaatcatgcatgtggtatttacatatgttaattagaatttttaacaatttaatatcatgcatatgctaattatatatgattattagaatttttaacaagtttaaatctttcatgtgcttattacgtattatccacttaatttactacagacaacaagaatttttcgaagtaattgtcattaatttttcgtctttaaataattttaatgcattatttactattttagaaacacatatgtaatgaaattcaatattcagtgctattatctgtagtcccggttcttaaccctaaccgggtttaaaaagaatttggaaatagcgggaaaatatctttagtcccggttggtaagaacaaccgggactaaagaactaggagtatatatattcccgatgcgcaccctcgtattctccaccaacacttagaagttttttccccgatctcgatcggcttctccttcgccgccactgcctagggcatccccgcgccgacgccgccgtcgtatctcgccgtcgtctcgcaagcgtcatcgtcgccgcctcctccgccgccgcatctctatggtgagagccgccgccgccttcctctctctctcgacctcgacctctctctctctctccaaaccgccgccacctcgttgccgacgccgctgcctctccccgagggggatcgagcccggggtgttgcggcggctgccccctcccagcttggggttgggccgcccccaaacccacgtggctacccccgaggggggtcgagcccagggtggcgcggcggctgccccctccaagctagagggaggaggccgccctcgcttggggtcgagctgccccgaccccctccacgtatcagcccacgtgtacagggcctaacgcccacctaactgcatttaaagcggtctatgcaaccgtgccatgccgcatttaatgcggcgtgctgtgcatatgaccggtctgtgaccggtggaatgaccgatgggacggcgactgtgtaccccggccctgtcagtgtgtcacgcggcgagcggcgtgcttcgtcccgtcgcatcataatgatgaggggcttcacagcctcttacccgggtcagagctggtccaaccactctgaactaacccgggttcccattttctggtgtgaacgagaacccggaagttctcatccattaaatggcgaatgacaagggcgccttgcatgatttgatgggccccgcgcagtaaccgacgtgcagatagcttctgggctaaggcacaagacatgtaatgaatatagagaatattttcccttctccctaggtagcactcgcagcacatgtggtatccccttagagtataaaagttggaccatgcctagcgaggaagggggatcggactgaggatccctgagccaaagcttgtctaaccctagcttgcataccagggattcagggactttttaagcacagaagaatcatacacacaggagtagggtattacgcttcgtagcggcccgaacctgtataaacctcttttgtttcatcgtcttggaggagcctccaagatcaagatcacacacagtttcgctcaccaaatcctcgaatctcacccgctacccccggccgaactctcaaagggggggcctcacagcctcccgctagagagggtcaccccttgacacgaggggacaagtgcggcggccagcgagccgcgagggaattgtggtcatgcatgctttatggatggaatgatggatcaatatgtgttcttactgaaatttttatgatgctattctaagtattcatgctattttttatggtacatataatatttgttcttgctgaattgatgattgtcttgtatttttggtgcagattggatggagatgctacctaatgtgggtccccggaagggtcggggacaggggcctgatttggccccacatctccagtcaggaccgggggtagggagtgaagtcgggggtcggggcggggccgttccagcccaacctgaccccgttgccaacccgaagtgtgttgccctcctagtgtttggaatgacttagagttccagtatgagtagtagtttacccgttggggccggatccccgcctcaacggagcaggggcaaaatcttccccatgggtaatgcggggcagggcccaaacttcatgccggggatagggaagcatctccacctatggggaccctgtggggccctaaaggtctactattagatgaaggtggcctatacaaataaacccaccaggtccaattaatgaggatatatcaagagaaatccggaccttatcctcaatgtccatggacccgatccatccgttccattacagccacaaccctcgtacctcaacctgtgctaaaggccccaaacatcggcacatcgggcactcgtgttatattgagcgctgccatgcttcttctctctcacacaccttgctgtgggccatggacgacctttgcctcgaaccatgccaccaaccgccggaacagaatgtcgccgggcatcggcctcaattatgcaccaggccagtagcttctttctctccatcaccacatcatttctggtcccgcacctcgtcttcgtccgctggtttccctccgcatggggcctgctgtggccggagccggggctgggtgaggcagccgggggttggggattgaggccattcttgcccaacctgtcccgtcgtaaactctatatgttctagtgagtacatactgaataatgcctttccaatggcaattggcaaagtagtgatgcgtctggcggtgaactgttcgtttaaatttgtctaattcagctttaagaaagtaccactacaatttggaacgggtctacacggccgggctactagcacattccttttaatgaatcatgactacgatttgttacgagtaattaagctataacacgtccaagtcggctttaaactatgtagtgactatatatccaggagtagaattacatgactcatatttaattaatcaagttgcataagagacgataaccacacccagtctacctgataaggcgaagaaaacacgatgacacgagcactgggcggccattggggcaacttgatgtaaagaagtcgcttgtcagctttcgtcgtcgcgtctctgtctagatttcaccaatatataatatttctcataacctattgtcaacaggaaactttaattacatagtatatagtactgactaaatacaaagtaacaacgtttccagcttgttgtcttctgtcggtacagtctgtacagatctaactagaatttgaccttgattgcacttcaagtttcaacttatttgcaagatttgtgagcacattgaaatatgagcgggtgctgatcgattttgaataccggcttagggaattttttttatcggtatcaccatatatcacacctacagttcgaatccaaaatgttgaattgaaggaaagggatcctctgacttaactgctgtgcagttgagtcactgacatgtgggccatagtaaagtgggacccacatgtttgcatgtgcattttaagttagaggatctgcttcttgaattgaaaagccggtcgatcgatggcctgaatttttaattttgtcgtggctaaagtgtagttttttatttgatctgacgactataaaatattaatacatcgtatatatattataaatgataaaatgtagtcatgcgtactagtacgtgcaactaattaatatataataatacacaatagacagtcataaactgtggtaatagcatagtcaacactaagaaataataatataatgttccacaacaaatgataattcatcctaacctatcacaaacactagggttgcgaactgggtgttcgtttattcattcataaatatgagtgtgcacgtatatatgagcaccgctgtatgtattgtatttcataaaagaaacaaaacgaattattgcacaattatttcaaattttaaaattcatatctgaatagtatgttgttaccaaatgggtattaacatgccaacattaaggtttcgattacccatctgtacctttcttttagattatggagaagtaagttttggtctatgcatcaatatgttggaattaatgaatgggtctcaacccattcgaagatttttttctttgaaaaatcataaaagcctacatcataagatggcatacatggcgagtttagtacaccttgtctattctaggagaaggagacctccctataagaaaggatactctcttagacactgaggcatgtgaggttgacagaaaaaggggaacacacgcacgctcttacacgcctggactggcctggcggcgcgtgtgcacaacatacgcatcaaattatctctatataagtcgagccgccgcctccacacaacacatgcgaaatcaaatttagggtttgccccctctatactatgtcgtcgctcgtagtctacaccatcccgctcgctagcgtgcactggcgatcgggagagcaggtctctataaccttcgcctttgacattctgcactgggaaaaggcggtaataagatttttgagaagcgctgtgtttctgtcatttttgcagcgggcatggctagcaaaggcctaaggctagccaaaaaacaatttttttttgtggattatactcatctgtgacgggccataacttaatgcccgattgagatgatggtcatctgtgacgggctgtagctaatgcccaattgagatgacagtcatctgtgacgggctatagtttaggcccgattgagattagtattatctgtgacgtgctctagtttaggcccgattgaggttagtagtcatctgtgacgggctctatttgtggcccgattgagataggtcatctgtgacgggctatagtttgactggtagtctgggtcaaagctatcggtgacaggctttaattagggcccgattgagataggtttatcagtgacggccgtttgcccaattgagattacttttcacatcagtgacttctagcctgtgatggacgccgtgcccgattgagatggggcttactgcccgtttgagatgagggtatccgttccagtgattgcttgatttccttcacttttttttaccaatatatatagttgattggaactatatatatttttgatttcttatctatacaaataatacaattgcagctaactccaatattcggtgtttaatcgaaatgattggatagactgtcatactcggcttctaattagaataaaggttgttgccagttctatacttctattccattatttcctcaaactaacgagaaaattgaaattcccatgctctaaccagcgaaaatgcacaccatcctcctagttagtccaagtaaagttacacgagcattttcagcaaaataacaagaaactaatgaagtcaactccagcttgcgtaacgtagcatgctaataatgcacgcgaaatttcagactccagttgttaattttggttgtttaattaccaaagcgaccgggcatgaagttgacttggaaagtcggaaacaatgtgtcagctcgttggcacacttatctatatccttctcagataagtacggcatattctgtccttttcatgcctctcgtccgttcttttgtcgtacgtaactcacggtagtcatgtgacatttcttcttaaactccgttgcattgccatcaaagcatgactatttctagtgtcagactttgtcaaccgtgggtgtggtgtgtggtctgctcacggagttaatttctcacttctcgcttgtactcctacaacagatggaaccaaggccacacgaagcaatatatgcattttccagggaacttttactatacctccagtggaggtgataatattaatagtgtggtagaaattggtgccggttctttataggtggcggttcttaccatccctccaaccgtttctgtatccattgagtaaaaaccaacacctatgttttaagttctggtttgaaaggatgttcgtacaggactataggtgttgggttcttcatcaaaaccgacacctacaataccatctataaagctgacaccgatgactttagtgtcgaccaattgatgccgacaccaaaagtaacacctacgtgaccttccgaaccggcacctataatacttcatatagtagtgaagtcctggtgcgctctcgtcagccgcccactacgccagattctcacacctgtgacgggcataagtattggtcagtgataagggtcacctttgacgggtcctacgggatcccatcatcggtgagccatccggcggcgacccatcacagttaactaatcacctgtgacgggccaaaaatggaacatgtcaaaggtgaggtaaagtcaaatatttggcctgactttacctcacctttgacgggtttgactttacctcacctttgacgggttccaatttttgtcctgtcaaaggtgactagttacctgtcacatatgaggtatacacctgtgatgtgagtaacatttatgtgcccgtcaaagatgataaaaaaaatctctctcataaccctcccctctcctcccggctcatcgatccatcattctcctctctctctctgtccctctcaaccctttctctctttatcgatctagttgtgtgtgggtcggaggcggaggcggcaccggtgggtctgcgggctggagggggaggcgacaccagcgggtgtgggggttggagacggagatggcactgacgggtgcgcgggccggaggcggaggctgcacgggcaggtacgggggccggatgcggaggcgcgcggcaccggcgggtgctggggccggatgcggaggcggcaccagcgggtgcggaggcggcaccggcgtcggcgccagttggaggcgaaggcagaggaggtgggagattggggtcggtgatgaaggccgcctctttaggtcccaactccgtccgcccctccgcctctagatccggcctaccggaggtcggtggtcaccggatcggaccgcccctgactaatgaaccctgagcttcactcgagacactcaaggcggttattggcccgatatttcggtgagttgtagataactacgatttgggagaaacgttgacgacccgattacaaccgtactagacattgttgtgttgcgccttagagatcgatacacctctccatgggttgttgatcttgccggtgcagatcatccttattcctgcaagcaaatcgaagaaacaagcaagaataagataaaagcaacctgaattacatataccaataataagttggggttctgtaacgagcaaaccagcgatctaaccgatcacgggattacacggcaaagtagcaaagctaaactttaatctaaacaaaacccaagaaatcctgaaggggtaccaagctatttatggagatgggaggaccctaggtcgtcctccacctggttggggcacaccccacatgggacccacttgggctagggtcctagacgaagttataagcccatatgcccattaaaggtgatgcagcactttgtttcctcaattgcggctcaatgagatggaatttcacaatgagtttgatccattggaaagaagactccgagagctttccatcaagtactacggaccgaaaacggatgtcgtatgcagattcagtggccctttgaagtcagcagtgtagcaagtggccgaatcagattccatcacttgggcatcttgatcttgatgtgagcaatggttgtatcaatggtagccttggtcacatcatcctccccttcttcagggaaaaccgtctcggtttttccatatggtgctcttcgcatagtccatttaaaacaacatgtttcttccaatgaaaacaagacactcgagataatatgattagcaataatatgtatctctagcttgtatattttatccacattgatgggaggttctaaatctgaacagatgtgaaaaactctatggaccaaatatattcctctatcatcagattcgccaaatatatgaaaaatagcactagttggatatgtcaaattagacttagcaaataatttctccttcaaattatcgagctcacaaaaatcatcaaactaaacatagcccaaagtatttaaagaagatgtcaattttcgttcctcaacttcagtagcaatgtgaacaacatgcttagaatcagcacataacgaaatattataaatagcatgttcattcactagttgtggcatggatataaatgaaacattatcacacaactcttctttatcacaaggaacagcaagtaattcaagttgtgacaaaggcatctcaacaattggttctactaatggttgctcttctctagcatgaaaagtggacatgttcaattcattaacggcacactcaccttgattaattgcagcaccattaatattacctgtggttctctcttcggatgatgtaggtgcatcagtcttctcttcttccttcgtgagcgatggagatggcatctcgatcatatttctcttctcctcacggtgaatgttctgagctccctacagaatgtcagtaataggaggcacaagcatagcttgtttctcccttgggttctttaacatattgctctcaacactgcaagcaagtatgaacaagtggcctatatgattatatgtcatgttaataagcccagcttgaatatcggaattaagccctctaaaaaaatctagtcattgtgttctcattgctttcttttaaaccactataagagatacaaattttaaagttatgaaagtactcccgcacggttttgtcaccttattttagatgttctaatttctcaaggagagtacgtttataatatgaaaacacaattttttttcctcatcattgttttgcattcatcccttcaagcttatggccaacagtataccaccaaaaagacgtagaaccggtacacttattactagcagccttaaccatttcagcattagagaaatcatactcatcaaattgtttgtctactgctagctcctaattaacataagcggcggaatcatacttacaatcactggcaaattagatcctacccttgcaagatcattatcatgtacctcatatacaatgcgtaaagaagtcgctatatctcgttgatggtgaagaagtcaatgttgagcatgaccatcttgtttctgcttgctcaatcctaccatggttagtagcaaacaagaaacatacaaatgaatatgcacgctcctatcaactactaggtagtggcagctgaaatatcacacactcaagcttttcaccaagctcttacaagttcttaccaaagcaagcggaatggtgacgtacacggacctcaaccaagcacctcaatggagtttggatgtatcgataccttggcaaacacttgctgtacggctgcaatcaaatccgtggagctttgggtaggcttaaatatgtagcaaaggaatagcaaatgctcaaatcagagaatgcaaagttgaataatcgttcaaagtcatgtaccgtgctggtcctaggctagaacgtactagagacgcgaccctagacacaaacgataccacaagatagcacaagaaacaacttaagcacactctaatatatgacaatctcaaggatacaactaatgttctctttttttctttctttctttttcttctttctttttttcttttctttttcttcttttttctttttcttttttttgtgcgactttttgtttctttcagcacctttgtgccttttctcactttttttatttttttagaaaaaaacgactcaaggatcttaaagcaagattacagggactcaaatgtaaatataaaaattacagggactcaaatgcaaaaatgcaaaccctaaaactcaaattatacaaaaatggaatgtggaatttatgcccgttccgttttttcaaattgatctcgaaaccgacaccaaacaaaaattcaccaagctatctagcaaatcacgttacccattgaaactgagacgagatgagagggagggagtacgactctcctagtcacggtggtggtgggtgcggggtggaaccatacgctaggtgggatggttcggcctttagatggaaacggggatggtccggcctttagatggaaaccgaataggtgttaatcaggaaaccgataccaataaaaaaggctttccccttcctccttcctcacgtatggaaaccgaatctaatctacaaaaaatctctcaaccttccttcttggtagcgcacacattcacggcaaaaaaaacacacgcagtatttgcaaacactagatgcaactcaactccaaaactaaccgacagaaacttctgaaaactacaaaaatagaaccgtggcaacgagccgattccgttttcgtaggtcacaacagagacttgggggcagcgacaactgtggtacaaaacgtgaccagaactcaaaactctaaacgaactagacgctaagaccagcaacacgatgtgacaatgcaacacaaaattcaacaaagcaaaaactgaaaacaaacaatgcaatggcacaatatggctaggtaaatgatacaaattttttttgtccagctattttttggttatgggtagaaaaaaaaaactcaccgagcaacgaaagctctgataccacctaatgaaccctgagctccactcgagacactcaagacggttgttggctcgatctttcggtgagttgtagataactatgatttgggagaaacgttgacgacccaactacaactgtactagacgttgttgtgttgcgccttagcgatcgatacacctctccgtgggttgttgaccttaccagtgcatatcaaccttattcctgcaagcaaatcgaagaaacaagcaagtacaagataaaagcaatctgaattgcagataggaattcaatatcataagttggggttccgtaacgagcaaaccggcgatctaaccgatcacgggattacatggcaaagtagtaaagctaaactttaatctaaacaaaacccaagaaaccctcaaggggtaacaagctatttatggagatgggaggtccctaggttgtcctccacctagttggggcgcaccccacatgggctccacttgggccggggtcccagatcaagttacaagcccataggcccattacaggtgacgcaacatcttgtttcttcaattgccgctcactgagatggaatttcgcaagaccgaaaacggatgtcgtacgcagattcggcggccgtttgaagtcatcagtttagcaagtggccgaattagattccagcacttgggcatcttgatcttgatgtgtagcgcccgttccgtcgtggcgcctagcgggaaaactatctcttaaaaaccctagttgcgaaatctgtttctttgcttattgtctagtgtccatgccatctcagatctcaaatctccgatctatcgtcgagttcaatcccgaatccaaatccttcccaaatcaaatccctccgcaaaagtctattttgcctccctcgggttcgatgggctgaatccctctcggcccatcgcccctgcgtgcgcggctctctctctctctctccccgctctgccgtgagccgcgccgagccctccctcccgctctcgctgccattcccgccgatgccgcccaaatcgccgcgccgcccgcgcgcgcgcgcgccgtgggggccgactggctagtcgccgccgccgtcagcgcctgccaagcctgccccgcgtctgccgcccgtgtcgccgctccactccaaaccggtccaccgtcatcgccgtcgtcatcgacccggccccgccaccgccgcgcgctagcttacaagggacggaggctgagccccgcccccccctctgccgcatcgctccctctgcctcctccttttcgccaaagtggcaaggaggcaagccccctttctctccccctttttcccttttccctcccgccggcgtcatccttcccccccctgtcgccgttttggccgcgaccgccgagcgcgagctccctcccttgaccgcccaaggtcggtttccaaaccgacatcgccgccctataaacccaggcgccctcccttccttttcccctcccaatcttcccctttttcgcccgcaccattgccgtcccctctgtctcgccgatcgccgaccgccgccgtcacgtgtgccaaaggagtcggtgcgcgttaggacgcggaaggggactccggacgcaccctctccttcctcttccccggcccgaggccggagagatcgctcccgtgccgtcgacccatcgtcactgcgccccgtccgcacggtagtgcatctccccgttctccctcctcaatccatctcttccccttagttttcgatagtagcatgtgtagcctccccgtagctagccggcgccgccccgactgctgccgtcgctcaccgtgtgctcgccgccgtcgccgcccgagctcggaagcgcctctcgtcgccggcctccctcgatgcgattcctcctaatccggcgcaaggggtgggttcccgtagctgcgtagacgctctcgccgccgggaatcggcccctcgtgacctcattgccgtttcccccttctcccgccgccggttgccgccgccgcaatccgccgccgtcgagcatcccccggcgaatccgagccattggctcgtctcccctcgtcctgtgcaacatcccggtgtgctcgccttcgcctgtatcgccatggttcgctccccgctcgccgccgtcgtccgccgtccgttccggccggcgtcgtcgtctacctcccgccggcccgcgtggcagccacgtaggcgccacgtcggcgccacctcggccgcgaccgggtcaagtagaccccggtccgccgcttccctccgccccctcgcgcgcgcggtccaccgcgagccgtgaggcagcgcgtgggcccgccgcaccgcgtcctccgcgaaccgcacgcatgcgccgcgcctccctccccaaaccctagcacgccccgcgtgcacctcgctcacggtgagccgagtcgccgacaagcgggttccacccgggaccacgcgggatgcacccggcccaccggctctctctctcccctccccgcccgcgcgcgcgccttgggccgccttcttgggtcggccggcccattaagctcggccgagccgcccctttctctcgggccgcgccctagccgcccgaggaaagtctaatttccctccctccttcttttcttttcttttctttttcaaaaaggatttaaataaatcctttttcctttagacaaaaaatccaataatcttagaaattcaatatcttcccaaccgtaagtctgtttgactccgttcaacttccaaaattcctcaaatctcgagatctatctaatggcacgcttagaggtcaataatagggctttattttcgccgtttgctgagttgtcctgtttcgcgtgtagtttcggagctcgaagacccgcagtgcgaggatttcgaggatcaagctgaagatctcgagcgaggcaagccacctttgaacatcttgagcctatatttgaacttaattatgttgcttgaaaaatattatgcattgataggatcgcacttaatctgcttatcccgtctgcaaggcagattggcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagacttggaaaacccgacacctgggttggtgcttgcgaactaaatgaatttccaaaatcgcggaccggggaacgtaccgggtgtacggtttcccactcttgcacttaaggaccgtttccttggaatttcatccgaacacatgacaagtacgaccacatgggtggaatgggacacccctggctgagtaactagcttatcgggggagccatgatgctaagagacatgtggattcaccggggtggtgtcagggaggacccctgggcttcctggcacagtatggtctgggacctaatctggtgttggtctgggacccctctcgttggcatatggtgaacctatgtcggctttcgaaatgccttgtcatgaaagccttaaggtctctagtcgtggccgttctgcacgggctggatgatccgggttagtaatgtcgtgtgggtaaagtataccccctctgcagagcttattaaaactattcgaacagtcgtgcccacggtcatgggcggatgtgaggtgattcctagcgtagttttgtttgactactgccttgtgaaatttgctgttgtggaatgggtttgatgtttggaaaatctgcggctgatgggattagccaggcccgggtggccgtttgaaagctgttggccgggtgccaatcttgatcaattcaaaagactgatacattgcacatactccgaccggacgagacgcactgtctcatccgtgtcgtttgagaagcactcacttagttatttcagaaaagagttcaaataaaatcaattgcaaaaacaacagcctttctttgaagcctgcattaaacacttatttcccatggcttgctgagtactcccgtactcacccttgctctatataaataatccccccccagttgctgaagaagatgaagcggatcccgctgacgaggagttcttccaggagcaagctggctacgatgagttttagggtttcggcctagttcccaagtcgcgcctgtgatgtttggtccaagtcttggcttccgcttcccttttgtaatgcagttgcgagctcgggatctgtctgcagcccaacatgactgtactcctactctataataaagagacctctgttgctgtgatattttgtcttcctgtgataccagcactgtttcctaggactggtatcgattaacaggttaatttagagcgtcacgggctagttccgctcgggactagttcggggcgtgacaagagatggtatcagagcacaggcttggccctagggcgaaacccgacgtttaggatgaccctaaggatactaagttcaaaactacttgcgaaaagctaaggcttcttttggtttctttattttcaatagtttgttgctaaaatggttagtgatcttttctccctctttcaaaattgtagatggcagtgaacgccagcttcagttcccacggttttggtgagggtcaccacgtcgctcagcttcgtgacctcgcccgcttccttggcttctcgtgtcccgagtacatggggtactccgtggacgtgttccccctcgctgtgagctctctgtgtacctttaccctcgcggaggtatacacggagctggccttcgcccacaccacttcactgtggctaggcccaccctccagatcgcgtaccaggacctctcctggactgcgcttcgtcgcttggcccacgactacagccaccgtctcgggggctctgccttccggcagctcccacgtcttccttctggctacgcagatgccaggtacccttgtccgtacagcgagtcttagccagtgctgactcgcatggttgagctttcggaggctcaggccactcagcacgacctactccttcaggcttaccgctcccttgcccgccgctacgctactctggaggcccgtctggccgaggagggtgtcacctcagttgacactgtctcttgggactcaggccgcctctgccacgccagccacctgtcctcccacagctcccgcggctctgctcgcactcctagtggcccgcgctcccccagctcgcgtgcgccgtactcaccagtgtactccccctacccacacccagttagcccctcctacacccccggacacaccccagttgcttcctcccgccgtggcgcacgctttatccgcactgtgcggaagcgtgttgttggttcttccaccgtgttccgcttcgactacccagctcccccaccgccagcggcccgtgctgctgccggccctcgacaggttccgccggtcccttcgcgtcagccgatcgacgtttcttcgactgatgagccgactacagcaggcagccaggcaggcgaggagtagaggaggcagtcttcagcagccgtccgtgtgttaggcccttttgttccaccgccaactcttttggagtcgtggcgaggtagtgcgtgcgtgtgttgacgtgggtgttgtttggtagtctggttctcctaggtggtgtgcgtacagtcaagctcggcgtagctctgtgacttgtccacacccgttgtatcaggtgtttttatgatttgagaaaaaaatccagtttatgcctagtgcgtgctatctgagttgttatttactttgctccttgcccttctaagtgcttatctgattcttacctcgccctcttctaggagtttagatgcctagccgcccccgccgtgctgctcatgcaccagcccgcttcagttttgaggaaggtagagttgagccagaagcaaatcatgagtcagctaatgagcagtctcaccacagcatccgttcgcaccatactgcttcccgcaatgcagaagttgagcaaccccaccgcagcaatcgctcgcatcacacagcttcccgtaatgcagaagtggaacaatctcaccgctctcaccgcactgccagtcacaattctggagaagaacgcatcccttccccacctcatgtggaaaacaacatgcagcacttaatgacagttcagacacaaatcttgcaaggattagccgcagccatagccggctttcagcataatgcccatggaaatggccaccctcacatgggcaacaatagatccaagctgacagactttctgaggtctcgtccgccagagttctctcagaccgtcgagcccgtcgaggctgacgattggctgaaagatgttgatagaaaactcaacttagtgcagtgtactcctgttgagaagatgctctacgcctctcaccagctaagaggacatgctgcagattggtgggagaattactgcaatgcacaccctgaacccactaacattgcttgggatgagtttgctacggctttccgtggagctcatgtgcctgaaagcaccattgatacgaagaaagaggaatttaacaggcttaagcaaggcaacaacagtgtcaatgagtacctaagtcagttcaacaagttggctcggtacgcccctaaggaagtggacacagacaagaagaaaatcaggaagttcttgaagggaatcgcagttggaatgagactccagttgcttgctcatgacttccccacttttcaacatatgatcaacaaggcacttctacttgaggatgccagaaaagaggctaccgaagaatacaagaaacgcaagtttaaccatcaggggaattcttcccgaggcgcacctcgccctcgctatggtcaacccatgcaatatcaccaatcggtcactcaggctaaccgccagccaggctacgcccctcgtcctcagatgaaccgtccggcacctcagccacagcagcatgccccaagtggcaatactgcgccaaatagtgttacctctttcaagtcaccactaggactatcagcagttcagtgtttccggtgcaaccagatgggtcactatgccagacagtgccctcagaatcctaccaacaccaactcagggcatgctaatggcagcactgccagaactcctactccagcggcagctcagtctcgtcctagctctcaggcaagtggacaaggttctcgtgcttccaacaactttggtcgaggccgggtgaaccacattcaagctgagaccgctcaggatgctccagacgttgtgatgggtatgttctctgtgaactccgtacccgcaatagttttgtttgattcaggagcttcccattctttcatatcacaagcttttgtgaagaaatggttggaaaacccaaaatttacgtgtaccaatgatagtacattcccctgggaggaatataagggcaacccaaatatgcccggaagttaaccttagaattgaggaagttgacttcctagccaaaccgatagtcctagactcgcaaagcttggacatcatcctagggatggattggttggctaagcacaaaggacagatagattatgccgaaaggtccatcaccttgcaaggacctagaggaaagcaagtctgcttcaccactaacacccctaccgcaagtcggtctatcctaacctatttacaagtcacctccttggagtcggtgcccatagtctgtgaatatcccgacgtatttcccgaagaattaacaagtatgccaccagaccgagagattgagttcgccatagaactggcaccaggcaccgcaccaattgcaaaaagaccctaccaaatggcagctaatgagttagcagaagtcaaaagacaaatcgaagaattggagagtaaaggttatgtgcgacctagctcatccccttggggagccccagtgctcctggttaagaaaaaggatggctctgagagaatggtaatcgactatagagccctgaatgaagtaactataaagaacaagtacgcattgccacggattgacgatttgttcgatcaacttaaaggagcaagagttttctctaaaattgacttgagatcaggttaccaccaattgaaaattagatctgaagatatcccgaagaccgctttctcaacgcgttatggtctatatgagttcacagtgatgtccttcggaatcaccaatgctccagcattcttcatgaacttaatgaacaagatcttcatggaatacctggaccagtttgtcgtggtattcatcgatgacatcctgatatactccaagaatgaggaagaacatgctgaacacctgaggctgataatggggaagctcagggatcatcaactattcgctaaattctcgaaatgcgaattctggttggaccgagtagcatttcttggacacgtgatctccttcaacggtgtcgaagtagatcccagcaaggttggagctgtacttgcttggaacccgcccaagaatgtgtcagagatccacagcttccttggcttagctggatattatcgaagatttattgaaggattctctaagctagccagacctatgaccgagctgttaaagaatgaaaagaaatttcaatggtctacagcctgtgaagacagctttcaagaaatgaagaaaaggttgaccaccgccccagttctcaccttgccagatatccgaaaggatttcgagatcttctgtgatgcatcaagacaaggcgtaggatgtgtcctaatgcaagaacgaaaggttgtggcctatgcatccaggcagctcaggcctcatgaagtcaactatcccacccatgatctcgagttggcagccgtggttcatgctcttaagatctggaggcactatttaatcgggaacagatgtgaagtatacaccgatcacaaaagtcttaagtacatcttcacccagaccgagttaaatatgaggcagagaagatggttggaactaatcaaggattacgatcttggaattcattaccatcccggtaaagctaatgtggtcgctgatgcgctaagtcgcaagacctactacaatgtagctcaaatatggccagaccaagatcgcctgtgcggagaattggagaagttaaggctgaccgtggtacagtcaggtgtccctgccagcttgaccgtgcagcctaccctagagtcgcaaatccgggaagctcagaaagatgatgaagggataaaagaattaataaaaagaatacaggagaagaaggacaccgatttctcaaatagacgatcaaggcacagtttggtgcggtccacacatctgtgtaccggccaagaaggagttaagagatcccatcctaaaggaagctcatgagtccgcctactccattcatccaggaagtacgaagatgtaccaggatatcaaggcatatttctggtgggctggaatgaagcgagatgtcgcagaatacgtggcgttgtgtaacatttgccaaagagtcaaggcagagaatcagaggccagcgggtctgctgcaacccctaccgattcccgagtggaaatgggaagagatcggaatggatttcatcaccggtttgccaagaacccctagcgggtacgactccatctgggtaatcgtggaccgactcacgaaatcagctcatttcgtgccagtgaaaaccacctttgatggaaagaaactagcagaactctacatgacccatgtcgtgtgtagatttggctgtcccaagaagattgtgtcagaccgaggcactcagttcacctcaaggttctggaagcagttgcatgaagctctcggaaccgatctaaattttagtacagcttaccatccgcagaccgatggtcaaacagaaagggtaaaccaaatcctagaagacatgctacgtgcgtgtgccctggatttcgaaggcacttgggcaagctggctacgatgagttttagggtttcggcctagttcccaagtcgcgcctgtgatgtttggtccaagtcttggcttccgcttcccttttgtaatgcagttgtgagctcgggatttgtccgcagcccaacatgactgtactcctactctataataaagagacctctgttgctgtgatattctgtcttcctgtgataccaatactgtttcctaggactggtatcgattaacaggttaattggaacgtcacgggctagttccgctcgggactagttcggggcgtgacatgatttgagcaatggttgtatcaatggtagccttggtcacatcactgacctcgcggcagtcggatcttgtcaccggccttggtctagtcgccgcatccgcccacgcccccgcctccgtgtccaactccgtcggtccaagcaagctccagaatggctctttgaggtcagaggtcaccacctccttcgccgatccatcgctttacccccttccccttcagatccatcgctgccacctctcagtgccgccagatctggcctatttgaggtcagaagctgcggtggggactacaaagtcgttagcaattttgatgaaggtctgatgatccattcggcagtgacatcgttaacaattttgtgaagtccaacgataggggaattgatccattctgtttgtgaatgtgattctgttttgtgcgattgtgaatgtgaatgtcattttgctctttggctagatgaatgtgattgtgatgttttttgtgattctgttttgtgcctaaatgattgtgaatgtgaatgatgagtatttttgtgatttatgaatgtctaatgaaggtctgcgactagctaggctcacatcattatatttcttttgccccatttttcaggtctgtgacgggtttcaattaggacccgttacagataaagatcgccactaacgagtcaaaatatttacccgtcacagatgaatgttacctgtgacggatttaagttgcagaccgtcaaaggtaactcttacctttgacgggtctttactcgtcagagttgactccgagtcgtcagtgaccactaatctctgaccagggccatatccgtcaaaggtgagggtttgcgcccatcacagataatgtgatccagtgtaatggccagccctccctgcacgagccattgctcatggagtcgtcgatgcctctgcatttgatgtggaggcacaccgtcggcttgatcacccgtggacctaccggcccgtgaatacattctacttatattaatttaagatgtgcaaccatactagtataattagtgcggcactttgattgacagaggtaatctgcattagtaatagttttggcactgttttctacgtagtaactaatcgaggaacaccggtagaggaactgcagggaccgacgatagagcatagcatccctcattgttagcactgaaaatggactaggtccggccaatcttcattgacggctagccgctctcttccgtcgtcattgttttgtgcttaatttctcccctaaatctaaggttgccggatctgacctcgatggccatggtgacagtaggcttgggtgggtcgggtatatcgcttattaacggcaacctatggccaaaaggatagaggtgtccttcattttctattttctttccatgaaccactatttgccttaaataaagtactatagatatcaatttatttcaggcgctcatactcttggtccccgcccgcgtcgctcaagggttgggcgacacgggcgtcgcctccctccccagccgacccatcatctcctcccacctctacctcattgccgcccaagcaagccaccagaaaaccgtgcctttcttctcctccctgaaagtcttgagactagagcccgtggcccgatccacgatggggcagccgccgcgacatagggtggaaagccggtggcgtagttttagagagggcaccggtgaccagcggcacgcgcgtaggagcctgagggtggcctccatgcaggcggagaggaggtgtgactagatctggcgtctcctgccagatctggtcggagaactggcgacaatgaccacgatcgacgacatgtgaggccacgggcggtggcacatgagtaatgcacgtccatggccgacggagcacgtccaacgcggcgtgaggccgtggccggcagtgtgaggaggaagtcaacaatggtctacgtgagaaggaggttggtggtggcctcatgaggaggaggccggcgagggtcgagcatggacgccctagcttgcgtgagaaggaccaaagtggcagcgtgggtcgcctgcggtggtggttggcctctagtagtgacctcgacagcttatgacagcaaacatggaagtagttaggcagtagagaggtcttcttctctgttgccggctaagcatcctcttctccatagcgctcctcccctttagtcgtggggagctccggtaaaaggggaggcactggcttttgcaacaagcggtggcggtggcactagttgatccgagcaaccctgcgagccagcttgagctgcggggtggtgacctcggcttgcgcgctaaaggaatgtcgtggtggtccggtgacggtcattgtgcaggatatttgtgtgggcttttgaacaggaattgctagtgaaaaccttgataagccttggcccgacttgacgacgacaccgacgccattaggagccgttctcctccttgtaggtgtcgttatggcactgacccctttttccccaacaccaactgcgtgcaacagtggccattggtggactcctgcaatggtgcagaagctctataggcttagggtgtttcttgctttgcggtgagtgaccatcatttttctttggttgttgttgggtagagttggagctgctttgttgttggggtgtaatgaagcttggcaacgatttttggctagctgtgtgcaggaagtggctccttggtagcttgggccaatgtcctttgtgggttgtcaaacttgtttgtttgttttggcgttagggcatcttcgcagcgaagtcggaactattatgtcgcttgtggaaagcttggtaacgataacacatgtgagcggctgtgtcactactatggcaagcttggtgctaatgtctcacgatgggctccgtcgtggtagcttaggttagattagttggtgtgttgttgtagttgtgtttttcgcttagtttccctaattaactgagaaatgtaagatatggtccctttttaaaaaaaaattgggcaccatcttttttatataactagcaaatatgagcatgcgttgcaccgggtgaatatcaaacaaatatggatggttaagattgcttgtgtacttataacacatgtgcacaaaaatattgaatttggaagcgtacagatcagaaaaatatgcaattaattaaaatacaaatccattgaaatatctggtatttttaagtaggtatgtgtataattaaataaatttaaaagtaaagcaaatgtgagaaataaaataacatggttaaatttaatgttattaaattctccatgattagttacgctctttagaattttattggaattttcagagcttaattgctaattttaataatacaaacatcatttaacaattatttaattggaaaaagaaacaaaatgcttcattttaggtttgattcgaaataaacacattcaacttcttctctttttcttctgcctgatggacctaaaataggctattggtgcatctttctcacccggcccgagatgggtgttgaaggctagacttcttttcggcccttgccggtcggcccacggccttttgcacatgtgcgggcgcacttcccctccccaggccgcaacctgggcttgggccggaaaagtggccttgctctcgatccctcttgggccgatttcggctcgaccgacgccggccgtccgatctctagggtttcgatcaaacagccgggcgtcgagatcggggaaacaaaaccccctccttctcctcagccgccaaaaaccctagcccatttccttctctcccttctctctcttcgccgccctcccctccgcgcccccgatgctcctgtgcccaagtggaggcggcggcgcctctccccccgagcccaagcggcggcggtggcaccctccccccgagtgacggcagcggcggcgccctcccccaagcagcggcggcgggggcggcgcctctctcgccgagcccaagcggcggcggtggtgccctcccccacaagcggtgacggcggctcccccaccactggcggcgcggccacgtcctcccccaccaccggtagcgcggcggcgtcctcccccaccaccggcggcggccggggcagcggcgcctgtggaggcgtcggcggcccgccggcgtcctagcggcggcggcacccctcccctccgccggatccagcggaaggggagctgcggcgcctggtgtccctgtgatggcggcggttgctcgacggcaacctcccctttgatctttttttttggatatatttgtgtgtatagtgcttcctccgattttattttatttgtgtgattgattgaattctgattgggtattttttttaggtgggggtgatggaattcttactgggatttggggggaggcaagggtgacgaaaaaatcaccgcacctatcaggcaacgaatggaaaaatacgaatatttatattagttatagaaatgtcggcaacaacctaaccatcgaaaagaaataaagtactataaacctccctaggcttgtaaagacctaaaaactactaggccacttaggctgagttcggcacttcatgttcacaaacccacctctttcgtttttcgtgcgtacacttttcaaattactaaacggtgcgttttttaaaaaaaaattatatacgaaagttgctttaaaaagtcatattgattcatttttgaaataaattagctaatattaaattaattacgtgctaatagaccattccattttagtgcaggagggtttagttccaatcctgcactacctaacacagccttaattggtttcttccatcctttgtgagagcaagtttaatagtatagcccactgctatctccaaatcatctataaacaacgtaatagtcaattcatacaatagttgcttgctatattattaatatctggtcccacctgtctatacacattacgtcttgaagttcgtgctgcagcgggctacagatcatacacattacatcttggagtccgtactgcaactggctacagatctatagcccgctgcttttctctctttttaaaatggtaaaattggttatataatatcgaaagtatatttatagttggtttgtacatgctttgagcagctcgaactcgatatggatcattgagaccagtcgtcatgttgggacattgtaaatgccctcgcactatactggagaatctagaacggacggtagggccttcctcgcactgacgcacgaaccgacaaaggtgtggttttattctggttatcaggtgttaccaccacgtcaagatgactggacggatgagatggccccgccaccaccgcctgcggcccaagtcgtccgtccgttccgcccgcgttttctcaagtttccccccctcctttccacatttatctcacccagaccagacgtgccgtgcttctcgtctcgcattcaatgcccctaaccccactccgctgcctattgtcaacgcccacgcatcacttatacacgcgcaccatccatctctttcccattgtccccgtccgtatactagaggtacttgttcttttccttcttcgcgaagcagggatgaagctggtgtggtgcccggagatggcgtccaaggcgtacatcgacggcgtcagggcgctggccggccacgacctggccggcgccgcggcggacgtggcggagctcgtgtcggccatggccggcggctggaacgcgcggctcatcgtcgaggcgccggactccgcggctccggcggcagccgccacgagcctcgcgctggccgcagccgcgcggcgcacgggcgggcgctacgccctcgtgctgccggaccgggatgctgcggcggcctcggcggcggaaacggccgaagtcgttgtcggggaggcggacgaggcgatggcggggctacacggcgtggacctcctggtggtcgacgcgcggaggagggacgcggcggcggtgctcagggcagccaggcccggggccagaggtatggtggtggtgcgccacggcgacgggaggcagcgcggcgccaaggacctggcggcgtccatggcggcggggacgcgggtcgtgcgctccgtctacctgccgatcggcaagggcgtcgaggtcctgcacgtcggcgtcggcaaggggcccagcctgcagaaccaccgtgaccgccggagcaccagccggtggatccgccacgtcgaccacgacaccggcgaggagcacgtcttccggcggcagtgatcagtcgtcgtctgttattccgtccaggtgaattaaatcggatgtaccacggggagggtagttaattaggtgtagcgtgtgttgtccagattcgttgaatctgcccgttaataccatgatgatgtataatcatcggatgggtggaaagtgtgacgaatcacgaacaatgtaaatacctcaaacttgtagctcctcatatctcttccttctacctactgtgaaagctttcttttgagttgatctgctagttcattctttaatttcctttttctttttttttttgctgtgcagagtgcctttgataattaactcagaaaaaaatatgttcaatagatattcattatctataggaaaaatatgtagtgaaaactgaaaaccacatatatagcgaaaacatgtaaacaaccgttggatataaaaatagaccattgctcttgttacctagagtaacatttttttagttaattgctcttaaagccacgtattattaccaaagtttcactttgttctaggctattgatgtttttacttttgatcgggatttcttaccttctattacacattggatcattattgtattccttgcctttaatatactttcctgccactcactccttgatttccttagctcaccagcaactaaacgcatacatcaatactctatcctgatcatctagtaccttgattttctttttggctcttttttcccaccaaaatcatgtgagccgagaaaaatcagttgattgtgagctcacaacaaaagttgctgcagcgagcagccctgtggcttgattttgtgatttgagatcaggaacggatccgagtgaaggaatcgtagtcatgtgattatttgggttaatccatgccaacatctcaatggaaaaaatacaagcaccttgattttctttttagctcatttgttataaaatcggcttgaaatcatcatcagaaaccaaacacggaaaaaacgatataagagatccaaacacgatgacgataccgaggcataatatttattaacgaagttcagccgaaacctacatctctaggacactgattatgggtgctcatccccgatccaacatattacaatgtatcaaagttacaatgaccctcggccggatgccgccggcagtcactacctctcacctatgctaagtcgtcatatgtgattacaatatgtacatccctctatttaagagagggcctaggatagagtccgactcttactctattcttataccatataactccaagtcttaaattgtagctaactacgtatacatattcgacacacaaactctatcaaactccaccttggtgaatatgccacgccaatctgaattcattatttacacgaacttctgtgcattcagaattgagtttattccttttttttcccataaacaagagactccgtaatccctgtaacatcttcctcttgactctacctgcaacagtactccaccttctctcttatgataataattgtcttaccaagcgaaattggatccttcctagctgtcaatccatagattctctaaagaccatgttcatctaaattttatgtcttaaatttgccttgatctaaccaaataaccgatgtaatcaccacatagataaaattcaactcaccatatatgaagagaacactttcttccttatcgtcatatggactgagctaacaaatccaacattcacacttctcgtatcccactactacaaaaatgattttcttggacgaacccatcgttagattccaaacggtcaataactgaccgcgtatggaaaaatcgtcctcccattcttgcttgcggatccttaagaggtccgcacgcaaaaataagactatttttacgtgcgaacccttaataggcccgcatgtgaaaatcctctccctagattttgaaaaaaaaacttctctaaaatgatccaattgttttaaaaattgcctccacaacctactaatcagttggacaaaaaggattgttccatgccatgtaagcaatacaaaaatatattcataaacattgaatcattccatacattcatcgcatcattcattcctcgtgatatcatagcatacattcatgccattttttaaaaaaattattgctatacatgccatcaagcaacctgcttatctttaaattagtaaccttcgtgcttgctgtccagaatttttaaacttttgtaaatgtgggttcaactaagattgatcattggccatttgatcattggccatatatagatcccaaatatatataccataatgtatcttgttagaaccaacttctctagttccactttttggtcatctaccaaagccttcgtaaaccacaactgactaaaacctgccacccatctactaaatagaagtcaagtctataatacaacttaagaaagttactaccactcgtcaatcctcaagatatagtcatgacttaagctaacctcacccacaggagattaggtagaaccttttgttagagatataatgtggtatgtttgaaagaggcttaggaaaaataattaaatcagatactattgtgttatcagaaagcatcatgcaagtaaaacttttagtaggtctttcgatcatcagtcaaggttaggattataatccattcataactttaacaaaaattaaacggagttcgacagtaagaaccacactaagaagagtaggattcttaggaagccaacacattgatcaacgtaaccactacaaccctacccaaatctcggggacgagatttatttaaggaggataggttgtaacatacccgaatttcaggatgaagaaattttcgtcaaaattagttgaaaggaaagttcttcaattttgtgaaccaaaaatttccattttaaaacctaggggaagttgacctaactcatgtaactaaataaaatttgagagcaaattaaaactttttcggaccattcgacgcgtacgtcgtgcacgcgcgccgcctgcccggcccggcccggcccggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctagtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcatgagagtatatgcatctttacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataagtccggagtttcttaatttcctgacagacttcaatcgtcttttcacatgtctagaagatttcatattatccttagaactattcactttgacaattatcgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggatatatcaggcctagttgcactagccaggtacatcaacgagccaatgatttgggagtattccagttgattcctagcaattctcttgttcttgcgaagcaacaatctaggatcataaggtgttggagaaggcttactatcaatgtagccaaagcgattcaagatcttctccatataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactccaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatattcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcaccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcagtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaagtatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaataagattcctgtcgatagaagggacatgctgcacgttcttcagctgtacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgctctgcaggtgccttcatccccttgcgctgtggacacttcctagctagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaatggttgtcagccattttgtagtcatgaaactgctccatgatatacagatcattgctagcatcagtagcaccgaatttagtattcagtgcatcccacaactccttagcgtcgatcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataagttttttggattgttgagattatagatatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatagagtagtctacgagcgacggcgcagtacagagtaggaagcaaacccaagattgatttttttgtatgtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgcatctgcgcaagggtgtggagccaatttttcggaccattcgacgcgtacgtcgtgcacgcgcgccgccggcctggcccggcgaggcgagcgagcgcgcgtgtgttttccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtggctaaggcccattcattaattccaacattttatagccccattacaggttcttactactagggtttagattatacaggggaatttacatgattacccttatgaaagggacatttacaagggtacatgatgatataggggctcatgggcccttgatgggccatctggcgatcgccggccctattgcccctaggcttgatgggccggaaaggcttcttcggccctcgcgggggcgaacttgccaaggcgaagtcgtcttccttcggcagatagtcttcgccttgcacccttcgcctgagacgcctctggcctggcaaggcactcgcacgactcttcgcctcacgccattcttgctccatagtcttcgccatgggtttcggcagatttggtcgaagggcctcatgccatccgccaacaagcccctcacgggcaagggtgagattggagcttcggccgagaccgtgcaaaccatgtggtatggtatgcggcgccccctttcgaccgatgctcctgccgaaacctacattattcttgcgaatgaagtttgttatttgtgcggctggtattattttgccgtgcttcttctcctgcgtttggttgcatattcatatatatattatacacatttttttatatattttcttttctcgggccgaaaggaacagtattgggctttcccttcgtgggctttttactgtgccgctcggacggtgggaagttaccgttttgcctacccttgcgacacgtggcgctttattactggtgggtaggcgaacggtcgcccgggtgagctatatattcctaccgaccttttcttttcaccaccacacttgccattttaccgcgtgcgctctcttcctccgtttctttcttccacagcatctctcgacccctcaagcgtttcgcccattctctttcttcgccaccgcaaatgcaccgttcgccatggaccctcgcaagccaaaccctgcttcggcgaaagggccggatcccggccgagtcgatgacgacaacatcgcctttctgggggtctctcttgtggacgacgtcgagctggcgaagctggtccgctctggggtgttggtcgaggggcaggctttcgccccagggaaatccgtggtgccgaaacctatcgacaatcggacggtggtattcaccgtcttttttgaggcagggctatggttcacctgcaacatgttgttgccggagatccttcgcctcttccaggtggaacttccacagctgagcccgtcggcgcttgttcgggtcgctatctttgactgggcgtgccggacttccgggtttgagcctaacgccgagctcttcagcgccatatttttcgccaccgtgaacttgaagacggtgattatcccggctggaacgaagaagacagtgttcgggagcgtgaactttaatgttcgtcccgagcggtccgatctctggccggtgaacgctgccatgtcgaagtgggaccgccattggatggctaggtggttctatcacaccatccccttcgaggctggcactgacttggcgaaagccctccgttgccggcgtggacggcgctatggaggcgcggttcgttctgctgcgaaaggtttgctcccgccttagctgccatgacttggtggaggaattctgtatgcttcgcatctttcccctctcccagtcatggcaagtcacagttgatcaaggcgaagaggttgacggtttgccgaacctggttcttcctgagggtacggacagtaagattgttctcttgctatacactgctgtgctttattatcttgccttgtctgactgttaacatagctacacactttacttttgcagcgttgaccctcgaccaggctgaaaatgaggcccgcaggatgatcggcgacgtgccggtcgtcgagtatagccagttgctaacacgacaagcggctgggcgggcgaaccgggtttacaacggcgaattgcctcctcgggcaaacccccacaaagctgacgacgatgcaggggcttcgcgaaagcgaatgcgcggacaagtgaagcttgcccctaggaagcgaagggttcctgcttcgccggactccgacgccgacgacgaggatgatgccgaagaacgcgacggcgaggaggaaggagaggagaaagaggaggccatggccgataaggccgcgaacgaggcgatcgaagaccgcgtcgacacccccgactacactcctaccccaagtcccggtcacaacgagaccggggtggagtcgaacagctccccccttcgacggaaggatttggaaggggcgaaggccctagttgcattctcctcgggcaaggcggcgaagggaggtccggtgcagaagatctctaaaaagaaaggactcgtcgacatcgcccacgttttcagcgacgacgaatcttctaacgggactccaacttcgcctgctggccgcagtttagacctttcgactgctcccctcactccactcggcgttgctggggcaggcggtaacgtcgccgccggggcttcagcctccgccgaacgaattgtgtcggctgcggcgagggttttcgggagccctctgcgtgagccagctatttcgccgctagtcaaggcgaaggggaagtgtgcggccgccgaagcatctgcctctgagtattcccttgcggcgccccacttcgcccctggtgatttcgagactcgggcggaccttattccctttgtggagggagtgagcaaccttgtcttgcccgccggcaccccgagcttgttcaccgaacttaatgagttcgacgaggggtgttccgccattaaaagcctggcagttcgggtatgccttttcttccttcttcgttttcctcttcgtccccccctttttttttacgtctgacaattaaccttttgttcttttggcccgctcctatctttcatctagattcttgcggcactgttcgacggagcgaaccgtacgggcccgttttgacggttttaagagccatcttcgggccaaggacgacgaaataagccgcaagaacttggaggtggaggccctggccaacaccctcaaggaggcgaaaactgaagtcaaacgccttcagtctgagctagataaggggaaagaggccagggccgaggttgatcgcctcaaggccgaactggagaaggagaaggcccattcggcggtgctgattgactactacaaccttactgagccgaagatggaggctcttcgcctgaaggctagtagggccgaagcgagcgccgcggaggagtcgcagcggttttcacaggagatggcgaagaccaccgaatccgcgagaacggcttgccaaacgctccgcctcacccttaccgacatgggcgcgaaagtgcggggggtccctgccgaggatgcatcagccttcgacttctccgagtggacccagcaggctgacggatcggtttcggactgcgccaccgcgtacggcgattgctgcgcgcgtgtatcggcggccttcaccttaggccttttgcaacagttcggctgcgagcacgtcgccgagttccctacctatgcgaagggggactaggagattagtgcgcagaacatctcgcctgctcttcgcgcgtggcgaaaacagttttggcagaaagatggctggtccgctgccaaagtgcgccttctggagcaactagcgaaggcggaggcggcagatcggggcgaaggagagggcgcggcaggcgaagaggttggaggcgatgcccaggatcacccagaggtgtgaggccctccgccctttccttagatttttgtagttttcctccctcttttgtgtttgcctggagaggcgaatgatgtacattcgtcaggctgtcgccaaaccttaaaaaaggctttttttgtacatttggaatatatgacacaatcttaattactttttgatgatcgaagtctttagcatatttgttatttcgctcatctcgtattatgccatacctcccccttcttacgtctattcttactatgtaagctgtgttttgctttttctgcactgtccatcagggggttcaccgaaagtcgtgcatccggcccccttccgggagctggcgaagtcaaaatgagaaatttgtggcagtgaagggtctgccgaaggtgcgatgtccatttcggcctgtttatcgtgaaatggagataaacggtcgcaactataaggttttcaaggttgccgactggctgcgggtgcaccccgggcgaaccttagaagattacgatcttgttcattctagacgtttgcaggatatggctcgcttttggcgaaaccatcagaagactgaatgtcaggaaacgatctttcagcgtcgttatagtttagtatgtgcttcaccccctactcctcttaaggttgtgtacgatattagtagtgatgacgaacctagttcgcctgatcattccttagggagggatagtgattatggggacgaacatgtaatttacttgtaaggtgaattgtatcgtgttgtgaaacttctattcttcgattatttttttcaaagttaataaagacgtgttttatttccttttcgctattgtttgcatcgtcacattttgtgcttttgttaggtcagaacatgccggcccctttgcatatatgagcgaaataggtgtactgacttttcagcttttcgtcgttcgttttcgatctgtagcgttctgtgccgaaagaaacgcttttgcttttatgctgatcggacgtaacgtcgttcggccatttaatttccgagacaagctgttgcggtttcaacgttcggcgagcgatgcttcggccgattcgtttcgcccccctggcctttttcgctgatcgagcatttgccttgggatttttccacaaattatcaatcacacgaaaaaaataaaaagaaggcggaggacacagagattttatactggttcgggcctccatggtggataatagccctacatccagttttttcttcttttttctctctttcttcttttttttttcttgccgaaaggctttcatagtgctgaagggcttacatagtgccgaagggcttacatgacagtatgtacatttttacaagttggtgatttgggtgccaccctttctagacatagaagcgcttgagagaggcggcattccaggaatggtcgaactcctcgccttcgagtgtcgctaggcgaaaagatcccgtcctggacttgtgtttgatgaggtattgtccttcccactttgattcaagcttgccaaccgctactggttcaccttcttccttaggacgagatgaccaggcatcagctccgtgggtcgaacttttttgttgtaagttgccgaagtgcttgtggcgtacttgtgtatgtgctcgagcgcttcgactcttactccttccaagagttcgagcgatacttcgcgtccctcttcacccccagagaacatcacccttggtgagttagcccctagctttgctggggtcattgcctcatcgccataaagaagcataaacgggctaaacttggttggtcttgtgggggtcgtccgaagggcccagagaaccgatagcaattcctctggccatttgcctttcgctgccccctcgagtcttttctttagtgcttctaggatcttgccatttgtacgttcagccgccccatttgactgcgggtgtgcgaccaacgcgaacctgatttccaggttaagcccttcgcacatttctctgaacttatcagagtcaaactgcttgccgttgtcagtaatgaactcttttggcacttcgaaacggcaaacaatgtttttccatacaaacttctgtactgctgccgaagttattgccccaaggggttcggcttcaatccatcgagagaaatattccacagctacaattgcgaatttatacccgtttcgcgccaccaggaacggcccaatgatgtccagtccccatctggcgaagggccatattggcgcaatgggctgcagatcatactggggcgcggcttggcttcggccatgacgctggcaacttttgcacttattgatttgctcaacacagactttcaacacaatgggccaataaactccttgtctaaatactttggaggccactgttcttgtagcctggtgcgcgccacatagcccctggtgtatctcctttgccatttcttcgccttcggcaaaagagatgcaacgaagtaagggttgaagtaccccggagcggtaaagctaacccgagaccatcttatacttcatggctctgagttgcaaacgcttcgcttctgcttcgtctaccggaagccagccagtttcaaggtgttttacaaatggggttcgccagtcatatgggtcttcgcccagtttctcctggttgattgccatgacttccgagctgtccgtgggcacacttggagcatgtaagacttcgaaaaagatgccaggcgaatgtgggccaccacaagcagcggatttcgccaaggcgtctacttccttgttctggtctctaggcaagtgttcgaccgttatgccggtgaagcatttttccatggaccgaacagcctccagatacctcttcattccctcttcttttgcctcgaaggatttgtcaacatggcctgctaccaacttggagtcagttcgaattagtaggcgccggactcccagtgctttcgcctttcttaggcccaggagaacggcttcttattctgctgcattgttggttgtgtcgatctgcagtcttgctgcgtaccgaatcggcacaccatttggcgaaaataggactgccgcaatgcctgctcccttgtgcgaccacgagccgtcagagcacatcacccagaattgttcggcgggctcggggtcgggggcaagtactggtgtccattcagctacgaagtcggctagcacttgagacttgatagcagagcatgcaacaaaatgtaagtcgaacggggatagctctgccgcccacttgctgagccagccagtgacttccttgcctcggagtatttcgcccaaggggtactgtgatggcactatgactttgtgggcctggaagtagtgcttaagcttgcgtgaagccatcactagggcgtaagcgagcttttccatttcaatgtaccttgtcttcgctccttgcagtgcttcggagacgaagtagaccggtttttgtccgaactctgtttcttggacgagggcagcactgactgccaccggcgaagctgctaagtataatagcagtttgcttcctggggttggccttatcagagctggtgggctttgcaagtattgctttagctcgtcgaatgctacttggcactctggtgtccaattaaactttcctgcgccccggagggtcttgaagaagggcaaacctctttcggctgcctttgagaggaatcgactgagtgccgcattcggccagcaagcttttgtacttcatgtacgcttgatggaggcttcatttgctggatagcatcgattttctcgggattcgcctcgatgcctctttcggaaacaaggaaacccaacaacttgcctgcgcggacgccgaaaacgcacttctccagattcagccttatgcctgctgtgcgcaagctgtcgaatgtctcctgcaggtcgatcgcatggtcgaaagccttgcggctttttacgacaatgtcgtcgacgtaagcttccacattccgccccaactgcttgccaaggaccttgtacaccagcctagcgaaagttgctcctgcgttccttaagccgaaaggcatcctgaggtgacaaaatgtgccgaatggagtgatgaaggatgttttggggacgtcgagcaggttcatgtgaatctagtggtaaccggaatatgcatctaggaaactcatgagcttgcatccagctgttgaatccacgagctggtcgattcgtggcaaggggaagtcgtctttcggacatgctttgttcaggtctatgaaatcgacacacatgcgccatttgccgtttgacttccgcaccagcactggattcaccaaccactccggatggtcaatctcttggataacccccaccctgagcaatttttgtacttcagctttcgccgcttcttggcgatcggcagacatcttacgcaacttctgttttcttggcttaatgtccggcttgaatgctaggtgatgcataatgagatccgccgggacaccccccacctcgtcagggcaccaggcaaagatatcgatgttttttttaagcacctgtaggatactctcaacttcttcttcgcccatgtcgccccccagtgatacgagctttgtggggtcggcatcatcaatctgcacttttgttatcttgccgtgaggggtgggctttggcgtgtgcttcggccgttcatgcggttcggtctcaacactgttcactgctctgttgattatggctagatcaccttttgaagcggccgaaggctgaagccccttgactactatcacccctgtcgggccgggcatcttgagcttgagataattgtggtgggaaatggcttcaaacttgttcagggttgcacggccgaagatggcgttgtagttgtacgggatgtcgacgacgtcgaatagtatttgctcttcgcgtctgttctccccctagccaaaggctatcagcaaaagtgcttggccaagaacttgaactgcttctccgccgaatccgcggagcgatgctggtgctggggtaagggcttgggtaggcaaccccatcttggcatatgcttcggcgaagataacatcggccgaactccctccgtcgaccaagattcgtcggacttcgaaaccagctatctcagctgagattaccaggggatcttgatgcgggaacataactccttctgcgtcttccggcctaaaagaaattagctggttcagatactgcggcgctccttcacccgccgaagtgatgctgtggaccatacggatctgcatcttcttctgccgtttggacaactggcttggcgggtcagcccttgtaatcacttggattacccttcgctgtacatcttggcgttgttcggctgggggtgtttgctcctgaactgcttcgcggggtgcttcaacagttgttccctgctgcggccttgggtcttgcgcgttgccacgttgcctaatgtttcggcattgctccgtggtgtgcgaagagcgtccgtgaaaggcgcagtagaggtcttttcggaccttcttgcgggctggctgctgatggttgctcgcttgctgggcatcgaactccttgcggagggcttgcacttcttcgaccgccatcacagctttgcccgcacggcctgttctaaactttctccaagttatgggggcttggccttgccttggcggctgtccttggatcgccggctgagactggcgaacgaagaggggaggtggttcggcaacttgaacttgtgcttgagcttgaacagcggcgacggaggctttgtcgtactcagcttgtatagcttgccgtcgcttggaatcctcctcgccccttgcgaacccgtcaatgatgcgaagtaggtgctcgagcgtctgaggctccatgttggcgatttttcttgtgagttcgccctcgagcagaccggccgaagcggcgtttataactgacgcctcggttatgtcttgaacttggcaccgggcttgcgagaagcgacgcatgtactcccttatcgactccccttgcctttggcgaatgccgagtaggtgttgttgcgtcttcggctcctcgtaggtgcctcgaaagttaaggaaaaaaacatcgcgcaattgctcccatgagtaaatgctattggctggtaaattgaaataccaagaacggccgatgccgtctagagcgagatgtattaccttcgctttggtagtttcgtcaccatgagccgcttcgatcgctgactcgtagatggagaggaactccttcgggtcagtttcgcctgaatagcgcgggacgggtgggaacttgaactggggtggaattggacgagtcttgattcccccacttagcggtagccccttttcgcctcccgccctgtttaccgcaccctgctgcgggtacggtgtggcgaagggcgaaatcgcagcttgtgcgcaaggttgggccatagcattcggctgcccggctccaactggaggtacttgctgagccgccatggatgggtcaaaaattggctgtgaccacgtcatggtagcttggattggtgcttggtttgttccgaagcctggagttggagcttgctgctgaacggttggcgcctgagcagcgttgacgaagtcgaactgcggtccttgattccacagcgaaactcccaggcccggctgaatcggtggcaaccaattaggcgcaccttgacttgtattcccctccgggtgggccgatggggttgtacttgaaatgcagtggggttggttgagttgctgaaggaaagcttggagttgcgcctgcagagccgaagccccttccaccattgtttgtggcgcttggccgggtggttgatggtgtacttgggcagcgactgcggccgattgctacccggcgaagtacattggcgcttgtgcgacttgaggtggaaagggctgggtcgtcacttgcggatggacttgaggcgggacataacctgccgaatactgaaggattggagccgacgtgaccttggtccgccttgccgcctcgtatgcttgttgttgttcttgcatttggcgaagcatgtcttggagccgtgccatgttttgtcgcatggcttctatgtcggcttcggcttgtgtttcggggtcagggctgacttgggcctgcacagcggcgagcgcagtcggggccgctgccggctgcgatggagcggcttggggcaccaccagttggcttgtcgaaaggatctccgccctggtctggagtgcccttgccaccgcagccgccttcgccacgtcggccgcgttcggcacttgcacagaggtggcgggggccgaaggcggttgtgatggcgcagatgtggaagcgaatggtcctcctccatcttcggccacgggcaccgaaggctctgctccctcctcggcggccatgtccggtgcggcgttgctttccttccgccttgcaaccttctccttcatgaccttcttcggtggcattccctctcagtggtttcgctcggaggtccccacggtcggcgccagctgttgtcggaatgacaactgcatacgtcgaaagacgtggttactcaacagtggtaggaagaagacgaagtgtattaaattttgagtttcccttcttttttctccccccattacatggccctaggggactattttatagccccattacaggttcttactactagggtttaggttatataggggaatttacatgattacccttatgaaagggacatttacaggggtacatgatgatataggggctcatgggcccctgatgggctgtctggcgatcgccggccctattgcccctaggcttgatgggctggaaaggcttttttggccctcgcggaggcgaacttgccaaggcgaagtcatcttcctttggcagatagtcttcaccttgcaccctttgcctgagacgcctctggcctggcaaggcactcgcacgactcttcgcctcacgccgttcttgctccacagtcttcgccatgggtttcggcagatttggtcgaagggcctcatgccatccgccaacacattagaagagccctatttggtaaactacattaacattagagagggacatataccacatttgggtccatcatgtgtggactaagaattcttaactactattcttagtatatctcatttagggtcattttttaaagagtaaagtgcacgggtggtccttaaacttgtagaggtgtgtcatctagatccctaaactctcaaaatgcatattcaagtcccagaacttgtcatagtgtgtcatctaagtcccaaatcgccacagccccttcaagttcctacgtggcactgatgtggcatgccacacgaacatgatatgtcatcattttgactgacaaataggactcatttaattttttttctttttttcttatctttttcttctctttcttttttcctttcttctcctttctctgtgacccgagcaaaagaaagggaaaaaataagaatgagaagaaaacaaaaaagaaaagaagaaaaaaaggacacgtcgcgtccatgtggcatgccacattggcgccacgtaggatcctagaggggctgtgttgatttgggacctagatgatacactttgacaagttctgggatctggatcagcattttgagagtttggggacctagatgacacaaccctacaagtttaaggaccgcctgtgcactttactcttttttaaaggcatcatttcatagaccctcttacgcacagagagtgacagatatttaaacaaatttggcccttaggagaaatttgagattatgcctattatcgattaatatcctgacaacagtatcatgaatacctaaggtcgttcatgtcaaggattcctaaacccacatatccaaaaaaaaaaaaaagccgaatgtttttttattggtccaagccaccctacatcatttttttttctaataggaactctccaccatattttgctttgtatatatgtggatgtgtacatgatacaagatatatggaggggaagctctagtctaaatctaagaaactgtctcgtcgggatcctcaaattagaaactagtagctagttgtgtcatgatcggcgacttggtttcttggcaccagttgtcttgtttaggcttgtgttggcttttcgccacttgggttggcttgaactgatctcaataggtttgccttgggtctgcctacaccaaggttcctaggttcccccttgtcctagaaggacatataacttgatttggatattaccttgagcagtactggttggccctaagtaggataatgtctttctttcctagctggaggactctttccatatcagctcaagactatccttatcttggaattgtttccatagaggagttagtcgtggtatttctggaatggtacgtgcatatatggtatcctatatttagtacaccaacaatggcataaaaagagggtttcactagaatgcaatctcttaactgggatcgatctcaacaccgagttggttgggctcgaatcgatcgtgccacactaacccatcagctcctccacattgcatcgccgcgccagcctgggcacccatatgatattttgatggacatatttcaacggctgcagctgtgcgctgcagcttggaccaccagcaaagggcgcggttgacagctcaatgcaagcacgactgaacatgggtttagattgatcctgcttagttcagcatagccccaagggcattttggtccctttactacgtgagaaagggaaaaaaacactaataggaatttgagaatggcattctagtgcgcatcctctatttgagaatggcatttttgcaaagcttaattgaggtctggaattttggcgaaacctgttttcgatgattgaataatttgaaaattttcccttgagggtaatagccctatgtcatgctcagtttgtatatacttgaacatatataatacaatatttggatggggagctcttgtctagacctaatagactatcttgctggggtcaacaatcagggtgttttcgtaaagctctcatggtcattaacgaaataaaattatatattcaaccgaaggacttcaacttctatgcaacacttgtccaacatgaatatcaaagaagacaacttctcttctctaatctgctttcttcttcatctgcttgattgctcggcaagggcgcaaggcataactagagcctaaccagcttggtcccgtggtgagcagcatcattctcatggacggatgccgggagagtgtgaggttgagactgtgctaagctgctgctattgattattgattatcagtaagggagattgaaagtaacagaagcaataactaaccattctaacagttcaccattagtcaccatctaattgtatcctagcaggcgttcctggaagtggcctgacattggcaggtgccaccacatccacggtggtcatgtctagctctgtcttgccgagcggaggaagaatatattgggggattagagagaagagagaggttgcctactttgatattcgtattggtcacatgtagcacaggggggcaaagcccttcagatgaaggaaggacttcagtcatgtataattttctattgtcattaactcaagttcttgtgagttgtttggcttgattggcttgactcacatggccttgtggcctctctatatttctatcattgtgcttccccatatttgttttgtttcataaattaatttgttcacgtcacattatatacagttgtatagcattacattttcccatagtagtgctgtcaaagttacgcgatttccctgtatccaccaatagacttcacagataacaatctaaaacaggttgtcaatactagtaccaccaaaataagcacgaaataaatatattttgataagtggaaataaatccagcaaaatgccaggttgtactttgtttctactatagctcctagtgggaacgcgttcgtccaactctcctatatatcacaacaccatggacatcaaattcgcactaatcctcccccttcatcccgtgtcacaaagccacaaagaagtttagcaggtcctccatggcagcctctctgccactgtcagctgccatcgttggagccgaagagtcggttgacaaggaggtcttggagatggagtacctctttgagaagtttttgatgccaagtgacttgtgcagcaatactgaatggcttgggatcccagaagaacatgttaggaaatttggcatgatgttggaggacagggacggttactccgtcattttctttcaggacggtgtggtgcctgggaagttgtggtgctttaggtactggaaaagcaatggagtccatggcttgaccaagggctggaggtgctttgttagggagaagggcctcaaagccggagacaccatctccttcttccgaggatctgcatgtggccgtctcttcatctgctgcaggttaggcacccatgcaacctttgcgtcatcctccaccttgcatcatggcttttctatgcccccaccacctgcccgcccgctggtgggtcttcaatctggcatgttggcaagagatgtcccatcattaggacaagctaggttgcatgatggaaatcaagatggaggcggtgcaccatcaagacatgttccatcctcaggacgacgtgtggaggcacagctatcacgtgtgtcgtcgcgccgtcaacgccgtactatgaagcactcgataccagagcccacgatagagacgccaccaattcttgagtcgatgttcctcatagccgcaccaccggcagtgaagtgcttacggctttttggcgtcaacatctatgtgttgcctgtgtcctctagtggccagccaaaacaagaatccagcccataataccaggcaccataattatggacaccccattgaagaggatcagagcgtgttggaggcgacaaatgttcctcaattgtatcgtttggttctacatcattcttagatcattgtggtttcaattattgtaattcttagtttgttatgattggttttctattggcaattattgtctttttggcagttattttagcataagaaattattttgtaccatcttcatttattaatttcttttgtttcattcccatcatgtttggggtatttgaatactttaacttccctactatccattttcttaatatataaaaagtaatcctatcattaatcatagtaattaagcaatatcgggccaattactgtattccttttttggcataatattcaacaaaatgtatggttgcttttcatatttctacattattgcaaattggatcaattcatcattgctccttatgatttaatgttgtttgatatttgtgcacacagatacaaagtgtatgactacatggtggtggcttccccaaactagataacaatatataaatctatttgaactccaacttcttgtcccgtggtacccttgcctatcccaccaagcgatgccgcttaactctttctagtaatcacgcactttctaactactacaagaacagaaccatgggtcactaccacaaaacatctaaggtttccattttacaccacctataaacatacttataaacataaaaggaaatcaactgtttataattaggggtacaacctatcgtccaaataaagaatagtcaagcgttttggtcggttccctaagaactatttcatcaatggaaaaatgaagtgtgaggtgattcaatatcaggtgaactgctggtcaagaggagtggaatgacatgtgggatcacaaatatggaatgaggcaacaacgctggatggtatggtgtgttcgccatacaaaaacgatgtctaaactgtattatatgacaaaaaaaaaacttggtctttaagaattatcataccgttgggttcattccattcaatgtcaaatggaaaattactcaatagctcatatggtttaatgccaaaaaaaaattggcaggctgttggtatttcttacgatcacagataaatccgcaagcgcacgaaacaccgttgtagtacttccccttagagtattccaaccgtatcgaacacgaggaacatgtgtgtattatctactgccaagattcgattgaaggacaacaacccaagataaattagctagagaggattcctatgtcttttagttagttacttaagttacttaaaggtaagactctaacaaatattcgggaaccggccctcccctggtctactaggataagtccgggcttgagctctatgatgtacctgaacgtggatgaatacagaggataaacttggctgtcaccacctgccccctacctcactttccgtgggcacacaacaaacgaaggtaatttctaacctagacaccacacctaagttattaattactactctagccttgcacgggaacttccttctttatccagagttctaatactagagcactcaagtgcacactaagcgatgaacccgcaccgataaaaatgtatcacttaaataaactaattaaataacataaagaaactcgaatacttaattaaataatggaagcatccgacaaggtacaagcgatagagcaaaggcgacaatcccgtcatctatcaaattgccaaaatttcagttgtcacgtcatctatcagatgggccatactagtatcagaaatttcctcagaaaactatgacaccacattatccattgtttaccttttattaccacaggattgtccattagttactctctctgttcctttatgttaatcaccaagcaatattcatattcaaacttccaccattcgtcttctttacagaaaaaatctaaatacttaaatagaccaaattaatacgacttaactagccatatagcagccttgtacttaggctgagtttgaaggagtatttgggcggaattttgtcctcatttaccttgagcacactttcaaaaatactaaatggtgtttttcatataaaaattgtctatataaaagtttgtttaagaaattatattaatacattttccaagtttgcatgtcacagctagcatttccattggcacgtctagcatgagaaggagcttaatcggggggaggtgcgcagtaaattcgccacattcaacagaaataggcaaatagctacgccatcaagagaatccgaaattaaacttctatgatcgtctggcatttgtgttctccttatttacgccctgccttaaaataattttcatgcatatcacgtacgctatctacagttgtccggcattaaggttttccacggtagtagtccaaaatcacgcatttttcctggagtcctgaagaggattatttacagttgacaatcgtgcatatgccaatgtgaatgactagtgctgccaaaataagagagaaatgaacatgtcctgataaataagtagtagataataagccagcagtaatctcacgattactagctccagcaaaatgccaggcttgcactccatatttgcactgtagcctccagtgggaatgcatttcattcctaaaccccaattaaaaaaaaaaaaaaaaggtgcttggacctcccctatatatgtgcccgtaccatgggcctcaaacacttgacctgctccttcgatcgtccaatcctacgaaaccacagagagaatctcagagcggagtactccgatccatggcggcttctccgccactgcctacttccatcgatggtggtcaagtgctagatgacatggaggtcgtggagatgaagtacctgtttggcaaggtcctgatgccaagcgacgtgtcctgggacaccgaacagctcgtgatcccggacgagcacgtcgggaaactactggacatggtggtgatgaaccggccggaagggggcttcttcgtcgtcgtcgtcgaggatggcgaggtgactgggaagctgtggcttttcaggtactggaaacgcgacgacgtccactgcctcaccaagggctggggttgctacgccagggagaagggcctcagagccggagacaccgtctccttcttccacagcaccgcgtgcggtcgcttcttcatctgctgcaggtgcacctgcatgagtttcttgtcactacccacaacatcgcatcgcattcacggctcgtctgtactgccgcaaccgcgggctgcccaggaggcgcaccatccattctcaggacacgccacattgtgtctcggcaacaaagctagtgatcacagcgcgccggcaaggcatgccactgcctccttagggtgtgcggcggcgcagcctccgcaggtgccgccgacgccgacgccgcgtcgtcgacggcgcagtatgatggttcacccagaaccaccggagcacacaacggacggcatgcctgtgattctcgagtcgatggcactcgtatccaccccgcccgtggcgaaacgcgtgcgcctttttggagtctacatcgacgttcctccactgcgcccaggcggcgaggcaacacaagatttcaacccatgatgatggcgtgccatccgtggacaggaacgccctcaagaggaggcgagctgctgcggacaattaacgcctcctgatcgaattgtatcgtttagattgcaagttctgcgtcattctcgcggctttgattattgaattcttaatttgttaggactttggctcctgaacaattctttggtgaatattatgttttttggcaacatgtatggcagcagaaatgtttttcatcatcttttatattaaaattttgtttcattcttccatgcaggtcaatggtgttcaaatactttaactttcccaatttccatttccaaatcagtagcttctttttaaaaaaaaaaactaaaacactaatttcttggtcatataagtataatcctttcatgaaacccgataattattacaattagctgcccaattagtgcattccgttcgagatatgaacaaattcaaggttttcttttcacatttctacattattgcaattgaatcgattcatacagacataatgttgttcggtattcgttcatatacacacaaagacgatgttttcctgtatatatgtcatggtatttccattccggatacatggtgatgggtcccccacgtaacagtgaatctagctagtacaactccaagtgataaggcaccatttcattcgacttagctgatctactctcttgttttcagtttcttgtgagcacactcttcgaagtgctaaatgttgtatttgttttaaaaactttcttttgtagaagtttctttctaaaaaaataaaataaaatatttatttaaatttataatacttaattaatcatgtactaaggatatgctttgtttcacgtgtggctgattaggcagcctatataactctgccaaactcgacctaatctacttgtcttgcttgtcccgtgaagagaatctctctagctctttctaattcatatactcctcccgtcctaaaatataataacttttagccattaaaatttttcccaaaatataataatttctccactaacattctctttctaaccaatcacaaccctccaccattcacttttcctaactacctccactactcaaccaatcacaaccctctatcattcatttctacctactttcttgataaccgtgtccacctctaaaaatacttatattatggaacggaggaacgtagtagtatttatgcccttcctaatttgtggtgatgaaggccatgggcataggcggccctaccagatcaaccggccttgtgactcgtgccactggaagacaaccattaaagaggagcagatgggcaaccagccatccatcttgtaggtgcagccaatgtgaacgtgtcccgatagcccagcagcccattaggccccatctacagttctacactctctccaccttatctctagtcttcctagcgttatattgagcgcgaactacggaatgagcggcccttcggctttggcgatgggagcaggagtgggctacacgttgacgatggcatcgcaacgacggcctctccccggtgagctccctccgctctccctccagtgcgaagtctagatcgaggtcagcttcgattccttgcctcctctgccactggcgcaaccccgcccggtcggcctccacccactccccttcgtcttgctttgcccccgccaccaccagctatcgatcctacaactccggcggcgccaccgccgcctcgccacctgcctttgtccgcctcccaccaacggttcatcacctcataggccatccccctaaacccgatgccccacttcccccttcccattgccaccctcctctcacttgatcaagacatggtcccgatctcccggtaggtatcaataagtcgattgaggataactcaacgcgggtgatctaaaggctccgacctgaattattgaacccctcataatcactacaccactgctctgttggttatcaattgtgccgaaacacattagaacccaccaagaaggctatttcctagcgaatcaatagtacaagcaagagggttgcagaagtaatctgaatattacaaatatacgatgaatctcccaagtttgtgttccacaaaccgaactagtggcaaaattggatttcgcaaaataatgtcagcaaaatccgacatgagaacggctattgaataaatatgattaaaaacatcctagggttagccttaagtccaaaaattgtttcgaactagataaggtacgtggattgcgtttacaattctggacaactcggaaggaattttgacatgaggcaaataatgtatgaaagtggactcataagttctataacaaatacacataggctctaagagaacttctggatcagcagatatgtatgtttaaagttgatattgtcagaagacccgaactcacgaacaaaatttatctcttgtctattatagttaaaaaatgatgatgaagcatgagaggagaatagggcaaggcctgatgttggtccccgatccacctcagtgaccatgcgaacattccctgcacatgttccactttgcttcacccatacgagtacttctgcaacacacaactcaatgtgtagcatccttcgttcaaatgcatgtctaccataataaacatgcaccttgagttcattgatgatgtgtaacataaatatggtcatatccgagcagatgatgtattgatcacaaccctatcctcgaatccaaacccgagcgcttatcgtgccaccatcggaatgtatttgcgagaatcccatcacgcacatgttcacaaattaagttttacatcatgtcgtactttactcttgatgcttttctataaataccctgctagagtggaggaaatcgtgatgatgtgaaccaccaacttgtccatccactggcaccgatcaatgatcatctactagtcagtttgaaggatgccaactgatgaaacccgttacaaaagaaaaaaagaaagaccataattttcaaaaaaaaaaaacaaagaaagaccatgctcagccttgggtacctgatctaaaggaaaaattaggcgcccattatccattgttgggcacacgctctctgctaggagcatgtttggttgcttgactacactcagcctagtgcaggcaactaaacaggcatgccccctctttgtttctctatgctacaatttaaaaggacactacttgtgtagttagctagtttctcatcttgtatcttcctcactttaaatggtttttctcccaaaccacctatcctatttacgatctaattataataaatatttgttttgatttaatatttataataagatcaaacacgactatattctgataaaaaatatatgttttaactgttaaaatttgatgcttcatttataagaaacaaatgttttaactagaatttaattatgttgcacatttaagttttttgttacaagaattttttcaatgttgcacatggtattgttttaatgtgtcatttaatgtttacaaatataacagatttgtatttttttaattgtttcagcaaatagattggaatgtatcaatatttacaactccatgtttcacgtatgatataaaaaaatgtttcaattaggaatatattatcacatatatttttttcatcagaaatataatcatgtaaaatcttgttgtaaaggtttagttacaatgaattcaacggtgcaattagattgtatatcgaataaattatttaggagaaaaaattatttaaaatttgataaagaaagttgttttttgttgagagaaaattgatgttgtgtagcacatcatgcatggaaaggttaaggtaacaatgagatgtttttttcttcgatatgttaaaatcgggcagggtactaagacaaattcatccaagaaccacatttggcacttttatcaggttagtatatgcccttcgatttattcgcagaaagaagggcttactggttcaaaccaaaatataagttaaaaggaccaatatccttctttgcttatatgaattgcagtcaagtaccgtagcagagattttctttacagtaaacaccacaatattacagcagcaaaatatggatttccaaattctttgctaggacaattagtttggtgctacaacaaaaactgctccagtagcgcaagctcgggagaacgagtaaatataacttgttatataacatacaaaaactgtataagtaattaaagaagcgcatatgaaccaacaatttaaagtctcaaggcagcaattgcttcaggcctgaagtcaatccgaagccctaacaccctcctaacctctgctggtgtcaaaagccatgtcagatgcccggcattgtcaccccagaaatccagtatctccgatacccgctcaaaattcagaattgttgacatctgggaaagtcttgagaacttgtctcggactggtctctgtgacatttccgagaaatggttgatcagggagcgtacctccttgtcgagctggagcccaccaagctggctgaacctcttctgcatcattatcacttcaagcctcttgacaatgaagtcgatgattaagtgcacaaaggaatcatagttgtttgatgtcatcacgggctggagccatgcaacattagtattaactgtaaggagaagcttctgcacccatggatcattcacctcattttctccatattcggcatcatccagctcataactgacagtggcaacagtgtccagaacaggacgaacacggggtgccacagatgccactaaatgctccagtccagaatgaaggatcttcttgaaggaagcactgatctcacctagctcagataaacaggatttgattttctctcggtcagcaggagcatgaaaagcctgttgaacaacaggaatagtcagtacagctgggttgtcaacacgaaaatactatgctacgaacaaagtgattttatcagataagagtgaaactattagttgtttttggtgtaattaaggtattttgaaagctcattgtaaagttttaatttgccagcaggtttctcccacattcctaattcatttttgacatgcgcatggtctccaatacatacatttgacaattaaactttctcaatgaatgttatcagcattataatatctacaaaattcctctttcaaatataatatggttggatttatcatgtgacatgtctgtgtgttcctcaccttatcatgtctattttgcagtaaaaccatgtgtcactaacttatttcagtcaatcaaatgcactacaattcagggttgtaagcacaaatgaaccaactaggtaacaagtaacatggagtccctaagtccatcgcaaacacagtaataagatgtgtgcatgatttatgttccatacttatttcatagctaagaaatttagaacgaagcactcagctagtcagcttccaatcaggtacgcagcatcccagctccacaaccccaacagggcagtcaaattcctccatggaatgaagcagctggaggtagccaagttttactagggagttcagtgcttcaatgaggcagtagcaatgcacttaaaatattgttggtgacgactggccacaagaccacgctgtggcaggccttgtgcaatgggtgtcaaaaatgttagacatcaaaacatgtttgttgctacaaatatgttatccttttgcaatttgttctctaaagtgttgcaattgcaactattccttctcaatgatacaatgttgcccagtagatattagctagactttttacatttgttgaaccaagggggcattttgctgcaattttgttatataaatgttgccgttcaatgatttagaggcacacagtaggatgcctaagactaaatcactcaggggacgatgcgacaggaacaacttccttcagacatttgtcaagtccttctagttccaatgtaggaaaaaagctaagaggaatcaaggtcaaccatgagcatcggatttaatcttctggaaataaaactatgactacatttcctacccatctgcaggcttgccaaaaaaaattactaccattttttccctttatttcatggttgtgcagaaagatgcactttccggtgacagcaggtcatttgttttcaggaagcagcagcatgtatttgacaaatctcttcaaaggcagcaaccattctgctaccctccaagcatgcaatcatcacatccaaatatattcaactagcttagggggtcactggtggaaacctgggagcgttggtttgcaaatgcatctgtatgacaacatgcatgcaacatttgatcgttttgggtcaatggtgagtgggtaagagcacagatacagttcttgctcttgaaaaggctccttagagacgtactagttcaaatagctgcatgctaacattgattttttgtggatgagtgagcacaatcactacaaaacattgtgcaggtgtgacagatgcagcaaactgtttcaatttccttagcaaaagttagcctggtaaagtgaacattataatttgacagatattatgtactagacaacaatgttgatcagatacataaaaataggttacaaattcaagtgaaccgtggagggagcgaacaaaatgaactgttattataatgaaaaagaaaaggtgagattgcacaatttgtagcttttatctccatccaacaggagatagatttagcaaatagcagtggaccgttattgaaaacaaattgcaccataattgtaggaagttcctaaagatttatctacaggttacagcatagctaaatatatcctaactaagagactatttattcaaggaagacacatataacccttttacatatgtgatgctgttttggtgccactcataaggtgtgacaacatgatattatcaactactttctagaggcttctttcactaaacaaattacaagaactggacaaaagcaccgatatcttaaattgtaataactgagagactacttgattaatcatgatatcttaaatcccaaatgaatgcaagttatgaagagaagaaaaggttaacactgacctctgaacagagctcctcaatctcatgacggagcttcaggacatactctgagctaacatccatgttgttcagcgcagttgcaatctcctcaccagtcttctgaacaccaacaccaccaagaaagagctttgcacccaagtttggttccctcatcctccattgcagtgcttcctggtactcattgctcagtaggctcgccgccccaccaagcactgcaaaaattgagtttatacttgcagtggatgctgctcttcggcagcaactctgcagtacgaagaacacatcatccaccattgatgttgtgagaccatcaggcactggttcatcaatccggatggctttccttacattctcaaccatgaagaattcttccaggatcacataaaacccagttaaatcctgcaccattttattgaagctaccattccggaaggacttcatcgcttgtggtcccagctcaggtttgacatctcgcaatccacgaatcttattcaccataaattcagtatagtcttcaccaagctgtgtcagtgacagaatctcctcaagatagagctcgacctccctggggtcaggcccttcattgccccctgcagcattggccacagaactcaccacagagaggaggttcttggtatatgagtttatatccgaggcaagacgtgcaagtttcctgtaatcagcatatcggcgcagtatctgtgtgccccgggaatcacactcctcctgcagctcaatgatggcataggcaacaccatcctcacctctgagttcacgaagcacagcatcattctcctcaacggccaggacaatgtccttgaagagacgggtaaggcagccaacaaaatcaggccgctctgaagtaggctgtgttgcagaggttaactcagctaggtgctcgaagtcggcacgagcgcgcagggcgacgaccttcttgaggtaggcgacatagacctgcaatccctcatcagcgagagcgaggagagggaagaggcggacgaggcggagaacggcgggatggttcagcgcgtccacagcatccgccagccttcggcgcgcgagcccctccagcctgcgcttgatgtccagaaggtcgcggcggaggtcgtcatcggtggggaaccgggcgtcgatggcgaggaagtcgtgcgcggcggtggcagcggccgtgagatcatccgccgccagagcacggcgtgcggcgtcgagcgcgcgggacctatcgagcgccgcctcggcgcgcgcgagggcggcctccgccctggagtgcgcggcgtcgaggtggcgcacgcgggaggagagcgcctcggccagcgcggcggtggaggaggaggagtccctgagcgcggcggcgtcggaggcggcgagcgagaggagcggcggggcggagcggagaagggaggcggcggcgcggtcgaggtcggggcggcgggcgaggagcgcgtcgaggcgggcgtcgagggcgcgctggtaggcgacgcactcgtggaggaggcgggtggcggcgccggcgtcggtgagggcgcggagggcgacgacggaggccgggtcgccgaagtcgagggacggggcggtgtcggtggaggcgtcggggggcagcgcggcatcggggcgtggggagcgcgggatgggcaaggggtaggacgccacagccatgccggccagccgcggcgccggggatcgccgagatctcggtgggtaattcgcgggatctgggtgctctcctctcggtgctctctactgtggcctgcctgtgggaggcctaggggggtagtttgccgggctgcgggtgaagggcatttctgcggggaaaattaatttgctttcgaatgtttcattgttaagcaaactgtttttatttaaatctaggttgcgagctattatattccacattgtgagagcatctctagcaggggtactaaacacagcccctaaagaaattttgagaggtaagacaaaaaaatttagatccaacaaagcccctactaaaggccctaaaataggaaggcctccaaattatcccctcaagcccccaggcctacgggccttctccctggcccctattccacgcgcgggagagaaatcccacagccgccgagccgcgcgctctttttttttcgcgcgaaaacttctgctagcgccgccgctaaatcctctcttccgcatgcgcaccgcctggatcagcgccgtcctctccaactggccaactccttcctcgccgcactcctccctggcggatcatctccctggccggcaacctcctccctggcggcctcctgccctaccggccacctccctgcccggcggcctcctccctggcgccctccctctcggctgccagcccgcccgacgccctcctccccggcagaccacctccacgtcctgcgcccttctccccgtccgacaatagtcgaaggtattttttttctttttccaattgatttatggatgcaattagataagacttgttctttggtgagatttagcttgccagggcgataaaatggatgtgtgtatttagaaatctatggttggagcaagtattttaatctgttcacttgttcagagataagcatgcaaaaatttatgttcttttcagatattagtaggggaaattaattggtgagaaagaatctggtggtgatcactttgttgtattttagtgatctaaaaaaaatcgataataccacaactcagtaggcagggggaatgataaattgggtcgagctaatatggttttgggcaaagctccttccctttctattactgaaaaaatgaatagttcttaatgcactctgtaaataaatagttcttccgtgcactgaaatatctagactacttacattgcacctgttctgcaacagtgcatatgcatgactttaagacactgtgccacctgaaatcttgtgatcgtattctagttatatgcaggttcttcgagcaggctgttacaaaaagagaaaaaaaaaagctgctctgggtgctatatggttttctttttaattcaattttgtagagctctaccataatctgttctaaattctaatgattggaaaaatttgctaccattatgcattctaccaacatatattagctagtatctgccatttttcctgagattgattagagaagttgttaatttatctacttattgcagtgactagattgtgatggcaagtgaatgtgattcctttgtgcgcacgatgtccgaagagacccatgttgaggcatattccttgccaatgcaaaatgaagaccttcatacttcaacaaatggtgcaaaaggaagagccaaaagatcaagcaactttaatcgtaaggaggacattcaactatgcatttcatggcaaagcattagctcggatcctattattggcaatgagcaaccagggaaggcatattggcaaaggattgcagagcactaccatgctaaccgtgattttgagtctgataggaatacattctctcttgagcaccgttggggtaacattcagaaggaagtaagcaagtttcagggctgctacgaacaaattgagcgtcgacatccaagtggcataccacatcaagagcttgtaagttaaattttttattcattattattaataacaatcttgtatgtatgtgaactagcacttgaattttgctataggttcttgaagccgaggcattgtactcatccaatgcaccaaagaatagggcatttcagtttaatcattgttggctcaagttgaggaattctccaaagtttcaaactctaaaatcccacaagaggccaaggtctaggaagtcttcgaccccaattgagagtgctggtgaagaagatgaagaaggtgatgatgctaggaagagtacaactcctgatttatcacagccaagtgctaaaaagagaccaatgggtaggaaggaagcaaaggagaagttgaagaatggaggagaagatggaccatacaaggaggcgatgaaagatttgcttgacgccaaagagaaagaagctaaagtgaaagaagagagatggaaggaaactaaggagattcaagagcacaagctcttatttgctgagcgtaagttagtgtgggatcaagaacagaagatcatgttttgtgatgtttccaccttggaaccagatgtgagaacatatgtgttggctatgagggcacaaattgcagcttcaaaggtggctgccctcaatggtggatttgatggtagtagtggctttggaggtgagtttggtggtggtaattgagaagtttgagcacttcgatggaataagttggatcatattggatgatccacatgtcctttgctagtaggatatgtcatttccacgattggttcttggagtccttttgtgttaatttttgcaattatctaagtgtcatttgctagtaggatatatattacttttagatttgttatttttatgatcgaaccattcattctttcttgtaggatgtgttatttttaaattatataatgcatctccgcaaaataaaaataatgcatcactgggttcacatagcatattgtggtgatatggagacagacaatgacatgttggtgagcaatttttgttttcattggtgaattataaatcttggttgcgtgttgttgtatatggcattgtgcctacaccatatttacatgtttgaaaattttgattttcgatttgaattgtggtgtttgaaattgtaaatttaactatggttaaattatgcgcgttagaaatatttatgtttaattattgtggtgttaaacatagtgtaaaaagggattgcatgctaaaataaaagagaaacaatagtaggggctaagaaataggggctattgctagagttggaggtattttttgggtccttgggagatgggggcagccctcatttaacttttaggggctttaaaataaggcctattgctggagatgctctaatgttatgaatatagaactaaccatctacgactccctgttaggatgtatgagtaatttttaaggcctcctttaaattatatgaataaagaaagcaaagaaatagaaaaaacgcagtattctaactagaatagaagtgttaaactgatgattgcaaaacatataaaaacacaggaatgaccgcttgattggaccgtaggaaaaacataagaatcggatgagagagatacactcaaagtaaattttccaagagctttgagctcttgctgagtttctttcaaaatctctataggattattcattccataggaatttcaaatgattagaaatgattcaatccgttaattaaaaggcatttatagaaatttttcctatagaattgaaatcatcccaaaattcctatatatttcctccaaatcaaagggaccctaagtgagtaccatttacaaccaactccctctatttcatattataagtcgtttgacctttttcttagtcaaaattctttagctttgaccaaatttataggaaacaaattagcaacatccacgacatgaaattaattttattaaatttaatattaaatatattttgataatatgtttgttttgtattggaaatattagtatgtttttctacaaacttggttaaactttaagaagtttgactaagaataaaatcaaacggcttataatacgaaacgaagggggtactcaaataaaaacagtttgcttaacacttactccctccatcccataaaaaccaacctataattgaatgggacattattgacggttattaagtactagtttcaaccgccaactagcacaactaataaagggaaccttagggcctgtttgggggagcttcttgctgctgcaacttctatcaaaatcagaagctcccccaaacagtccagcttttggtccagattctgagaagctgtagttgtagaatctagaaaatgaactagaatccagaagctggaaaatccagcttttccaaattctcagaagctgactaccaaccagctgcttctcagaatcttaagctcccccaaataggcccttagcatgtcttacacgcataccaataataaataatgtagttgtattaggattggaaaattaatgtggatgcatgaattatacgccaaagtgaaggagaaattaagccggcatgcaaagaaaaacacctccagtgaatcacgtgcaaccacacggatttaggggccctcaagtcagctcaaaccgactcaaagtgggaccaaacacccgggtaccttcataggggcccacatgtcagtccctcaccaaagttggtgagcagagtggttgaatgggttcggccgaaccaatcttggtgcacctgacacccatcttccacgtggcgactcctcagcgctccccaatgacggttatgcgcagttagcggcccctaactgccatacaaccgtcattacaaggctataaatagagcttctctccctcacatgcaacacacacctcatggagcaattcactctttcgctttatattctctatagtttttagtaggaattaagcttaggagtttcgatcctatagtcttcttggagttctggatatgtctctagtactctcttctttgtgtaagattatagtcgaattaatagtattatattctttatttatatatgctcatattttattttatataattctttattgagtatatttcctatgagtagtatatactttgtatatttgtttcatcctaggctagttgatccatgctaaagtaacggtccaatgaccttcataggttgctctagctctaacttgttcatcccctagggaagatagtgatattgtttactagcataaacgtggtgtttaggctagataaatatcgttggatgtgggtgtatcccacggaaagtgaggtaggcggcaagtggtgatagccatgtccatcctttgtattcctccatgttcgggtatgacataagagtgcataaatgccataactacgttggcaaactagcagtgagtggtttctctatagtacctgggcgcctggaactatatcctacattgtaagtatgtatatgttaagtatatgcgacacgattagttttgaagtacaattgtatcgtaatatccttaggctattcctactagacaatctttagagatgaatctcttgtgtgtgtacctatcaaaccttatcataacccctgtctagattgcagaaatataaatacaatacccttgggaatactcatgggtgaaatgctacaacgatatctgtgcacttgcggatttatctgtgataataagaaatatcaatagacatatctagtacaacggatatggacatactcctgtccagattcgctgtactaaatatgtcccatccaatactaggttggtttttttatgggatggagggagtatattaatttgtagtggtatacccacaaagtaaaatttataactctaacatgtaatatattatagtacgctacttgcacatgaattataacacaagttagataacataatctaatcttaggatgtgtttggttggaaggatataattaaataaaaatgtccatgcaacttttatatgtgtttggtaagagtgaatgggatggtcaggagagctaaagagctaaaattggattattctatgaagatgttggaattcattcgataaaattgactcgatatccacgtcctagggtctgtttggcacagctccagctctacctctcctagatcccagccaaacagtttcaactccacctaaaatgggagcggagctaggtggagcgctctcataaaatgaggctgttatacaactccaccctagacttaactcctgaaactaaatttaggagttagagttctaccaacaggcccctaattttgattattaataatggggcaattgcaaatttaccactactttgaatcattattgcaaaactgccactagaaaattgcaaaaatgccactagaactgtcattcgagtggtatccttgcaatattcaaaaaaccggtggcaaatttgcaaatgccccattaataattgattaataataagtattacatgttgttagttaataattaacttgtgaaaattaatgtcgattagacataattagtcaattttattattaactagtatagattatggcaagaataattataattaacatagaataattagtagtttatgttttcattcaatccgtcctcttctaaaaaaatgaatggccatatccaccctatcaaaagaaaaaaaagattactatatcccttataatatggatgcccatatcctatctacaatcttgatcatgaaccaaagacacccttttatactctttgcatttcaaaatatggttctctaatgtttgttgcaagaaatagatatgtaaattttgtgaacaatgttactatcactttgtcggatgaagaaatgaccaaaataaaagttgtatgtcttgatgagttctacagcttttatgttcatgactttttcagctaaaattatttactacaaaatatcatttgaagttttgaaattcaaattttagttgataaaacaaattcacaagaaaaaatgaccaaaataatagcagaaaaaacacaataaaatgatagagcatgattttagaaacatttaggaaaaagaatcatccaatttagagttcatatgagtgagataaactaatttcaaattttaaaattttattttcgcatacggctccttaatacacccgtatggaaaaattgatttttctatgtgggctcttaagtggtccgcatgcaaaaatgagcttattttggcgtcttaaggagtcgtatgcgaaaacaccgacgcagcaagttgtggtccgtttgcaaaaatcatagggtctcatacacaaaaatcttttgtgtagtagtgatgggtttttatattccgattaatattcatcaccgtattcgtttcgcttattcgcttcgtatttctattcgataatattcgatttcgttttcatatccgggttttcgattccgaaaaaaattatgaaaacgagtatggtaaagctagtttttgaccgtattcaatccattttcatccctatatattatgttatattattacttgcatgtggcagcccttagtttagttgagtttgtttcctctttttgcagcaattcaatttagaaactcctgtcttttagtcaagccacatacgcgtaaagcaaatcctaaactccctcctatcctaccaaaactttagtttcatgcttcgcactaacatgatatcattttttgaacttatctgacatgacaacaatatttccatcactcttactgtaggctaacaaaaaatgcactttacaaagtttaaaaagggatatctatgtattggacaacccaccaaccacataaaaccaaattaaagatgctccacatgtactttattgcatcatcttgctaaaagaaatagatatacctcatgactctaattaaacacgtcattctgcatagatagataaggtaatattttccttttttatatattctcctttgttttgggtatataaaccctcctcctcctacatagctagtcatcagtagagagaagctagcaggtgactaccatggcatccatgtctaccattgtaccactatgtctaagcctcctcctcttctttcaagtatcgatcgcacaattttcatttggtggaggcccactatatagctcacgtgggtttaggggtgactcagtgagccaacaccaatgtcgttttgagcatctcgccgctctaaaggtgactcaccgagacagatctgaagccgactttattgagtactacaacaccgaggtacgcaacgagttccgttgtgctggagtgagtgtgaggcgcttggtcattgagagtaggggcttggctctgcctgtgtatgccaatgctcacaagcttctctacatcatccaaggtctgtataccatagtccaacatattatgtatgtacacacgactagttgttttcgaactacattattgttcacaacatgtgaggttttttaattgtgtgagtacatgttgtaggtcatggagtgtttgggatggcactaccaggctgcccggagacatttcaatcggtgcagtatgcatttgagcagtctagcacccaaaaattgagcgatgagcaccagcagcttcacaagttccgccaaggggatgtcattgcagtgccagctggagtggcccattggttgtacaacaacggtgattctcctatggttgcttttttggtcatcgactttggaaacaatgctaaccagcttgatccaataccaagggtatgcccatatatacatctcacaagcataattaatactattccatatttctaactttagtttaatgagtggtaccactaatacatattatataatgcaactcaatatattgagtaggaatttttcttggccggaaagcctacgagctggcagcaagagcagtattcgtaccaggctgaacaacaaagcgacaatcaaaacatctttgctggattcaatccagatttacttggtgaggccctaggcgtgagtaggcaaaccgccatgaggctccaagaactgaatgaccaaagaggggtgattatcagagttgcgcaaggtctccaagcactacatccttctttccaaactgagcaggtccaagaggaacagtcccaagaacagcaacagcaaccaacctggtcaggcagaggttgtgcgcaaaacaatggtctagacgagattatgtgtgcttttaagctgagcaagaacatcaataatgcacaatccaccgacatcttcaacccccgcggtggaaggatcacaagggccaatagctagaattttccagttctcaacatcatccagatgagtgccacaagaactgtgctccagagtgtgagtataaaccatgacaaagttaataagatttttatgcacaaaataatgtaggcatagtacttattgcactgatctattttcctcttctttgtagaatgctttgctcactccacattggacagtgaacgcgcatatagtgatgtatgtgactgctggtcaagggcgcatccaggtggttgatcaccgtggtaggactgtctttgatggtgagcttcgccaacaacaaatcctgctaatcccacagaactttgcagttgcagtgaaggcacgccaggaaggattttcctgggtgtccttcaagactagccacaatgccatagacagtcagatcgctggaaagagatccattcttcgtgctttgccagttgatgtggtcgctaaagcctacctactttcaagggaggagtctaggagcttgaagttcaatcgtggtgatgagatggctgtcttttcaccaaggcttcaccaacaattgtacgctgagtggcagaacagcaaataattaaccaaatatgtattctatcctatgttagtgatttgaataaagtaaaggagggatcaacacctctttttcaataaaaaaatatcaaccaagaatcggaaagaattttatagtgtaattgcgtttttaatctaggacctcttgagaactcaacagcaactagcaatcttaacccttagattatccgggagtcgccaccaccactatgaaatttgtagactcgccaccaccactatgaaatttgtaagtagtagagaaatggaaatgggatcagatgctgaattgaggaaaccccacgaacgccacgaaatcagtaatcaacgctccaactcagttcttgctccaattccctcttttgtgcaaaagctccaacttatccggactagtcaacagttttacctgaggctgagggagataaacgttcaaatgttatacagaggctgactgcattactcgagagatgcatttaaagaatcacttagcaccaccaaaatttatatttagtcttatctgtgagggactaaacagagttcaaaacaagtgagtccagcaggttatatacactcatcttcagaaagaactaaccaaaattcgtataaaatggtaatgaattagtcttgaaatattatgttagcatcagttgcaatggcagatcgacggagtttgacatccacaaacattttagcacggctataaaaatatgttatccagcttggccactacgcccaatggatggttaacacttctcaaagctgggattgcaagaacatggctccataacaaagctcattaaccccacagaaagaaagctcaccaaggaaccttctatttgtcctgaaaagacaaacgtcgcagtgtaaatacaagataatgaaaaaacggcagacactacattttagccatatgtacttacagaccaccaagagcaccttgaatctgttgtgttaaaattagaccacctagagaaccttgaatctgttgtgttcaaatttgtgattttcattgtaagctatactcagtgcacagctctaaaagtgtatttgcaatctagaattgggttgtacaggtaccactggtgcaatcttcttatgatgattgaactccaaattacaacccacaacagaactcagcaaaatgttttcatttactcacctcaagctctggaaggtctaaacattaaatgttgagctcccagcaggtggaacagcaacaacttttcctacagcaactgtcttacctgcaacaatttaagataaaacgtgcttcatggagtcggaatatattgaacttactaagacggagagaaacaacaacatactttatggtcggattacttggacttggtgaaaaaacatgcatagaaaacctaagtacaactttcaatagggtgaaaagcagccaaagagaaggaaacagagtatttgatgactgcttggtgcttgcccattttgcctgactagctatggttaaattttgcagccaactgcacttgcattaccttaaagtaatatattattgaatttgcgagaaataaactaacagagattctgattatatagaattagtgaatgatattaaataggttcatttaaatgagcattagataccttaggaaaaataataacagcagaaagagtatatcatcacaatccttcttataataatttcgataggcaaacacactcaaaatcatgacttatctgtgtccgattagacgtaattcctatgttatataattttaatgtcacatttagaaaagaagacttggtgctacaggtaaaaataaaaacatctttggtacatcagtgttgcatgatttaaacagagccaaacattgatttcagaaaaggatgtatatccttgccttcagtccggagcgtaaatcttccaagctgaggaaactcagagaagttctcgatacaaatcaaattattgacctaatataaaacagaggtgattagaaaatgtagccctcagactttaatgccagagcgatggatccatatggtatctgagcagttcactgaggaagtttcaaggataacctgaacacggcaaacgacgacagctccattcttcacaaaaagaggtttcctctttgacttctttttttttatgtcaccttctttcctcctcttcaaatcaatttcttctatgagttcaacaatctcacattcctcaactacagagtggatatgcagcactgccttgtaaccagcagtaaaaattgcctagtacatcaaacatcacattcataagaaattcgaatacacaagaagtcagtccagagttaagacaccctggatttggaatttaaaaagaacaagaaggctcataagacccttgcaatattttttgtagtaattatattaatgctatctagatgttcaaatatcaaagaaacttcatctggtataaaccgttccgaacgggagtgattattgaattactaatatccatgtgacaataatttcaatctaaataattttggtttctgagctcccaaaacaaaattaaccaaataggagacataaactggagtttatttaccaaataatatcagtcagttaacctgatgcattgaccaaataattgtggcttactccaatgtatattgatcaatatactaaaatttgtaaacttgaatccactgtggaatatacagtatagaacatacacataatgcaggaaaatttgtaaaactattggtttcggaaaaaggaaatcatgtataatcatattgagccctatcagttgataaaataggatgaactaacagtctaaaaagatgtcttaacttataacagggctatgaagtaagaaatattttaaattctcatgttttatttttcacttaaaactataagccaaaaaatgccattccataaaagtacagtttttattttatttttttacaaattgtcaacatccaaaacaaaaatatctatatccatgtccaacacattcccaaattcatgctcgaaagaccagatcaccagttctagtattttatactttccttttccaaacatatgttttcgtaaataaactatgcaggacaaagaaaatcagctgtgattctatctaagagaagattgcaaactaagcaaggcactcctggcaaatcatagtaggccttgcaggaaccagcattcaaaccaaggtattgaacacagagaactaacaaatgtcaagtgagaatagtcaagcatgaaatatcctatgctatcgtctgtaagtgttacttacattgtcaagcaactccaatatctgtagttgagcacgaaattcagatatagcactaacaggattttctgcaagaacaacgttgccaagaatcagtatactgaaaaacaacttccagtgcttgaaaaatgtccaaggtaaacaaacacctagaccatagtcaccagttcatgaatagctaattatttcagaaagctcaacagtaaacatgtgcagaaaataatccacccagggactgtttgcaaaccagctcttttttttttctgagctaggctcaaaaaaggcacttcggtgggatagtaaaccactaaatttagccaggtttgagcagatccaaccagaaaaaaaaatctggtccagacacaagtttaaaattctccagaggcacatctcgtctgcacattggttaattaaacccttctacgtacatttgggtgaataaaaactgctatatcaccatgtaagaaaatgcaattttttataaataatgtaatcttccatggtaaaaacttagtaagaataaaataaatggtaaaatgaatgaagaatttcctctacttttctgcttcaggaaacaaacaaaaaggcatcatcaaagtatcaaacaaacaaaagaattcaaagacaaatggagcacggatagacaggatccctttcaacttgcaaaaatagtgatatatcctagaacctaaatgcatcacttttaactagagcaatatataatcaagtgttcagaatgcacaaagttcagccagaatcagtaccacttatcaaggagagtactaaagaaagcagcaccaacaaagtaattatcttgctgctcccgactacttggaaaagacacttactaatgcttgatagcacaaaaccagcagtgatgtcatcctcttcaattcctgacagtttgactcggacattctcaccaggtgcagcacttctcactctatcttcatcacagtgtacactaatgactttcacgttggcctgtgagcaaaatagaatgtgcaccaagatcagatttataattccagcaaaagctgatgcacttgctacttgaaaacatcaacaataaaagatgttaccttgtttggcataaccaacatgttatcaccctccgagatagttcctgattcaatttttcccatgaccactgtgcccatgtctttgtatttatcaatgattggcatcctgcatatatatgtgccttactgttattagttaaactatccatcataattattcaagtaagaaaatgcaatctgaacagaaaggaaataaaagtttttctcctaaagaaatgccatttcatcttatgaaaccaaggttcggtaagtaccacctgacatgaacaggggttttcttagtccatttaaattgtacttgacaagctaagaaacctggtcgtctaaccttactggaccttttggatctcgtaaagggacttgaatgcaatctagaacttcgaaaagacatggaccactccaccagctacaattgcttttatccattcttgtcttcatattagtccccaaaagaccagagattggcaagaagtggacatctgaaaagaatgccagaaaaagcaaggtaaaagtaatgtattgtggataattccatcattatcataaccacagatcatcacatcattgttattaccacactcagttgagcaagggctccattcaacaagtgctggatataatatatgacgctatgtcaacacccaaaagccaatctctaactagtaaccacacgaataccaaaaagcttattttgtttggacaaagaaaacatatgagtttcttttgattattatatgtaacatttgcaggacacaggaaacatcataaaaagcatatcatatactccaaatgtatccaaaaatagtgcttcgtgaataaactcccagcatttttagtataattagggctaaattaggaacaatcacaaagctaaacaatctaaaccaggaagtcaccaaataatgggaaggaaaactatggaatgttacttactaaactttttgcagatggcataataggcaacaataaagaataatattcctgtcttagaaggaaataaccatgtagatgaaagatgtcttaccatgcttagaaaaagaagatgtgaagcttcaactttgtgataagctaaggcatcaaagatttaacaagcaatgaagcaaaccacaacagaactgtctaataccccatcctatttgatcttttgatttctacaaaactagccaaatacccatgcgcttcaatgtctacaatgtgttccatagattctaaacttggaaaatgtatatatttttcatttgaacatcaatcactaaataattctattacaaatgacatgcgcaaagacataacttttcagagaagattcttggattaataaagcataggtgcagcgcggaccgtggatggtagactcatgaccaccactaacttctttcataatagaatagaaatttcaaattaaattgagaaaaatgaacagattttgtgaagagatatctccaacctaaaattaacgcatagagaaaagagtgaaagatgatcccattcataattatatacctttcttaacattgtaccctgatgatttaagaaaaggaaccatttttccttctatttcatcatatctgaaaccacataagtgaaataatgatttttctttacccaacatgcttatttaagaggaacaaattcttctcagtggatttgttatcaatgtatataccgttctttcgaccagccaacagtagattcatccatcttatttatgaccacaaccaacttagaaacacccaaagtttttgccagaagcacatgttcgcgagtctgcccgcctctttcatacccagtttcaaattcacctttccgagcagatatcacctgagggaaacaatgatacattcatattatatcccagcagaaaagacggtaaatatgatttcgaaagattgcgccactgcttacaagaacaccaatgtctgcttgagatgcaccgcttatcatgtttggaacataacttttgtggccctgtatgtcagaaatatattgaatacaacattatataaaagaacacagaaaccattataaaatggatcaaataatcatcagaaagtagcatgtcttgtaataaggtgtaatgacttggttagcaaaaacaccctgaattgttgctactttgctacacaaaggtgacactcaaaaatgagctgtacaagcatgaatgaagacatagtttcagtcaaacaaacagagcaacaaacacatacaatccctataaatcaatcctaagaccagtttgagacggacgtaaggtaccaaggcagttgttgcttccacatgaacgattccaattatttcaaaagggggaaaggaaatacatcaccattttatgtttaagtcttctgcttatctaagttttacgttcaagttatttaaatgtatgaaactatcttaaaatatgatagaatcacaacagttgctccataaagcaacacaaaatctgtttcaaaatattgaaatataaaactatgaccttgcattactatggtatatgtaaataagtacagtatatgaggcaaaaaaaaaatttaccggtgcatctaaaatggtaaatcttgtagtttctgtctcaaagtgtgctctcccaacttcaactgtcttcccctgaatagattcaaaataacacattgtaagtacaataagtgatatttgacagaattattcaagccacgacaaaaatcaaatttcatgaattagaagtatgatgacctagaagcaggattggagctggagtatccatagacaccatttaaactttgttggattcggaaatgtttggattttagttatgtaacaggcaggccatgaccattgatttgcatggttcatattactggtctatccaatgatccaagaaaaacaggtgcaatgatgttacccaataatccaaacccaaccatcagaatataagcaagcagatggcagcaaactcttgaaggcagtagagagatgaccacacaagtaatctcaagatatcacatgctcatcactgtcgaaacaggatgtgggagtggccatcaaggatcatcagtactggaactagaacaaaccttaggttccattttgatggataagtctttgtggtccttggtcatggttctttattttgcttttgggtagtttcacctttttcaggacagcatcactccttaagcatattttcagttgctaggacagctgcagttagtaggacagcagcagttagcatctcctttatatctcctttatgctttattaagtttggatgccctctaggacagcatcccattcaaattttgaattttagactaggagggtgcagcaataggcttgcagccagctatggctatatatatgtatccaacctccctcgggttggtatggctttgagtttgcgaatggaagaaaactagaaaaattgccccatcttgagtgccatcctcttatcaatgagagtaaccattgaaattctaacatctggtatcagagccacactttcctgtaggctaaacatctactgttccaccccttcccaagctcggttgagctctcagccagcagcagcagcagcaccggctgctcttccttcccctttcccttccccctctccacgcagcagccccccggaggcgcgccatgtccgatgttcggtctcggcgttcggtcgcctcgagcactcggcgtaagcaggacgccaagctcgccgcagcagaagagcacaggcgagcaacggctcagaccgctgcagcagcagcgagggcggccagactggcggcagtggagttggcagcagccagggcagaggcggaagcagaggcggcggaagatgcggcacgtgcggcggaggtagaggttgagaccttgcgcagcaacatcaacggctccatcggcgacatcaccgccgacagggagcttgaggagctagcaagagggagggcgcgggagcgggcagagcgtgctgcccacccccacggcggcggcggcccaagggaccgcgcgcccgccgatgggaacccagacgggcacgggtgtgccggcggcagcccggagcgcgcgcgcggcggcggcgctccgagtggaggtggctggttcgacagagagcgtggccctcgcaggcagcgcggctctccctcccctgaccggcgccatggccaccacggcgtccagacggtggtcagggactttggtcccggcggttggtggcctaccctcaccaaaaccaactatatcgagtgggccgcggtgatgagggtgaggctccaggtgcggcacatgtgggaggcagtccggtacggcgacgtcgactacgacgagaatcgacgggcgctggatgcccccatcgctgcagtcccgcccgagatgcagttctcgctttcccaaaagcggactgccaaggaggcctggcaagtccacactgcaggcactccgcaaggagtgggagaacctggctttcaagccaggtgaggatgttgatgactttgccctccgtcgcaacactcttttgcagaagatggtgcagtacggcgacaacctatgatgaggagagagccgtcgagaagctgttccgctgcgtcccagagaagtatgggcagatcgctcgctcgatcgagtctctgctggatctctccacgatgtcgatcaaggaggcgataggtcgcctcaaggtcatcgacggccatgagccacagcctctctcggggcctatcaccattggcgggaagctccatctcactcggga

SEQ ID NO: 79287 - DNA, 14327 bp, Oryza sativa
aatatatgtgccccccctaattttataatgtcaacagcattaataaaattatacaagcaacttagggcgatatagtaataccggccattgcacatcggtaaaccataaccgattacaattggaaaaaaaaaactaagggcgatataacaatatcggccatctctaggcgatgaaaattcatcggctatcatgtatcggcaacatcagccgatcatgcattaacccaaacacttaggtaatatttcttcaaatacttgccatttagtaattccgttcttctagagccgattctaacctcccatggcaaaatagcctcatgtccataaacaagcttatagggagggacttggatcgatccatgacacgccatccgataagaccacaatgcttcgtccaaccgagtatgccattgccgaggataatcagaattttttctcttaatcaatttgattaagctcttgttagatgcctcggcttgcccattagcttgtgcataatatggtgaagaattcaacaatttgatacccatgctatcgacaaactgaacaaactcatcggacacgaaaattgaaccttgatcggttgtaatagtttgaggaataccaaaccgatagattatatgttcttgaacaaattgaatgcatccccagaatcaactttttcaaaggaatcgcttctaccaatttggtgaaataatcagtcgccaccaatataaacttatgtcctttactcgatggtcgacttatcataccgatcatatcaattccccaacctctgaatggccatggcttaataataggattcatagccgacgccggcgctcgctgaattgctccaaacttctgacaatcttgacaccctttataatatttgaaacaatcttccagcattgtcggccaaaaataccttgcacgccgaagtaaccacttcatcttatgagccgattgatgagtaccacaaattccttcatgaacttcgccgattgcaactttagcctgatcggcactcaaacacttaagtaacactccatcaatcgtccgatagtaaagctcatcatccaatagagtatacttcaacgccttatatctcaatttcctagaagctgattgagatggattatgtaaatattgatgcacatcatacctccaatcaccggctgttattgctgcaatttcagccttaacatctttgatcatcggcttataccccgatgccccctgggccaaatcattagcttcaatattttgttctcgagacacatgctttaaagtaaccagccgaaattcctgcatcagttcttggcacttctcattataaaccattaatgtatcactcttgcattcatattcccctgccaattgactgattaccagcaaagaatcccccatgatttcaatagcatcggcttcaacttccttgagtaattgcaaccctttgagcactgcctcatactcagcttgattattagtcgcataaggttttatagtataagcaaacttgaaacatgccccccgaggggaaattataaccaagcctataccacaatcatgagtacacaccgatccatcaaagaatgaagtccatggcacaacttcaaccgagccgattgaatcatcacaatgttccacaataaaatcggctatagcttgtcccttaatagccttcggcgactcataccttagatcaaactcagttaaggaaaatatccactttccaacccttccttttaaaatcggagccgataacatgtatttgataacatcggctttgcatatgacagtacactcgttagatagtagataatggctcaaccttgtacatgaaaaatacaaacacaagcacaacttctccataggggaatatctagtttcaacatccaagagccgacgactgagataaaatacaacgcgctcttttccatccaactcctgaatcaagactgagccgattgacttctcaccggccgatagatataatctgaaagatatccctttctgtggaggaatcaaaacaggaggagagctaagatattctttaatatcatccaaagccttctgttgctctgccccccaagtaaactgctgatcagcttttaatctcaacaatggtgtaaaaggctctaaccttccagacagataagaaataaatcttctaacaaaatttatcttgccgttcatctcttgtagttctgtcttgttctccggaggctgaatcttcttgattgcattaacactcctttgagtcacctcaatccccctctcatgaacaagaaatcccaaaaactggccaaccgatacaccaaaagcacattttgtcggattcatcttcaggccatattttctggttctctcgaaaaccttcctcaaatcggctatatggtcctctatttctttagacttaacaaccacatcatcaatgtagacttcaaccaaccagccgattagatcatgatatatgtaattcatggctctttgatatgtagctccagcactcttcaagccgaaagtcatcacaacccattcaaataagccgattgcaccaggacatctaaaagctgtcttatgtatatcttcttcggccataaagatttgattatatcctacgtttccatccatataactcaaaattttgttccctgacgcagcatcaaccagctgatcggctactggcattgggtattcatccttcggggtagctttattcaagtctcagaaatcaatgcacaccctgaccttaccattcttcttaataacaggaactatactagaaacccattcagcatatcggcaaggacgaataaaacaagcatcatataatcgtttaatttcaactttgacaggttcaagcatatcggctttgcatcttctcagaggttgctggtgtggtctaacccctggtttgataggtagccgatgttctacaatcgatcggctgagtccaggcatctcataatactcccaagcgaagcaatctctgaattctttcaacagctctatcaacttggctctaaattctgtagataaattcttacaaataaatgtcggccttggtcgatcacctggacctatatcaatttcttccaaatcatcggccgatataaaaccctgtccttgtttgtcatcgagatcatctaccgtgtccttgatgtagacatttgaaccctccacaacgccctcgaaataacagcttgggttctccatcttcaattggctgtatattagaatcggacacttttagaaaatctctatcccaaacttttccagataaacaatcgagaccatccatctcccaaagagctaaatcagcactagcaacattgactgacctgtcggctggcacaatctcaatcttgtcgtcttgccactgaatcaagcattgatgcatggttgaaggaatgcaacaattagcatgaatccaatcccttccaagcaacaagctataagaaccattcccatcgatgacaaagaatgttgtagggatagttttgttaccaactgtcagttccacattcgaaactcctttggtttctgatagattgccgccaaagtctatgagcaccatgtttgtcttgatgagatcttcaacgtttctgcccaactttctgaatgtagcataaggcatcaagttaacttcagccccaccgtcgaccatcatcttggacattggcttcccattgacataaccatttatatacaatggcttaagatgccgattctccgtcccctctggcttctcaaaaattgcctgctctggcaacaaaatcaatttggctgattcttcttcaacttcatcgacatcggcttgcttggtcccaatctcagcaggcaacgtgaaaaccatgttgaccgaagcagttacgacacttttccccttagctaacctttttgcctcctcagctgtagcttcatcggctacaggaacctgattcttaacacgccactcctgcctcgactttgttttctgcagccgatggttaatttcctgttcaacctcctaaaagcactccctgttcctcaatctttgaacccttctcttttgattcttcgtgaaaataccagaaggacaccactgatttttcctgatttcattgtcctcttggccatgatcttgattcactggacccaatctttgatgaacaggaactcttgtctgccttagccgattgcccctaccatatgatcggcttgaattcttggcaatatcactgcacccaggacagtcttcaatagacggcagccttagaccttcatttcaacaaaatctaaagaactcacaacctcaatgaggatcaaaaccatcgtcatcttcttcatgatgcttctcctgctgcttgtcatacttcctctgatatttgttgataatcttagccgaattcacctgaaaaccccttgcacggcccctatcggctgttcggccagctgtatgcaccatattaacaggaaaaggattgccatcaaccttcatcagcctcttagagtcgtcaaacttgattttgcctccctcaatagccgcttggatctgctgcctgaagaccttgcaatcattagtcgtatgagatccagaattatgccacttgcaatatcttttcttccctaattcttcagccgatggaattgtgtgaccggcaggaagttgaatctgtttctctcggagtagcaagtcgaaaatcttatcagccttggatatatcaaagtcatacctttcctctttacctgagttctttacccattggcatggtataaccttcttactccttacccactcggctgcagctatctcagaatcatcatcttcatcatccgatccatatttataagggcaaacatgattaaccttcctagaatttttcctagcctctgcatacctttgttcatgcaaggctaccttctgtgtaagatgtgacaggctttcaaagtcttcagatgataacttctccctaattggagcaatcataccctgaaaagccaaatcggctaactgggcgtcagttaaactcaagctgtaacacttatttctcatctccctaaatctctggatatactcatgtactggctcatcatgcttttgcttgattgacgtcagatcggacagtttcatctcatgaatcccactatagaaatagctatgaaactgcttttctaaatcagcccaactgttaattgatccatatggtaaagaagaaaaccaagtaaaggttgacccagctaaagacaaccggaataacctaactttcaaagcatccacagccgatgcttcaccacattgagctaaaaatcggctaatgtgctcataagttgatgtactatcttgccatgagaactttgaaaaatctggaactttgaaccggttgggcaaaggaactctctcaaaccacttaggatatggctgccgatatagatttccagcatctttcggcctaagcctgaactgctccttcatgacatctgcaatcaaatcggcccatggccactattgaggtgtcccttgaggttgttgtggcatcggctcgaattggttgtattgaagaacaaattggggctgagccgatcctgcttgctggtattgaacatgaggtgatggtggctgatattgataattcaaattgccccctggtaattttgaagatccggctgaatattacgcaccaaatgttcaggaataactagcggaattaccgtgccatctggttgtacgtgatgtactaaatgctctgggacaacctaatttgtagcatgttgcacaggctgcccaccaggtgttgcaaaccctgccgatgaattcattgaaccttgctgttgaatcggctggacaacctgttgccttaatggagtttgctgaaccggtcgtacaactcattgagctaggggtgtttgctgcactggttgcacaatttgttggatttggggtgtttgctgaatcggctgttgcgggttggatcaacagtgttttggggaggcaaaaacatagatgcaacctggtcttgtgttagccgatccacattttgtccagcgtgttgtggctgttctcttatcagcaatcggggattgaccaattggcctggagccgaaggtggtacagtaggtgcgggagccgatgctggtgccatcggctgagccgatggtgcaataaaaggagctgcttgaacggatggatgactgttggtgatcaaaggccgataatttggaaatactcctccttgcaaataaactgggcctgcagcttggtattcagctattgtaccatcgaccattgacttcatcatatttgacaatgtattgactaacatcccagattgattgatcaaagcattgtgcacggcatagtcaacccgatcttggaagttattgaaaaactcctatgatgcattgccatcctgataaaaatttcctccacgcaacccctaagcaacatcaccttgaactccatgcaccccatcaccttgaaccccatggactccttgagaattgtcacgttgacctcctagagaaccgtctgtagcaccattgtcactcggttgagccataccgtccggagcttgtttaccatcttcacctttagaagaactggtcccaggatcatcggcaactacctttactttatacttctgaaccactgttcccttgctagtctgcatgaatgagttcaagaattgatcccgtgcctgctgcatcatcgcgtcgaaatctttcttctgatcaggtgtgaatttttctggatcgatgggcacgacgtttccttcattgacgtcggtcaatcccaacttctggatcttttccttaacagtgcttggactagccgaggatggcgatagcggtggtttctcggccatgaggaagaattgcttgctgacttcttcttggtcccactgggcatgccaaaagcgtgttgacgtaaaacacgaggcctgcgagatctgcttaactccagtgcaggtccaaagctcgccttcgggtatgttagcgtgccagttgatttgatcctgcaatcaacaagaaatagagacaaagaaaccgcggttaaacctataaatgatagacgatcggctaagtgccgatgacatatcatttatctttgagccgatgtcatatgtaaatctatcggcggttataaatagataataaagaactaaacctactcgatcgactgtagatatcaacaatatataattttatatcgatatatacataaatcgagtgattgggatagatcggtcgccatgccaagacagtataaatcacttagattgaaatatatattaataacagaactatatatgtttatagcatagccgatcggatagatctagcatgtatcggctaatactccaatacaacactatgttaagatgttgaaacaaacagaatataccaaacataagcttaatatacttagatgcaataatatcctgacataaagggcagatttaacatgtcaatgaaacatataaagcaaatataattaaatcagataagatcagctgaaactccgatactaccctaattggcaaccagaaggcaggctagatattgatattctaagcatgacttaatagatcaaactcaactgatacagcattacgtatgaaaagaagaacaatatctagacaatcaagtcgctggaagtttcatatagtggtgggtatcttatataatctaaaccaacatcgatatttaacctaatcggctgccctctattaacagatgttagccgattgtaggctagatggcgatatcgttagagattatgtaagatatatgataactcggcaaattacataaacaaaattagagtatcataaagatggaaggactaatcccgagaacacaagccgacataacaagttttacctcttgttgaagatcgaaaccgatgcaactcaacccgaaagcaagaaatcatcgaaataaaactaaagcaaaaagggtggcgatgcgccgaaattgtattgaacgtgtgtgttaaaaattacatagggctcggggtctatttatacccgagaattacaagatatgtccataccggacacgactattatctctaacaaactctaagataccataagtctttgtggcagacttttgcccatatttatctctaagaaatttacataaaatatcctaattaatagatacaattgccttcccaggactttatccatgtatggcaatcatcttgaagtacgtcaactcaaacccgatatcgaatacaagtcgtattgtcagaatcggctgcatcacttaacccagtcttactcggacttaaccgattctaatcgtagccgatctaggctccagccgattcttgctctattctcgaatcgatctccgccttcggctccacttcgatctaatcctcttttccgatgctgatattactaaatttggtcgttaacagctttgtccaagccatccactctctcttgaagttgagcatttgccacctcaagattagcgtgagactctttggtttgcttgtaaagccgtaccaaagcctcatttttctctctccttagcaagctcacccttgagttcatgagaccgctctttctcacgaatgagtaatgcctcttgcctcctctcaagggttgcatactgatcatcaattctcccaagcaactcactcaagtgtggtagagactccttggttatggacttgaacaattcctcatccataacctcatcctcaacatcatcctcctcatcacaaacaagatcaacattgattgacttgagggaggaaggtaccttaggctcttttgccatgaggcaaatgggagcatcctcatcacttgagtagttgaagagtcttggtggtgatgaaggcttgacggcaaacgtggcaactccttcatcacttgagcttgactcggagtcggagccgaaaatcatcccaaggtgagcttggccataacgttcccgcttgctatgcttgtgcttctccttcttctcatccttcttttcgcccttcttatcttccttgatgtgggaaccatccttgaggtaagggcaatccgcaatgaattgcccgggctctttgcacacgtagcacacccttgcagaatgtcttccacttgacttgttggagtggtgcttggaagaacttcccttgaagaagcagcttcacctcatcaacttgccgaacttcttgacgaagagagccatttcttcatcatcgatctcctccttgctcttgctcttgcggctctattcttcttcttcctttgccttcaatgccaaatcttccttcttgatgcttgtcgttgagctttggttgatgtattggatgacctccttggactcttgcacaagcatgtcatgggctaggatgcgcccgagcaaatcatgaggtgtgagagtcttgttgtccagacgctcacgaatgatagttactaaggtagagttccttggagtgattgctcgaaccatcttcttgaccacaacctcatcggtcatgtccttggagccaagtcccttgatctcattgacgatcttgctcaaacggtcatacatgtcgcttgggctctctccatccaacatcacaaacctctcaaattgccctttgaggatctccaccttggactcgcgaacactatccgtgccttcatgcaaattccgaagcgtgtcccaaatcaccttggcactctcaataccgtccacgcggttgaactcacttccactcaaggcgctaagtattgcattagcggcttgagcgttcttgtgctcgttctcgtcatcctccttggtgggatcctcaggtttttgcaaaacatagcccttttcgactattctccaaatagatgggttaataaacttcaaatgcatcttcatcttatgtttccaagcggcatagtccgtgccgttgaagtacgaagctttgccgctataggtactcacataagaggtagatgtggatggatagtcataaggaaacgtagatcccttatcaccatctttgccatcccccgtttggcccgacatgatctctccaagcggttaagcctaattagtagattaggctctgataccaattgaaagggtcaattaggcctagagggggtgaataggctaatttaaaactttatgcggaagctcacactgagttagggtcggaaagtctgatccacagtcagaccatctgaaaatatcagatagtctgatgttggatcagactgtctgatccactaaagaaacacaacaagtagatctagtgcacaaacaggagtatagcgcaaacagcgactagatctatagcggcacaattaagcaaagctaaagaagggatgaagagatatcaccaacaatgaagttcaccgagttgttcccggagttcaaatccttgaggggattctactctccgttgaggagctcactaagagcggggtctttgctaaccctttcctcaagaggttgcactaagcactcctccttccactaaggggtatctctttccttgcggaggcgagatccggccttcacaaacttctcccggccaaccacacgtagatcggtggctcgggagtaacacctagccgtctaggagtcctcaacctccaagagtaacaaacaccacacaactcttggtcaaaccctagtgctcaagatcgagtgaaacagacagtaggccctcaaacaccaaatccacaaccaccaagatccaccacacaaagaacgaggagggatttgagagagggagaaagagctcaaatatccaaagcaccttagcaccaagctcaacccaaagtgaatgtgaatgaatgagttgggtaaccctagaaaagggttaggtggggggtatttatagatcccccaaaatgtggccgttgggagaaaatattttcatcccacctcggaaagtccgaggtgacatcggatagtccgatgtttttgacccccaagcacgccagagacagagaacgaaattctggagaatttcggacaatccgatcgatcggatagtctgatgttatattggatattccgttatttttgaatcatgaatttcatcctctcacagagactcaagttccattgaatttcagagtctctgggtcatccgatactccgatcacatcggatagtctgatttgaaaaatcactcaagaggaataaaaagcaattcaagacagagagtgaagttctgagaaagttcagacagtccgatgtatcggacaatccgaccttatatcggattgtccgatattttttagccaacactcagaccaaagacagagggaaaagttctaagaaatttcggatagtctgagcatcggatagtcttatcaggatcggatagtccgacaggaataaaataggaacagtccaaataaaggattttgagcactagtgttctaccaattatatgcatgtggtagccctcttaatagtacggcatcctaatactcaagaacacaagatatacatggaatagaagataattaccacaaaagatgccgcaaagcttgtaaattcaagttccactcctttttatccttgcatccatctcaacaaagagcattagtgaacctctaattgtgttgttattaacaccaaaataaatgaggggtcctagatgcactttcagggtgaataggctttcctgaaaatcacaaacaaatcgcagcggtaaaatttaacaggcccggaacctcctggtgtagaacaccggaatttccggtctgctcagacaatccggaacttccggtgttcttgtaccggaacttccaggcaatagaaaaacctgggaaaaactaacagggactaaagctaaaattcacgagatgaatcacaggataactgcagtagcacaatcacatgcacatgcacagaaacatcacagagtggacaaagatgattttttttcccgaagttcgaatcttgcaatcctactctccgttgaggtgctccaaagagccggagctcgattaaccccttgcctcacttgtgcaaaatccttagaggaaatccacagccttcaaccccaacacctataggttgttttctagaattgagtgaccaccaagatccaactcaacctccttctagaaaacaccacaagtgtgagtagctctactaggaaaacctctaggacttcagcacaaggttctttactcacttacctcattttcttacggaggtgaggaataccttcacaaactttcccgggacatccacaattgcaaggaagctcgcgggcgacacctaaccgtctaggagaagatctccaagagtaataagcaccgagatgacagcccacgagataccctaagtgctcacaccaatcttagccttcaaaccttctccaactcttctccttcaccctcaaaatctcactctcttacaagaatggctcaagattgggtggaggaagcaaagaagctcatgggagaggctagcaacagctatggagtggaaaagcaaaactgaaatggccaaagggtgagctggggacgatctagatatatataacggctaggtgacgtcatctagccgttactcacatttttgaactgggaagggtccggaacttcctgaccactggaagttccggacaacacttaggaaaaatttcacctctcaaaggtccagaacttctgggtccaaggaccggaactttcggccagccttctctgcccgaggaagggctatttccaaaaatagctcccaaaaatatttcaacacttgaatctccctaagagcacttgttgtatcccagaaccacacctggaacccctcttaatagtacggtttttcctaaaactcgaatgcaaaaattaaactatcctatgcgcccttcgagttccaattccgcttgaatatttgttgtggggggttctccaagcatctcttgatcacatacaatcatcttgggactaaacacctgagtatgctcaataatactcattagtcccttaaccctattcgtcattaatcaccaaaacccactagggggataaatgcaacttcaacaccaagctgtgagatcgattaggtcgggtggttggggtggaacgtgaatcctgtggtggaaaactccccatacttgattggagaaggaacacgccacaagtaggtgatagcatatcaacggctccatcatgcaaaggggacaaactagctaacttggcaatccccatcaatctaggttggctgacatcaagcaactcttccatgtggcaaggtacatgaacatcttacagcgacctagaatcttagcccccccaaatcagctcagcgcaacccacgaggactttccccaagaagtacagaatagctatcgttaaatgttagcttcaacatcggaaacttgatcccacaactgaagatattctagtagtgtccacatcaaaagtctgtctttaattacacgcacccacgtgtaatcgtcgagagccgctaccaccgtgtgcatgctccttagtacaaaagaaaagagcacctttctgaaactcattcttcatacaactaagggtgtgttcgggagggagagttcggaacttctcctccctgcaaggaaaatgagatcgctcattagcgcatggttaattaagtatgtcggaggaatggagatgcggtcgccatctccccgggtcctcagggctttgacaaattaagtcaacaagagacatacaagatctacatctacaagagacgtacaagatttacatattcaagagatgtacaagatttatatcttcaagagacttataagattacatcttcaaggcgtctagaagagtgaggaaacataagagatctatatcttcaaggtgttgaagacggggcgtaccacttagcacgcctcaatcaggttatatccatcaagaactccttcaatcattgacatcttggagaagcttgtccgagtcaagaagaaaatctataaaacagcgatggagttgatgcgagcgccctgggcatgttggatgcccccggcatgcactatgtcctgaaaacacgatagtccctggcacacccccttgatttgggcatgccacaagccctgggctcatcaccgagggctttgcctcctgccctgggctcgccctgggtttctctgtatacctaggatggcctagtggtttaactgcagctaacctcatgattatcattataggggctacccgcatctgcatcttggtggtggcaccgtatgtagcctcctacatgccacatcaaccaaaggagtaagagagaggcagcgtgtcacgtcctcaggcgtccaccgcccaatattccatcagctgtcccatgggctgacccatgggctcatgatataactagatggaaacttcttcaaactcagcaccatctaacagttgtgggagaact

SEQ ID NO: 79288 - DNA, 1726 bp, Oryza sativa
agcgccctgggcatgttggatgcccccggcatgcactatgtcctgaaaacaccatagtccctggcacacccccttgatttgggcatgccacaagccctgggctcatcaccgagggctttgcctcctgccctgggctcgccctgggtttctctgtatacctaggatggcctagtggtttaactgcagctaacctcatgattatcattataggggctacccgcatctgcatcttggtggtggcaccgtatgtagcctcctacatgccacatcaaccaaaggagtaagagagaggcagcgtgtcacgtcctcaggcgtccaccgcccaatattccatcagctgtcccatgggctgacccatgggctcatgatataactagatggaaacttcttcaaactcagcaccatctaacagttgtgggagaactgacacattcgcctggcatgtcaggagggacattgacaagactaagtatatcgatttcgttggagtgggccctgcttctacatacatgtattggtatggtggactcccattcgcctgtaaaaggaggatccatgccaacgaataaggggttcgattccttagcaattagatctcgtaaaagttaatttcacaattcttagttaatcatataatcattattcgcatatgtatttagcatatgattaatattttaatattagcccatacaatacacgggttgatgactagtaatcacaatgcagcaaaatttttccacaaaatcaatgaggatgaaagtggtaaatgtttaaattaaaaacaagttatggatggattaattgttaaaatagaattttaaactaaaatagaatgatgccccgtcattgcgtattttttttcttacaattctagcaaatgtttcaacggcaataatttgtttcacatagatttcagacttggacataatataatccctaattaatccagacgacactcctattagtctctaggtgatcaggtacacagagatatcggcgaagggcaccaaatcagcatggagcagcttttgctagttgacaagggcgcatgtcctccggatctccccctggctgccggtgagcacgcccaccctgcccatgttcaccattgacacgccaaagtcccggaggaagctctcctccgatctcatgtactcgtagacgagccccctggtaacgtcgttccggagcagcgcctcgtcggagtggaacatgcccttccgctcggcgacgaggccgtagtaggtggcgtcgaaggtggtcgagctgccgggcaccatctccagctgggtggtgttgtccttggccgacctgcactgccgccgcagccccgcggcgtacgtcgcatccagggtcgggtccgtgttgtggtgcgccgtgaagttgcgcagacgcttcgctatcgatgggcagtgcgtgttgcccagcgcgtgggcgcctgaaagttcaaagtgtcatgcataagaatataaacaaagttaaataatctttaagaatgctagggtacactggtagagaaaccatctttggtcggtcgacccatatccacaatagtcccggttccattaaaaaccgggactaaaaatgatttttagtcccggttaataagagaagatctttagtcccggttgttgttaccaaccgggactaaaaatcatctttactcccggttggtaactccaaccgggactaaagttcatttttagtcccggttgattccatgtca

SEQ ID NO: 79289 - DNA, 28073 bp, Oryza sativa
  unsure (1)..(28073): unsure at all n locations
cgcctcgctgtcgacgggtacgtcgcctaccactgaaagcacaacaccgttaaatcctagaaaattcgctctcatagagagtcgaacctagaaccttagatgctactgaggctctcgtaaacactaggctacagactacaggccctttcgcaaatcgtaatagtttctcctacacgcgacatcaataggccagtagtaaaagagacatgtgacttcatgctctacaggccctttctcaaatcgtaatagtttctcctacacgcgacatcaataggccagtagtaaaagagacatgtgacttcatgctctgtctgatactagctttgacggtcgacattgtcatacaaaactacaatgggtttcaagtagggcatcatatcgacctcatgacaaaaattacatatacatggttgttattcaaaatttttaactgaacagggggtttagacctgaaataattcaatcaaaaatattggaaagtaattaaatacatatcaccagtactgaccacttcgttgtcaatttgttacattttggaatatttcactcttagtataggccctattcatgttgccagacaacggagcagctgcaaccactatgagtacacaggcacaagtaagctacctgactgctgcagccattgccgcagaactggatgcccaacaaccgcgtaaaaaactactcaatccattttatattataagacgttttgatttttttaatcatttttctaaaatttaactaagtttgtagagaaatatagcaacatctataacacaaaataaattagttttactaaatttaatattgtatatattacgataatatgtttgttttggattaaaaatattgctatatttttctaaaaaaattcagtggtgtgaaaacggtatcattatgttttcactgagatgatgtcatactatctcctttatatttttttccttgcatatttgtataagtaatgattggaagtgcacgggtgatatatcggcaactacatgttgtcctgaacaggaaactactcatggtctaattttgccactattggaatgctatcgtggtgaatccactagaatcttttaatgttttcacatgaagccaattcaaaatttttactatatatgttatttcagaccgagtatagttctaattttttttttcaaacttccaactttttcatcacatcaaaactttcctacacatacaaacttcaaacttttccgtcatatagttccaattttaacgaaacttccaattttgacgtgaactaaacatatcctcaatatctcatcaggtgaagtttgaacacttttggtctgcaagaaactgtatgtgtgacgcctgaaagctaggctgaatggagattaaatatgtggctacgtacctgacagaacagccagatccttgaggctgaggcccttggaagcaaacctggtgatgagcctgcgaattccatcgaaggagtcgggcaagtaggtcaccgcctccttggcgctcgacacgcggccgtctcgccggccggtctccacctcgtacaagttgccgtccttgctccaccgtccttgcctcaccgcctttgttgcctaagcacaaagacttgcatcttagagtgattttacagtttctgataaggtattgagagttacaatatttttttaagtgtaaaatgatctctcacgatatctccagtactaaaagagatcaaactttatattaaaaattatattaaaattgtgataaaatttttcaacatattaaggtatgagatggaattattaattaataatcttcattaattactactccctccgtcccaaaataagtccagttttatactattaatctccaacattcgattgttcttcttatttaaaaatattttatgattagtattttttattattattaggtgataaaacatactccatcgtttcacaatgtaagtcattctagcatttgtcatattcatattaatattaatatatatttagattcattaacatcaatataaatataggaaatattaaaatgacttacattggaaagcggagggtaaatactagtactttatgtgtgactaatttttttaataagacggatgattaaacattagacacggatactcacgactatatttattttaaaacggaggtactagtgattaccaaggagacggcgtctctggcagcaatggcgaggatgtcggcgcaggagacggtagcggggcacttgtgctccagcttctccttgattgcgtcgatgacgtcgtacgcgtccagcgtgtgattcggcttggcgtccttctccgccgtgttcttcttggtcgagttgatcagcaccgatccttcacacccctgtacgttcatcgaccaattccatggtaacatatcgatcaaacaatcatggtcttgaaagaatgctaatttgcacattttaatttgtacagaccacttcatctacggcattgcggatgtttgtcttgtggaaagaaaaaatttggcacttgtcagggcttgtgagtggattactagtgtttttttatgattattttatacagaaagtttcagagggtcaccactttagtttgtggacgactgatgatggactgcatctcatcattttagaccggctttggatgccatttcactcaaaaaggcaatcaaacaggatgcagaaaaaaggcccattttgaaggaatctagctaacccacatatcttatcctctcctcctttttactttttcaccttcactagctcacagttaaaccctttttttttttagctttgaataatgaaacctttgaatcagtagtaaaagagtaaagatgacatttggacttcaatctataaaaagaaaataacgagacaagtagtaataatgcattttagtttaccctgacgaaacaatcgtggaagtgaagcctgagcagcggcgcggtggtggtcgggtcgtcatggacagccgccgccaccaccttgcgcactatcttctccgcctccgggcacgactccttgtagaacccgaccgtcagcccaccgccgccgccgtatccatggacgacgggaacagccgccgccaccaccagcagcagagaagaaagcaagaaccaccggcgaggaggaggaagaagcacgcgcactgccatggcagtacactacactacactacgctgcaggtagcttagcgctctagcaatgcttaagtgcagctggcttgtcagagagaaaacacttgttaaaaatggagtgccgtgtgtgtgtttgagcaggcagcgagtgagtgggacgtgtgcctgtgtgtatgtatataaagggccaaggagtcgaggagtgtgtgtatatgtgtggatgccatctacggagtacgagatcttggggagtgttatataaatggagttgctgtttccccggctgtcatgggcatgatgccatgtgattaggcgtgggtttccgggattttagcaccgtgacagcgtggtagagatgttatctgaaatgtaattaaactctagcagggcgcgcgatcgacctatgctgattaacccagtgctagttgttgccatcagaatatcctggtgatcgcggatcagatgctgacagacgggccaaattaccctctccgggtttttcttttcttttggatttgctaaaaaaaaaaccttgacagtttctccctcaaaactttccgtttgtgaaaccgttagatcgtgtggagatttgtttgagggagtgaagatttttttttttttgacatagctgcacaaggcggactttcgtacgagaagccagattgctaaggggcgatcgattgccccagcgatcatattcgtatcgccctctccctccacctgttttttttttggcaccacattacttttttattttagtaaatttatgtacctaaagtttatacacctcaagtttacacatccaaagtttagaaacctaaagtttataaatcaaaagtttatatatccgattcaaatttgaatttgaattcaaatattttttatatatagtatttctatacatctaaagtttatagacccaaagtttataagtcaaaagtttacatccccgattcaaatttgaatttgaattatatccgattcaaatttgaatttgaattcaaatattttttatatatggtatttctatacatctaatgtttatacacctaaagtttatagacccaaagtttataagtcaaaagtttacaaatccgtttcaaatttgaatttgaattcaaatatttttttatatagtatttctataaataaatttttcaactttatattttttattgttttttaaattacgtagttcctacgaggtgatctcgtagttcctacggggtggagataattggggtgtagtaggaagagaagaagggaaggaggaaggggggagaggagagtataggggtggatggggatcgatcgcttggggtcttttttaaaaaaaagaccacataggttgtcttttttaaaaaaagaccacataggtggtctcatagcataacatagcacataggcatgctagccaccgtgcctatgtggtcttttttattttattctatctctattttttaaatatatgaagccattaattttttacaaccattcgtcttattcaaatgaataatatttaagtaaatatcttttcttttgttgtggcttgatttatcaataaaggaactttaaacattacttatatttttttatatttgcacaaatttttgaataagttgaatgatctaagtttgtaataaaagtcaacaatgctatgtattaaaaaaacatagggagtagtaatttatataagttaagtatatcgcagtgtaattataatgtacatcctccattcaaaagtcttaaggatattttatttattatttttcaaaatgagataggtgtgtgtatatatagtcttcctgcatctaagacttacataaaaatattgtgtttttgttttgtagtgctagattaaattattgattggaaatcgaaacccgaataaccatcttaatatttaatactcctcattggtttgcatgcaggcgtataatccttggtactttttttttctcaatgaaaaaagtaatatgccttagatttggatggagggagtaattgtcgaatgttctatggcaactattttttttcatattggtcatctttaacttttggataagactatttatcttataaaaaactaatcccttcgttttatattataagtcacttttactttttttttccaaatcaaacatttttaagtttgatcaaatttataaaaaaatatataaatatttccaacacaacacaatcagattatcaaaatgtattaaatattacttttaataaaactaatttggtgttgtagatgtcgctaaatttttctataacattgattaaacttaaagaaatttgagaagaaaaaaaataaaacgacttataatataaaaggagggagtatgtaattatcatttgttttgccctgatttattttaccattaaaggcaatgtcttatatatttttttaatatttgcacaaaattttacaaacttggtgtttcataatttatttttattttatatatgaaaaagtactgatcaaagcttggtacaactcgatcatgaactcaatgtgaaaagtacgaccagcgtgcgaacgagaagagagtaccacaacggtagctgcggtgaatgttgcgctgtgggatattctgttatagttaatcgtgtttactgcatttcctgcggattaattaattggttgatgattgattattaaattagctagtcgtataacagagcagccagtcagtagtagatggaattacgatgcgatcggatttcaagcatacaggaccccaagtgcggaccacgtggggtcggggagattatttgctttcttttctatgcggcctgatggcccaatcttctgccgtatgtcctggttgatcttatctatagcttgctagtttcattagcttagaggcgactttgaccaaagcttttactcgccaatcagccatacactaattaagctactcttgatattacccttcaaattaaggatcaaggcatgcatgttccggtgttcattatgacaagtaccacggtggggtgtgtcacatgcatgttttgcagctggagatgtatagaaaaccgtgtattactacttgagcgaggtacaaaaggtcaccgtcgtacgtcggcaagctcgagcggcctcaactgttatgccctcgggtgggtcggcacacgggccaaactcttgctgaagtgcttctccaagtcatgctctactgccgaccgtgctcggctgctcgccttgcattgtgccctcatttcagccgccacgcctgccgatatggcgatatctgctactgctactggtactgcttttattttcctcctttgtcctcttgctatttattttttggtcatggctcacaattcctgccggttaggattgttttctacgcgcaccctctattataataaaataaatcaatatatataatatttttagattcgcaatcattttagtagttaggaattgatttattttaagcaagaagcaagcaggaactatgattgatccttagaactcatatgtgtttggttttataggataggatggatcgagcccacttttgagggtatttggtgtgtctatcatctaaaaataatattcctttaaaatttatgttggcatttttcccaatcaaagctagagttctctcgtgttgatatgtgggccatgtcttgaaaactaggaccattacacccctcatgccgaactgatagttaggatcattccatccaaatacatggatgagtctaacatatcctatttcatcccgaaaccaaacacacactagaaggagaggcaaagcttttaaggctaatggggactatagcttctctagcttttgaaaattagaataaagtccttgttattatttcatgactccaatgatattgtagtttagctagtttgctcttcttttatacttgatgtgatatactccaaatcaatacatgtaaataggagtagagccattacccatatcaagtccgaacctgtataaaatttttatcccatgtcctctttattccatattcatgtatgccatgtataccttgttatcagtagtaccttacgtccctaaatactgtggtagagtataacccgttgaaagtgattagctagatagagggcctgtactccaaggtattatcaagatgacttcgagacactggcggagggctcggtagggcgaggtgtggcgttcgccatacctcgcgccgcccgctaaccccccaccccctcatgtcacagagcggcaaccgccagccggaaaggacgcagagagcgcggcgactctggaggaagacgagcgatgaccgagacacgtcgtgggcgtgtccgcgcgtggccgtgctgggcctctcgttggtagctagtaggcccattgtgttcaggcctgccagtggtttcaaatccacctcgcacctacaccaacccaaaagcaactacactagcccacccaatccaaaccaacccacaaaataattttctaaaccccacccaaccccacctgcacattctatccacccgatccaatccaacccgcaagttgttccccacaggcaacccatggattctacccatggctaaccaaaacacacaagcacacaacagttggctaacaaaaacacatagtgacacagccacacagtaacacaggcacaactgaaattagtcaggaaatttgtacaacactttgtcaatattacacgaatagttagtttaacatgtagaagcatgctacttccgcagctcaaatcagttagcatgcaagccatgatcctctgatgtgattgcttgatgtggttatccccacaaccaaaaagtggtactactctcttgaagctcatccatctcaggtgctttgatctgtaatagcatcaagagagtagaaccaaaaggttacagtaaagattcaataatactgataccacaaaatttaagtgtaaaatatcaacttagagctaaaatccatcatacaaaaaactactaccttttcagaccatcatactttagaataagttagcgtacaaaaataaatgatatggccacacatacaagcatcagctaccaactgcattacagttttcaagttaatttgagaataatcatgcaaactatagagaccaagttttcttacaagctaagaaagaaacaatgttactttgttagtctagctagtagtagataggcaaaaaaatatacatttaattaccttgtttcttcggtttaaataaccaatctttagcacaaactagtgcctcaagcatatccggtgtcaaggaacttcttgtgtctccaagtatccttcctccacaactaaaagctgattccgaaggcacaatgctgagtggaattgctagaaaatcccaagtcataattgccagtacaggaaaccttttagcatttctcttccaccaagccaaaacatcgaaatctttactatcatcctcacaaacttcttctagatatgtctcaatctcagacttatgtaatcgtgttcggtttgacttgaaaatagcaaactcttggtcaagttttcttttgcctagaactggcgagcctacaccactagcttctccttgcccagaatgtgataggcaggatacaccccttctccttgcaattccttcatatactctaaagtaagacttcatccactctataacagaatccactttagtttcagcttcattcatattgggagacaccttggcataaaagaattccaaataatctcgttttcttcttggatctaagacagtgctaatgacaagtgccaaattaaaattgtttggcaatttttcatcccaatacttagcaaacttcatatgcatagcactagccaattgagtcaaaatactagttgtttgcgaatcaaaatcacttaaagcatggcgaatgcagagaaccaagtgcaagaatgagtgtgctgttggtttcctgtcagctgacacaagtctagtagcctcttcaaaggctttaagaaactcacaaattgattcagcagtcagccactcttcgtcagatggtgcaacctcaccattttcattggcataactattaaggacagctctatagaccaatgcttctaaaaccattttgaaagttgtgttccaacggttaggtacatcaacagttaaaccaaattttgaacaaaggcatgaactgttggcaattgaattgaacgcttggatacgtgaggctgaattttctatgtatttcaagagctcatgtatcttatgtattgccccacgaattaacctcattccatcttgaaccaataaattgaggatgtgtgcgcagcacctaacatgaaaatgtctaccttcaaataacaactcattcttctgatttttcaccatttcctcacaagcagccgtgttattactagcattatccaaagttaaagtaaatagtttgcccctcaagccccaatcagtcaaacacctcatcatggcttcttctatagcaaagctagtatgtggatacttcacaggcttcaagcttatgattttctttttcagactgaattctgcatcaatataatgtgccgtgacaaccatatatcttaagttttgatttgaggtccacatatctgatgttaggcacacacgtgaatcaatattttgtaattcatcatgcagttcttgtttcatcctaatgtacaggtgtaaatcttatcacgaattgtttggcgaccaacaactttaaaggttggttgcatggacttccatccactcagcaaagtaaggatcttcgatttttcgaaatggtatctcgtcatggatgaaaaattttatcatcaattcttcactccttctaggataaaacacaaaattttccacgggttgtttccgagcaattgctatgaacctatttctaacttcaacctcaactagtggacaagagtcgcaaacatggtttatgagatgactagttcctgattttctagttgctgtcaacattaaccgacaatatttgcactgtgctttggggacaccatctaccataacaagctcctgctcaaaatgttcccacacctttgctcttttacgtggttgtaaagataattcatgactagaactattgccagttgaactttctgaattgtgtgtagacatgtttaataagcctgcttgtgacaatattaaaaaattaacattcaatctgctacaaacagccaaattaatatgaatctaattcaacccatatttgtaatcttgtagaatctactatcaatctgaggtatttccaaatcagtattaccaggcataagtcataagtcctgaaaaggagagaatacttgctggatcttgaagggagagagtattgctagatcttgtgggggccggggcagggacacacggcaacagatcttgcatggaggagagcagcagcttcttggcgccgacggagcggagatggcgatctggcggagcggtgccgggagatgacgccggagcggaggacgagcgggaggccgggagccagtggagctgcagccgcttgcagccaggtcgaagtggcgagcagcagcaacttcttggcgccgatgaagaggagatcgtgatctggcggaggcgcggagcacgccgggagatgacgctgaagcggaggacgagcgggagccggtggggccgcagccgtttgcagtgaggacggagtggtgaggaaccaccacagcagcgaccccgtcggtggcaatggtggcagcggcggcggaggagaaggagcggaggacccaagaagaagaatgagttagcgtgtggattcagtccatggattagtcccgtggattcagtccatgaatcagttattttactcagcctgcatccaccccaaaccaatccacatgttttgtaagctcagtttaattgggttcaaaatgacattttaggttgtttcaatttaataaaaggattaaaatgaggatctagtccacttaatctaaataaagtcagctcattggtaggtcgaattgtgcttgttctgtgtgantgtaaatgtggaaccccatctcctccacttccatcgggcaggcagggcagcatggaggccggagggtacaacagcaaaagcaagccaagcgctcaaccagccatcactctagccactcattgctatttatcttatcaacctcaaatatactatactaattaatctttgctatttgttttgcatattctacatatatctaatatctttcctcactcactagttcctacatgtatgcaatgtatcgttgaaagtctgaattttgaggagttgaggcattttttaagtatctactcttctatttgtacttgtttgcaaatggatgatgaattgtgaacttgtgattagggcttgttattaagataatgttgtgtcgtacaacatcgtgcattgagattgttttttcctatatttttgatatgtgctaacttttgctgtggcccacctaaattttttttcattcttccgcacttgcttcgaaaggaagttttttccaatgaaggttttatgatcgctctgatcagggagatacaccccaatcgatgttcaccctcctttggatcggcccgtaactttccaagtctactcagcatcgatgctcccgatcaattatcccactgttgggaggaccatgtcagatcgacccaatcagcttactcttgtcccaaaagtggtggtgtccaattcataggacatggtaccactccttcattgaatgtaagtttttttcacagggtagcagccaacaagccgttgttttatattctggtcgagttcaaggtgtttctcagataggtgccaagtaaaccacaccctaccgaagcttttgagggccaggaactttagtttagtattctcactactacgaaaaccatttttcgtggcggccattttggatttttgctggcggaatttgcagccgccacaaagcaaagaccagtgaaaatcaagatcttcgctagcggttattgaccaccagcaaaaatctattttcgctggcgttggcttaagccagccgccagcaaaaatccattttcgctggcgttggcttaagacggcgctggcggttgtgttaaatcgaaaatacccatgcagctgcagagcccgccagcaaaaatacacatgaagccccatgttttgattcattaaatttcaaaattcaaatccacatctagatgctcatttccaaattcaaacacgaatttacacatcatttactcatcatcatcagcacagatcaaacatcatttacacagatcaaaacatgtgcatcatctggaacaacatgcaaaaaaaaagagaaaaaaaaatcaaatccagccgcgggagcacggtcgacggcgtcgaggtcggtgccgccctccccgtggtccagcggcggcggatccggcctcccggtggcccgacggcggcggatcgggcctccccacggcacggcggcggcggatccgccctccccgcggcctagcggtggcggatccgccctccccgtgagcagccgcctactcccgagcgccgccgcgttcgcgcccgagtcgccactgcccgcgcccgagctcgccgccgccttcgccgcgcactccatgttgggagatagggagctggaagaggaagagaagagggtcggagcggcggtcatatgcggcggtggagctgcggtgatggcagccggcggtggtagggaggcgacgagctggcgcggtggagaagggagggaggagagacggagagagacgggaagggaggagagacgggagagacggtggaaaagggataaagatgggactggtgggtgggcggtggattttattagcctcgaattttttttagcggtctttcttacctaccaccagcgaaaacgtgatttttcgctggcggacacttaagaggtccgcctcaaaaaatagagtatttttcatggcgaacctcttagcgtggccgctagcaaaaatcggttttcgctggtggtccatggccccccacccctcgatatgtttttgctggcggttttcgcgtatgcccgcaagcgaaaataataggccaacgccatgaaaaatcgtttttctagtagtgtctagtgctaagtggagtagaatagaatagctctcgttgtcctcggagtctttggaggaattcgggtatggctctagtagcttttcttatttcttttgtaagactttcggaagtaatgaaatgttattctttatatactctcggtactttagtttatctgagtatcggccttactttctatttgcatcggtatagtcgtgtagtcagcctaccagggaggtgcagtggtgtggatttagtgtccggttattcggttgctctatgtcatcttggaggatgtagagtagtatttaataatgtagacgtggtgtctagattattaagtatcattatctgggcatatatgctacaggtcagtcgaggtgagccgctgatgatgacagctcagtacgggcattcctccacgatagtatatattcctaagaaactttcctggggagggtactcctccgtatttagccccggttggaccatgacaggttgtcgtaaggaactcggcaatccgaagtggtccctcgaagcaccaggagggcattgttagggggtattggctacatggttgtatactaatagatgtaaactaagattgagtgtatactattattataagaattgattgtttttctatttcttcttccacatagcttaggaatgattagtgagagatatgagttctttgcttcgtgtcactttaccctataaatatattaacccatgcttagactctgatcatacaagtggcatatatacattattagcatagttctctcttacaatcttcccttgggattaaataaatacgatactttagaatactcttgggtgaaatgctacaatggtatatccgtgcgcttgcggattctttctttaacaatatatatttcttgtaatgtcattcagaaatatcaacaggaatcggtctccagccatcatccatccttcatcagctaactccataatttcgcacccaatgcgcaccatctgatacagcctttctagccttaacaaatgcaatatgagatcctaaaatcacgtcgttgacttcgctccatattttccttacttaacggaatatacaaaattttacagttagcactaccttgtaggatttaaatttaaacaaattttaactgaagttaaatatatttaggaaaactaaaaacttgccccacattgggtaaatgacaattacccaaaaaaatgaaattcaaaaacaaatattgccttttttttctaaaaagatataaaatgtttgtaatttaaacaatttacgaaatttttaaattttgtaaaatatatctaaattcagccaaaatagtttcagatttaaatcttgcaaagggtgaaatcatcttttgcaatgttttttttccattagaagataatatattaaaactatggccgagtgtttgttagtaaacaactataatattagggtgtcataaagcaaattttgcatacaattttctttaacaaagccctcacatgcaacaacatggaaagaaaagagggttaatttgcattttttttagcttgtcatatgaactcacatggtgttcaacttggcagaaaaaaacaacatgaacaattcacttattcaatttacatgattagtgattatatcacgccaacctcgccagttatggtattagtgtattttaataattatttgtttgaaattcattttatgcaaaaagtactcccccaatattaagaatataaggcttattagcttttttttacattctctaatactccatctgtttcatattataagtggcttatcttctttttttcaaacttttctgagttataaaaatatagtaacgttttgaatcccaacaaacatactatcaaaatatattcaaagtacgttaggttcaattaaattattttggtgttataagagttgttatcattgtttataaacttgatcaacttgtaaaaatttaacttataaaaaaaccactgtgatttatatatgaaacggagggagtattataatcgggccattgatttctttagtaatgtactaatatcaacaactacgaaattaagatcatacgaaaacattttctgaaataagaatacaatgatattatgtgtgtgatactaacacatactatattgttattagtagattcttaggtggcgttttctaattgagttacagatttttcgtaggtttctgttaggcttttcagatgattaaacggtgtatttcgtgcaaaaaatttatatatagaagttgttttaaaatatcaagtaaacctatttttcaagtttgtaataattaaaagttaattaatcataacctaacttcaccttcctcttcatccatctcaaattttttcaatgatgattttgctgaaaacaaagagcgcctttactgaaaacaaagggcataggtcagatgtgcataggatcatcttgttttctatatagctctattaaagcatgttattataagggaaaagaaaagggatgttaaccgatatattttattttcgaggggaaaggcaggagctctgccaatttcattaaaaaaggagagaaacaacgtacctcaaggggtgccacccaaagaaggtacaatgcagtcgcaaaagattttcaggaaatgtaaagctacaagcatcaataagtggtgctaaattatctaaagaatctgagcttcatcaagtcgtgtagatggttaaaccatcaagatttcgcctattttctttgatcatttttctccgacaagcttcccaccattccataatgtccccattggaaagggatgtcgtgggcatatgaaggcctagttttgaccaaattttgctccatacctatctagcgaacgggcaatccatgaagaggtgtctggctgtctccggctcaactccacaaagggagcaaattgggctattgtcccaaccctggagctggagcttatcggaggttaggattttcctttggaccattagccaaccgaaaaattttcacttggttttccatctttgctttccagatgtagttgaacctctcctcctgtatgctccccaggaattggatccggtaagccgagtttgctgagtagatgccaattgggatccatctccaagttactatggtatccgtttgctcctctagatgtacctgttggattaggtgccaaagaagaatgaactctctgacctgggtggttgtgttcatcctcttcatcagtctcaaccaacagttgtcttgtaactcctgtcctatgccactgtcctatttttccttgtcacgagctgaaaaagagatggagtcaattccttgggcgattgcccttccagccatctgtcatgccaaatttaacttttccccatttgttaaccgatagtaaatttaatatgtttttgtcatttgtagataactaaatgcccatgctttgctatggctaaaaggaaaaaaataataatattgttgcctaaaataaaaaaatatttttcatgaaatattttacccaccttttagatttagttactacatctgtttcatattataagttattttgattttttttcttagccaaacttctttaagcttgaacaagcttataaaaaaatatagcaataattttaacacaacacaacttatttttaatgaaactaattcggttttgttgatgtattttttctataatcttgatcaaacttaaagaagccttactaaagaaagacaaaataacttataatatgaaacaaatggagtatgtcatgttgaaaagtataaggggtaacatataaaaaccagaatggagtagtgtcactagaattttttgaattggagtatagataatgagacacaaacttttatacggattaagttctttggaataattgttgaaatagattttttctaaaaaaagagaatctcatgggatattaggaaacaatacaaatttaaatattttttaactcgtggtatgggagtatgagacaatgcttgctgcaccacgatatctttttcataaaacttgattgttttgaggaaaaagaagttcaatagataaagtaaaaacggggccttgtagcagaagttcttctggtggcaaaagcgggctttcgggacttgtgctgtggatactgttgtgggctttgggatttcatgcggacttgagtccaaatccagtccgccaatcgcatccagggtctctctcgtcggcctatcccaacgaaatctctcccaatccctctcttatcccctgaaaaccactcaccgtccatttcccctctccccacctccgcgtctcctcaccatggcttccgccttctcccccgccaccgccgcgcccgccgcgtcgccggccctcttctccgcctccacctcccggcctctctccctcaccgccgccgccgctgccgtctcaggtaacatctcctctccctctccgcttttccgtttccaaaagcaccgcattcgaatcccccaagccaggaccttggcaatttacttacactcgagagtggtttctgctgcgcagcccgtatcccgtcacggagagggttccgccgcggccgcttcaccgtctgcaatgtagccgccccctccgccacccagcaggtaaccccacgccctcaaatcccttcgagacttgggtggattgtttcgctcatgtccagcatcttggtgaaatgcgcgtaggaggctaaggcggcgggcgcgaaggagagccaacggccggtgtatccgttcgcggcgatcgtggggcaggacgagatgaagctgtgcctgctgctcaacgtcatcgaccctaagatcggcggtgtcatgatcatgggagaccgtggcaccggcaaatccaccaccgtccgctcgctcgtcgacctgctcccggatatccccgtcgttgttggcgaccctttcaattccgaccctgacgatcccgaggtcatgggccctgaggtccgggaacgcgtgctggagggtgagaagcttcctgttgtcacggccaagatcaccatggtagatcttccccttggtgccactgaggatagagtctgtggcaccattgatattgagaaggcgctcaccgatggtgtcaaggcgttcgagcctggtttgcttgccaaggccaacagggggattctttatgtggatgaggtcaatttgttggatgaccatctagtagatgtgcttctggattctgctgcgtcaggatggaacaccgtgaagagagagggtatctccatctcccaccctgctcggttcatcctcattgggtctggtaaccccgaggaaggggagctccggccacagctgcttgaccggtttggcatgcacgcgcaggttggtactgtcagggatgctgaactcagggtgaaaattgttgaagagagagctcggttcgacagggatccaaaggcgttccgtgagtcctacttggaggaacaagacaagctccagcagcagatttcatctgctcggagtaaccttggtgctgtgcagattgaccatgatcttcgtgttaagatttctaaagtgtgtgcagagttgaatgttgatggattaagaggggacattgtgactaacagggctgccaaggcgttggcagcactcaaaggcagggacactgtcactgtagaggacattgccactgttatccccaactgcttgaggcatcggcttcggaaggacccacttgaatcaattgactcaggattgctcgtggttgagaagttttatgaagtcttcacctaaattattctggaggtaaatggttttctatcagaaagttcggcaggagggcttttgtttgagtttaatgacattgtttcagaggcttgaacttgatgtctatttgtacatctatcattagtatagattttattccccttcaatcgaaatgcctgctatgagttgcagacggttcgtacatttgaatcttccttgtagtcattgatgcagccaatgattaggaaaggagcatctaagtcaagctaacatcttatatttctttttgaaaaaaaaaaagaatcttgcagcatatatgaacaatctttgaactagtgtccagagataatgtcatgccataaatattctgctgcttttgtcatttctcctagatgaaaggtcctaaaaatagaaaatacaatgctagaaatcttgaatggatcttttgcccaagtaagcttcaatagtaattatctgttggtattttagggaattacattctgtgctactagaagttttcatcatcatttttactcactgtttcaatgaaacaatgtacaatggaggtcctggactcacttgtcattgggtcaatgaggagttttgcaatttcttagtggcatataataagaatagctgaatgcccaggtgttgtgattgaatagaaaaatgaattgaatgtcactttaactatgtgcttacatgtttttaatattggtaaaacattaaacacgtcttgtgcaaacataagggtataagataaagggtgcatcagtccatgggagcatattttcctttttcttgtacatattttctttgtacaaaaatacatgacaacgaaatgttattctccaaaatgatatattattatctcaaatgataactgatcgagtaagattataaaataatctgtaattgtgacaattgatggtactaaagaaattcttgacattccaaactatgaaaagaaggtgagttcaggtctctctgacattctacatgcataaaaaaaagcacgcattcattttgatttatcaaattattggtcacctgtaatgcctaaaaaatatagtaacaaacttcagcaacttgagaaactctttacaaatatgttaatgaaaaggactcctggatattgtaggtttatttatctcacccaacaataaactcgagaaacagttcctttttgtgttgagtaattagatcagttagttacatgcatagtgcggatgctgctttcatgagggtataggtactgcagaacacaagtagcataacgagcaatttactaaatcaagttgtataagaatgtagtaccaaaattcacaactttgaactatggacaaatgttcaagtttgtccacacgctaattacttgaactgtagttttgctgaagactgttacttatactctacactagtaatcgtgcacgtgcaaggcacgttttggcaatctatgtacgaaggtagaacaatagtaacttttttaaggcgatccttttttttaattgtgcacgtccaatgcacgtcatgacatacattaaacttacattcattcgaaaatcaaattcatagtagtatataatcaaaagctaggactttttaataaaattatcagtcaagcatcatgtcctacaagtcaataacattatatatttaaaaacaaaggtagtaatattcatgcatcaaagtgtgactgcaattttggatctttcatcaggccccttgattgagcaatgtaccagttagacagacttaagagaaataatttttttcatgtttagtataaaatttcttagaatttctaactgttccctatgcgccaagtgggcaacaaagctgaggggaatgtcttggttaggtataatttattcgaaaattgtaaatataacccctttctcactccatgccaaattttgcacagaacaaaatgtaatgccctgctaggttgctatagagtacaaccacttaacattggtaacacttgatgaattacaacagctagacgattatgagggtacaaaacaccatatgaggaaaaaagcattagtttaacctaagataatttattgtgctaaccatcttcctcatgtattgccttcctcgaactgaatcatgcattatgcactttgtgaattactgcattgatatcctagatcattcatgctccggatctgagcgatggtcaatcgaatcaccatggaaaagctgttttcattttatttttttttaataatgagtttcccttccatttatgcctatgaagacatggtcagacttaactgtgctgtaaaacaattttatcactgccccatcttgttgttgccttttgctcttgagcagcaacttgtattttatttttcaatctcaaaccattaaagccacaaatggatcaattttgatttaacaaaattcatagtaattaaagctccttatgacataccatcctagtgatataaactattcgttgttcaatttggaactgcacatatgtcaaatgaagctcggatccaaattatagctattgaagcggcaatcttatgataagaaagtgatctagctagctgcatacaacttccaacctgcagttaggactaaataaatatgtaaccctcttttcaatttggcaatttagaaaaaatattaactggcatatgatgaacatcaagagtatctcgacaattccagatttgcatcaaagtggacatgcatgaatggagggatggcaatataagtgaaaaaaaaaacagtagttttttttaaaataaattcagtcacaacccatcaatagactatcagtagcacagtgccgtgtaaaaataaagaattgcaaatatgtacaaatatgttcaagtgcatagcagggaaatgttgggctagttgtttatgcgcaatcaacacaatctattatagataggtgttcaggagtaaagaaaaactctcatattgtctgcaatatatatatatatatatatatatatatatatatatatatatatctttgacttgtaagcaatactggtttagctgccaactggacctggaaaacgtaatcaaactttggagataattagacaaaaaagaatcaaatagcatgcaagcgtataacagtacctaagaagcattttgtcgaacatttgctgctcacgcaagagtgtgatgcaacatctcgcaccaaaggttattaccttgtgtctgttgcttgttaccaggattgggaagaaatcgtggttaagccgtttcaacaaacacccttgcaagcacagttaatcagtttgtctagcaatcaagagacatgacatgcaattctgaactttcttttcatccacaaattctttcacttcagtttcgtgcgaaacaatcatggtagacaaaacaacaaattgagtgaaaggaagatggcaaagtttaactcacctacaactgagcagcccattcttctggccggtgcatcggatccggtcgtcgatctggcttgactggggatttcatcggcacgggggatgcttgactagtcgatctggttgcggcgtcggcggaggcatggtgttgtggtcctgtgggcagggcgacggcgttggttgcgggcagcgacgatggtaacccaccctcaagtggctcgctgcgccaccggcgagttccatagcgatgcggaggcggcggcaaccggggcgcagctgagcggacgactcctctcgtgagtcgcgagctctccttcgcgctgggacggaggaaacggcatggcagattggtgggttgtctgggcacggtacaaagctaggaacgcgatttggggaggaaatagcggccagtgatggagctgcggtgtttgcgcagcgggaggatgccccatgcgaggaggtgttcggcgtccggggatagcgcggcgcggcagcggtgtaaacacggggcggatttcgcggtggtggggtgcgtcgaggttacgtgatttcacggtaggatcgcctgctcgtaaccatttggagccatcggatgaaaagatgatttcacctagtggactgacggatgagatgatgtcacctggctgatcgatagatgagatgagatgggatgatttggcagataggattgggaggtacaactcctttttatattagtatagataattgtagcattaccacataatttaatcggtaagtacccttatttcctcctgttacatcattttttactgagtttcccccttgccttctcatcatcgtgtggtctttgacatgttcagtacaattggtggattgattcattcagctacttctgcttccttttgcactagccttttatttcagtgaactctggttctgtacaacaattgctgatcacagtattacttatgaaaataggaaacatatgttttatattaaagcatctatgtagcaacaagcaggtgaaaacatcagttaaacatagttcaggtgtagtagactgaacacctgcaaatctatctgtgcaccatagcaaattgactgaattgtgatttgccagcacattagaatcaccctttcttcagttgcttttactgtcgaatgctcggtaactaatcgccataagaattcactgaagcgtgtgtccgacgtgatcaaactacatggactacaccttggtgcagaccctggcatccttgtacaccttgccggggcgacacacataaccttgctccggcgcgcagtgcgcgtcctgcgagcacacacacatcccctccagcgcgcaacccggcgcgtccctggtcggcgcacggccgccaatgccaagcatcatgtcgctccagtcgctggagaagaggccgtcggggtcataggcgtccttgatgcggaggaactcgccgatgcgcgggtacttacgggcggcgccgacgaaggcgaggttgcggttcttgccccagtgcggcaggccgccgtacttgaacacccccatctgctcgatctcctccaggacatcctcgaacagccgcgccctgttggggtcgcggctgcggtagtacgtcatgtcgagtccaccatgtcgtccgactggccgcctcctgccgccggtttcccgaggtgcgcggtcgacgccttgacgtagcggatcaggattccgtcgtagagctccacaccgcagagcgctttggggttcatgtcacggagccgccggacctcctcgacgaacgccccggcacggctcaccggcaggctgaaggtggtctggtggaagaagctggagcccctcacccgggggtcccacgggcacgccgtcaggagcgcgtcctccggcccggtgatgcagccgccggacgcctgcatcaggtgctgcgggcccaccaccgggtacccggtgaacagcccgccgctccgccgcatcagcccgtacccggccgacgagagcgccgcgtgggtgacccttgacgtcacgcacttgccgttgccgttgcccgcgcgctcgaacagctcctccgcgaggcggttagtacggatcagaagtctcggcgtggcacggaagccgatgaagtcgaggacgccctcgccggaggcgttcatcggcagccggtcgtccacgcggtacaccgctcgcccgatgcccgggtaccaggcgatgtcggcgaactcgtgctggtagccgaacttggtcacctggtccgccaggtcgtcgtcgtcgcgctccatgaacgtcacagaacgcttgaacagaggttgcagcgccagagtcacctgcactaatcccatggctgtgcattacttggtttgtgcaacggatcaaattttagagggaaagaaaggaaataagatggtttcaaaattaaatttatcccaaaaaaaactttctaaattccccctttttaatcactatttagtatttactcggtccctccttttggccttgccggatcttaaagaaaaagtaagaggaactgaaagcacaaatttataatgaaggacaggatgcaagatgcatcatgacagcatgtgaagaaatgagaataaattctttgtagcccaaacaactccaaaagaactaaagtggaaaagattgtgataattacactaaagctggttattttgtactccaagtatcatattttgtactccaagtatcacacaatcccggcagatcgactacgtactcattaaaaagcgatgtactaattcgtggaagtacttgtacgtaataagaaatgagcaatctgtcacactgtataggagtgactctgatgaatcaattgtttagatctcaagtttcaggtaaaaggagtgtttgctaacacatatcccgctagatttgcatgttaattgaataaacatgtgtcacgagataatatttttttaaactaaaagatgaccgcgttggcctatatttttttttggatggacataattaaaggaggaaaaattttaagaccagaaaattcaacgaatagtaattcctctatttcacattataagacgctttgggttttgatatattcatgtgtctatgtatatgttttatatatgtgtttaaattcttataaatgttagtgaatccagacgaaagataaagatgtcaaaacaccttatgacgtggactgaacgaagggagttagcctgattatcactatgtaagtgccgttaattctaattatataaacaaaccaaactattacatcatattcacttgtatgtccaagggtaacatcaactgtagtttgatccttttgtatatcatcgtttgtcaatcgtagacaaaaattaattctatgttagagttgattttgagttttttttgacataattcaaaccactaatcatacacatacattttgcccataattgtttttttttacttgcatataagtaattaattgttgtttctactggatcggtcaataggaaacggcccctgtaccagctggagtgcttatatggtactacccctttttattagcgtctctaccagactagcgatgtaccctgtaggctgaaaaccttcagaaaacgtgttaagttttagtgcattttcttcagacgtttttatctcctatcaccaagttgtcccacaaattaatactgcatattattaataagaattgtaaaaaaaatcatatcagtgatcaacccatttcgatacaatggttgatgtaaaaccaaaatgaaattgtcagtctttagtcacaaaaggttttagaaaaatagacgaagaggctgcaattttttgtggcgaagagcacttcaaaaaaaaaaaggggggggggaggataatcaatatattttcaataatgccaggaagaaacagaaacaacctataattaacttagctaaaatgtttcgtcgtcttgttcaatactagtcctacatatagctacatataacttaaacgtacgcatacagtggagcatacctagataccttacctgagaaatgactcctaggacgcctagggagaccttggcggcgtcaagctccgggtcggccgcggtgagcacccgcaccttggcgtacccgtcggcggcgggcgccggcgtgacgatgcgcatcccgaccacgtactcgtgcacggcgctgcctttcccccacagcgagctgccgtgcgcgcccgtgccgagcatgccgcccacggtgagcccccaccagtagggcgcgtacggcagcgccatcccggccttgcccgcctcggcgatgagctcccgcagcgatatgccgctctccaccgtcacctccatcctgccggcgtcgacggccaccacgcggttgagccgcctagtgctgatgacgaggccctcgccgtcgccgtcgccggggcaggccagctgcgggatgctgtgggagtacctggtggccaccttcatcttggtcccggacgctgtcgcgttggccacggcccggaccagctcctcctccgtagaaggatacacggcggcggccgcgcggcacgtcgaccggtccgggaagacgccgtacgcgctcgacacggtgcagtcggccgtgccgctgccggacgagcactgcaccgggtccggtggggggctcgcggcggccggcgcctcagccgcaggccacgccaatgccacgacgaggacgagcggcagcaaccgcacgagagtgatcatcatcttgttgtgctcgaggctcattctaattaagcgacggcagctgcagccactacatatatatgttgcaatcaaccattggtagcaagcaaagcagcttgcttccacgcctatatactccctccgcattataatatatgacaccgtttactttttaccaatatttgactactcatcttattcaaaatttttatgcaaatataaaaatacttatgtcatgcttaaagaatatttgatgataaatcaagttgcaataaaataaattataattatataatttttttaaataagacgaaaggtcaaacatttgtcgaaaaatcaacggcgtcataaattaaaatagactgatggaatttaatttttgtgtgatgaactagcggccgttctagctagtgacagcgggaattgatgataaatatatactccatatatatgcccaagcatcaaatttgcctataaaaaacatgtacttcattttttttttacagaatctgcatgcatgtgcaccaaagtaagtaaagcatgcaagccagattgcgatatatacgagtatatgaccaagatttgataactcgtaggagtgcaacaaaacatagcgtgtggtgaggagcttgctctacagaaactagcctggtactagcaaattgaagtagaggaaagcttgaagcattatcttcttctgctcatgtggtctataactagtcaggtgtcaggatgtccgttacaagcttgcaataaactgcttggcgcatctacttcatatttggggttgccacttttagatttatcaattaactatttgccacacctatctcagtgacatgtgggtccacatgtgtttatgacatgtgagtccagtggcaaatagttaattgccacatctaagagtggcatatagttcaatatctctcatatttgtgtctacgcgcgtacttcttcttccaactgggatcgacgttatctcttatatacgaaatgccatttaaactttctataaacgcttataagccatcacacactggtggagaaaccatctttggttggtcgacccaaatctacaatagttccggttggacaaaaaagatttttaagtcccggtttataagaacaacat

SEQ ID NO: 79290 - DNA, 15978 bp, Oryza sativa
gcatgaacatgcctgtgggccgtgtaaaggtactaatccctgggttggcacctagtgagatgctcaaggcagagttttcttgactcccaaccgatcacatggtgtctttctccacctcaattaagaggttggtggggagtttgagagcaacggagaaaaatctccacgagagtccacgatggccttttggcctctaccgttgctcagctgcgcactgagaacaggaggctaaaggacaccttgcccaaggacaaggtcgagctcgatgagcttagagttgaccttgcgtccctccgtcgtggcttttgtgccaagcattttcacttgtacaaggccgtaggaaaggaagacctctactgtgctcctatcctgataaggacacaaatagctggaatataaccatgactaccttatgtattaatcaaccaaaggttgctacacaatgagttttgtgtgtttttgtttgcagaggtacttgcttgggcaaaagaaaagagactgagtgtaaggaatgcatggatgattgaagaagttgattggggaccaagccaagaccttctccaagtcttgtttcatctcaccatgtcacttttggtccatagaagacaagagataaagttctacacgttttggattcgggttcgggcctcctaacagcatcaacttcaaacagatctagccactgatctagaaggaatttcggggcctattattacttgttcgaaagcttatggagtctactttcagatggttttggtcccatgtcaaaattcacaccgagctgccgggaaactgcaaaacaagccacgtatctcatccagtccgaatctgatttgggttttgggcattgtaattgtgtcgtgggcttagcccaatggggtgtgcgccctagggcaaccctaggatgtccctaatcatatttattcagtagccgtcaacgtttagagtcggtttttccttacattattctgttgagaacagttttgccgctagatcggtttgtaagaccccaacttgtgagcttaatcattcatccgcaattttggttgtattctatcttgttcttgtttgtgtccttcgattgacaaacagggattagccttctcgtcgaggtcatctgcgtttcgacacgggtgataaccagaggagacgtggtgctgcgattgcggggctcaagagcgtgcgcgttcaagaagctggatcgatttgtgtcgtgactccgcccaaatcgttgtttatcagaacctttcagaagatcaggaaccctagtgcatatcatatcccatagacattccctagttgttgttgatatttcttaacagcattactaaggagcttaattcatagcaatgatgctagaaatatgggcggtaattctttacgtttacaaagatgaatccacaagcgcacggatttactgatgtagtatttcacccgggagtatacccaaggcatcgtatttttaatcccaagggaagagattataagagagaactttattatttcatttcatgcctacgacagatcaaagactttgtaggggttaatgatatacatgcaaaaagggtaggttgacacatgaatcatcaagaaaaactattctgatactaaaagaaatagcttagtatagtggaaagaaactagcaaagaatcctatctgtacttcattaaaaagttgtctagtatacatttaatatgcactaatcgtacaaccaatacccttaactacgccctcctgttatgtcgagagaccacccttggttgctgagttccttatgacaactcgtcatggccatccaactggtaatgaatacagaggagtacctacaccaggaaattgtcttagtactatatacgcatgtggaggaatacccataccgagctatcaccatcagcggcctacctctactgtcccatggcatataatagcatttaatggtatccaataatctaagcatcacgcttacattactaaatactactccatccatgcatacgacatagagcaaccgaatggtcggacattaaactaataccaatgcgtatctctggtaagctacccatatgattaatacatattaaatttataccaaagcaagtaattaagctatataaatatagcataatactataactataaaaagaagaatatattattatataataaggtcttatgaaggaagagtaaactatttcaactccactctaactaaagctagaatataaactaagagagagcttcttggatttgatgcttcaaggtgtgtgttggagagagtgaggcctgctccttttatagccttccaatgacggcgattcctccgaaaagacttggagaacttcggaaccctactatttcaactccactctaactaaagctagaatataaactaagagagagcttcttggacttgatgcttcaaggtgtgtgttggagagagtgaggcctgctccttttatagccttccaatgatggtttcggcaattggaaatgtcataaacatcctccaaccgtcattgggaaatcatctgaagcgtccacgtggaaagggagcatcaacggccacgctgggggttcgacagaaccctggcctggcccaaacggcctacattttctctggtgcatctcttaatggatccttagtccagtgatatggtggttgggcctatttgaagttattttaatagatttgtaagcccatccatccataagtctgccactcgacggatttcgattgattgttcggttattctccttcatttatgagtgcttctcctacatatatgttattagtagcatagcatataatggaagtagatattttatttggaaattatgcattgcaagcataggtagtattcattaattgggtaatattgacggtcaaaattggtcgatgaccactgtcaacagttatccttagtattatgatagataagttaggtttaatttattctttcatttatttatttcgattctttcatgtaattgtggccattaataaagttgaaatagaataaatttgctgggcttcaccggatgagtacctttgctttcattttttgttgtcttttctgtctatgaagcaccccacgtacaacaacaagtgtggggttgaccttgtgctcacataatgcattcacgtaccaagatcatccacgtccgtgctaatccacgactcatgcacgttcgcgagatgagacgtagcaaccttgcatacatggctgcttatcatcacactcacatttgagcgatggtttgcacgtcatccctttatctccctaattcagttggattaattttgccatatttggaattaactcaagaatgaaaatgagtattgacataatcaactggaatatatgacttgctgcaaaatgacctacctactttttaatctttgatcatcccttgttacttgtgaaccacattcatgggaccacatgtcacctaagtgattgatgaatgagagattgcctgataataagaacctcactcttactgttggaaacttgggagttttataacaagaacaaaaataactttacatacttattgatgttttccttcctaccaacatcatatgtcagatcacattgataaaccttatacatataccacttgccatcattttgagttttgttagattcctttcatattttcacgaccaaagtcctgtgtacttatccaccaaaatatattgctctccctctatactggaggacttgcaacatatgccatccacctaccagatgctaaacttctacaccggaagtcggcatccaccatatctatccaccaaataaagacttcacatgactatgtttctccatcctcctatccatgctaaatgagacatgagctaaaaaaatgatcagtttttagaaaatcaaaatgctcaaaagagaattggccaatattctcgagcatgatgaaaaaaagaggatatagaaaatagccatgttctccaaataaagtatacacaggagaatcatataaaatgagtcataattccatttcacatcatccatctccctattccattccatccacatataagtgcataactttggtcatgttcatatgattggttatcttcttggatcctcaatttgactttataatatatctaatgcaagtctgtcatttcttactccctacccttagctccacagaagcctttagaaggtaggataagaaaaggcaatgtgaattccttggttaggaataaaaactttgagtgatttgagagaatcaattggggagtatagtacaagttatgtttttatgaacttcaaagaaaactacaatgtaatttatcggaaggagtaaaggccattccattcttcaatcagccaagatgacatagtagacacatcatgttcacaagtacagcttggaataacctatatgttgtgtcattaagcagaagtcattaccacattgatccatgagctttactcagggacgattaaagcataagcgtgggggtgttgttgacagtcgttaagtataaactttaaccgtcaactcatacataaaagatatcaaatataacatcaaaatttagtggtagggtttcactactaaccttttcaactagtcttggtaaaaatatttatgcaggtaattttgagagaaaataaacctgccatgcgacaaaatgaacctctggccaatcacacgcgagtaaaaggattggagggcccacgtgacaatggaaacaaacctaaagtggggccaaacgaacctctaccaccataggggcccacatgttagtccgaaagacggtcgagagaggcagtgccaagggttcggtcgaacctcaaacggtgcccctcatctccaccctccacgtgtggctttctagttggctcccaatgacggttgcgggagttaccgacctccccaaccatcataactccctataaaaggagcggttcactcacttccaaagcacaccaacatcaacagagtacaactcactttcgtaatttagacttcactttagtacgtgggattagtgacattgaggggaagctctgaatggagtgcccaaaagtattggagttctctccgagaatttctggaggagtgcccactactgcacaatacaccataggtaccagctagagacccattataggtgacggtttcccaactgataccaacttgagagtacctgtgcccgttggcataggtgccggttctagaaccagtacttatgaagattataggtaccagttctacatacacaactgacacttataatatttaaaaaaatcaatggctgccacgatggatacatcgcaggaacacatcatcgatggcaacggaggagtgcgacaccatgcagtgcaatgcgaaggagctagcggcacaacggagacaactaccctgttcaacaggaacacatgcagttcagaaaaaaaaatcaatctccaacagaaaaatgccgttgatctgttcatccaaaaattttagaagaagagcaaaatctccaacacatgcagttaaaaaaaatcaatatccagcgggtcaaaaaattaagcatgagcccatagcagcattggtcaaagtgtctagaggacatatgtcagtcaagaatgtgatctcataattgaaaaggttaattctaggtaaatggaaatgggaggtagaagattatggtgataactcttttcgcactattttttcttctactgctgaattaaaacgcatggtagaattgggtatagtgcatactaaggtgggagagactaaaatgtagattgtggaaagaggggttgagaatgaggttaagtatgttattccaaaagtgcctctacttcacgggcctcatctccaccgttaactacttgtgcatcgcttgcactgatttgttcgccgccgccgactggtgatctcacctctatacggaccacatcattcttctccaacgagcaactatgactgcaacagaaggacaagcaaaatgctctaagcttaccagctcaagcacgtggatcataccttcaatctggacttgttttggataaacgcaagtaatcaatcgagaagccttcgcatcgaagattgaagcactcagtagtcagtataggttatgaatcacggagaagactgcaactcgattatcaaggtctcaggggctactgtggaggagaagactgcaactcgattatcaaggtctcaggggctactgtggagaatatggatactaggtactcatacaacctccatattcgattagagataggtgataggccagatccatgtattatatagagtaggactcggttgcaatgttaccatgtgttctatggcaggacctagagtaccgagtgaggattatcatataatagattagcaaactaataccaaatccgattaggtttttcgattctctttgtaaccctatcccctacctatataaggtggatagggagccctccaagaacatatagcgagataagcactatcaaatcgttagatcaatatacaaccgatggatactatcggacttcctcaatcatgagtaaggtattacctctcatcgaaagtgtttggatctgattaaattattgtctttacatccatttaattttaggtctgccgatttccaaaatctataataataattgtgactgctgcactatacggaggctactgagatgggaaagtgttagtcacattgcctgcctatgtcgaataggatagtcatatttatacatttttttgccattcaagaatcatttgatttttcttactaatccattgtcatcagatgttgaacgggggcatagcctcaacttgcaattttttgaaaagaaaaaagaaacagcaagctttactggaagtgaagtgcaaacctttggaaaaaaaaaagctgcaactttcctgttttaaattgtgatatattttgctatcgccgcctactgtatgaatctaagggagtggcgttctgtcgaccgtctgcgagcgaatggccacggctgtgatggacagcgagttcggcagcctcgtcaaggtgtctgcggcggtgtgggcggcaatgttctacgcccgcctcgccgccgcaagccttcgccccggcgctccccgcctcgccgcgctccttcccgtagtcgcgctcttctgcgtggtccccttctccttctccaccaccactttccgcggctgctctgccttcttcctcagctggctcggcgtcttcaagctgctcctactcgccgcgggccgagggcccctcaaccccacgcatcccctccaccacttcgtcttctcggcctccctccccgtcaagctccggcacctcgcatccgccaagccggccaaaggtgtagatccagctccggccaacgagagcgcggcgggcaagatcctcgtctccggcgccgtcatccccctcatcatctacacgtaccagttcaagaacgccatgagccggtaccagctcctcatcctctacaccgggcacatctacttctccctgcagctcctcctggccgtcgtccacgggctgatccatggcgtgctcgggatggagatggagccgcaggtggaccggccgtacctggcgtcgtcgctgcgggacttctggggcaggcggtggaacctcatggtgccggccatcctccggccttcggtgtaccgcccggtgagggcgcgtctcggcgacgcggctggcgtcctcgcggcgttcctcgtctccgggctcatgcacgaggcgatgttcttctacatcatgtggcgtcccccgagcggcgaggtgaccgtgttcttcctcctgcacggcgtgtgcacggccgcggaagcgtggtgggcgcggcacgcggggtggtggcgcccgccgcgcgcggccgccgtgccgctgactctggcgttcgtggccgggacggggttctggctcttcttcccggccatgatcaaggctggcctggacgagatggtgctgcacgagtgccagggcatggtggccgtcatggagcagtccggccggtggctcgccggcgccaccaatctcaccttcgcgacacgctgaccagaggaaatgaaagaatgggacgtgagccacaccattactacgatctgacgaaacctgttgcatcgcgacgattctgacaggatgctgccgtttgtgattttttccgatttgggaaattaaatactcgagccgttcacatggccagcttggacagcactgggtgtttgcatcgtctgggggtctgggctgtgatgccagctagaattatgctagatcgatcgtgttaacaggggttaaagaagcattgattcggttggaaaatatctttaccattttttattgtacgttttcagctttgctatttatcaatccatttgattttttttcttattatcagccacctacactattagccctagttttgaacaacaaaaacctactatgttttcttgtatcaatccctgaattaaaagttggtatacacatttatagctagtagaaaatttcaaaatgaatttaggctaaaatagtttaatatctttacaaggaccaatagggtcttatcctatcagataagtagtagcggaaaccaaaatagtaataggcccaagcgacatgcccacaggcagttcattaggggcaggacctatttctcgatgagccctctgatcatctgctgagtatggcatattgttggcagagtctccctcttctactactgttatgtttaaaaagggagaaaatagctatgtgagtacatagagtacttgcaagctaccactgcaacatgattaatgcacattggatttaagaaagggcttgattcttttgctcaaaaccagctttcataaatattttaacaaacatttgacctagccattctaacaagaaaacaacggtaagttttcttgtttaaccattcactgagggttgcgtccacattcctaagtcttacttgattcggtttatccccaggcacatttatctatatttctgccattggaccctacactaaccctggctagtcccaccattcatccattcccattcacgccctaagtcaataaaaagtatataagtctagttaagaacagtacaaatgacggcgcaaatggctaaggtaccgcaatcttatggtggccataatcctctaggtctatgcccatatgcccatataggaagatacgctcgtacttagatcgtttccttcctatttttctaactcagtccttaactaaccagggtcagcactagcctttgctggaatccaaacaaatcttcttgttgtgattaagttttgtttttccataaacaacttcacatgtgtctcacaagatagtcgctaccatagcgatcttcccaaatcacattatcacatggctaggcatgtgtcaataatttgactacgggctttaatatatccatggttatcaaggtaaaggtaagcaataccaagatagggttaatcaataattaggtacgcaatttaaatatacttcctccgttttacaatgtaagactttctagcattgttcacatacatatagatgttaatgaatctaaacacatacatatgtctagattcattaacatctaaataaatgtgggcaatgctagaaagtcttacattgtaaaacggaggaagtagcatgcagtttatttgaaaacaaaatatttcgcaacataggtacaacatgtatcaatcctgattattttctatagatgttcacttttctgtagattaaccatcaaagtttgtgttctaagtgaatgtactttattttccttagcttatatctagtggccaaatctcaggttgattgtttgttgctttcataattaacaattcaatgttttatccttttgaatgatattttccatgcttatggaaggcttaatgaactgaagtttgtgttggcagtgatctccatcagatgtcctgtctcttcagcaggtcgtccacgatgcaatcagcacatgaggcaacagttccctccaacccacctgctgaaggcttggtttgcctaatttgattgctacatgcgaatgaggattacgccgtgtagattgaggtgcaggtaagctccatttcttgctgtcaattttttcatgccatttttgtgaatgctggcgatgggggatttttgttcatggagcaacaatgtttttattttccttttgtcaggccatatggagatgcagtcgttttcatttacagcaatcctcaaatccaggttaatattatgtggattttatctcttttgtatacattaaatatggcatctacagaaccaggattttacctctttttttcttgcttctgttaatgaagataagaaatatatcccatgtaatcaattggggatcaatgaggtttagtttgttgtactgctaatgaatgccatgtttaatttttgaaacgttacttgttttgttagtacacatgcatggggatgtgaaaagatgactataattgaaatgtatgtgctacgaacaactctccatcatcaccatacgtgatcactgcgaataatatcttttgataaattgatctatgaagtttggtcggttccaaacatatatattatcacaccattgatttaagttgatctatgaagaacatttctttcttgatttatttatgcttcctttcacaaatttttgaccaacatgatatgattagggaggtgataaatgctgaccaactgaaaaaatgtcactgtattctgcattttggctcagcttcatcgttgtcactgcagctcatttttcagtagatagaacatattgtcactacaaactaatgatgccgttagcgatcatccagttttgcaattcaatggtgttgttagtagtaatccattcaaagcataatgaaagaaaaaaaaatgaccatttgcataaacactaacaaacagttgcgtgaccatgacaatctgtaacttgtattttataaacaaattcactcttccgtagcttgtttcatgagtatttttgctttaagccatttttcttagagctttatccctatcactactatctaatgcttctaatcatccaatcgtaaactggaccaacaaagcaatgatctgtttgcaccaccgctaacaaatagtagcatcattttggataaatgaaaacatacctgaattccctctgcttataaaaaagagatagcgtggcttggtgccaacgtgcaagagcacacatttagcacgcaaggatggcaacgggatcgtaaacaatcctcggcgatatatatatgtttcttttttttgttactggaaagtatttgttgtatttgtcacactcacaccctttaatttgattttccaaccgaatctatttatgaactgtacagatgaagaatgtagcaaaacaattggaaggattgtgttggtatgcatttcccgtgatccactgcaccggcaccagcgacacgtgagatcctcactgctaccccaacttggaagatttgtgttttgcttcccagggttatgcctcaccagcactggcacctgcactagcatcaggtgagatgctcacagccattgcgcctgcaccagcgctggtgtccatgcatggattttccttgtttgctgtacttgtgtctccattgcttgatgtggcgcttgcagacgagtaatccctccatccctaactatttgacaccgttaatttttttaaatatatttgaccgttcgtcttattcagaaacttttgtgaaatatgtagaattatatgtatgcataaaagtatatttaacaatgaatcaaatgataggaaaataattaataattacattatttttttaataagatgaacagtcaaacatgttttaaaaagtcaatagcgtcaaatatttagggatggagggagtacaatccatgcccaccatgtgtttgtagaaatgccaatcaaataaaatgcattttattctccaaattcctaagctctcttttctcacacactcactccatgacaggtttcttaagacatactaattctcttggtatgcatttcatgtgttggatcagacttggtggcatgaaaccacaattcgaaggcatcattaaaaaaactgagtttatgatttgcggtaccgccacccgttgaacttggactgatcttatctctgtcacatatgtgcaccaaacgaattcagtttatgatcatcctaatgacagtagttggagaaaagagtatggacatgtaaaatttgcccctttgcattgagctatatattttcgcacaaaattttttacacttctgcttcaccttgctatgacctgtaggttgtcagccaactatgcaagttggcggtgccacactactgcaatggacacgcgccatctacaccattaacttattttcctgtcgttctccatttgccctgcggcaaggtactttatttatcggttatagttgtcaattgtaaatttacttgcatatgttgtatatgaagaggtatgcttgccgacattactaacttaagtttctggaggaagttagaagacaacgtgatagggagaggtatgcttccctcactgtatttattcatatcgtgcctagagttcagttcacaggaggtataaataatggaaaaagaaggttgaccgatctgattgaagttgatgcttgattctaaatgggatatgtttactgtgctctccagttcctcacaatttttaagcagcaatatgatagtatgctgtcatttctatttaagtaaaaaaaattgattactacctcgaaccacttgctttctagccttaatatggaccattatatctgcagtatatattagtgttagtttgacacctcaatcatattatggcctatggaacctgatttttggacttattgtgaatgtctcttgtggagatgacatatttcacaatctgtaataggtacagatatgtactgcaaaacttccataaaagcatcttcccaaatcccaacatatctttttctctgcagaacaatttagggcctgttttgatcccctagcaaaatttttcaccctgtaacatcaaatgtttggaaacatgcatggagtattaaatataggcaaagaaaataattacacaaatcacgtgtaaattgcgagacaaatcgtttagaccatggaactttaattttagttgttacctgaaaacttaattggtagtgtttacatcattacagaaatttgggttcaaaaatcttttgtgaattattgtttctttccaatgttacagtaagaataattattccatttgatatatgtcgacgtggcttgcacctacacactaaatagtttatgtacttattttaattattttcctcaaggaaaagtagtaagccactgacagctgtggtcggggtcaactattgacagccacggtggccagcgggcccacacatcagcgacacaaatcctaaacatggtttatttgctattcttaattacttaggacccacatgtcagtgtaatagtcttaatgaattgattaacttaattaccttcattagtcgctaatcaaggaggaccacatgccatacaaaggagagggatagggatttatgtcacgacacctgacatgcctggagatacataacaggaggtcgagccgaacatgcatatgaatgctaatccatcgatgctgcgcaagtctactcgggagagtaggcctaatagtaggtattattcaagtgaatggacccagtcgaaatgggttgggccatgtgtgagggagtgaggtccatggcgcgatgctataagagaccgatagggagttgagacagaatcgaacattgtagaaacatattctgaatactgaattcaaatctctccctgttctatgttgttcttccccaaatcccaaattccttgctacttctaccctcaattctgttcaattcttccttgttgcgacattgcaaatccagtgtcgtgacaaattggtatcagagcagtcaatcctggagaagccgcgctacacttcacggttgcaattgcaagtagtagcaatggagaaacagaatattgacttcggcaaaattctcggagaaattcaggaatcgctggtgtctctcaatagtcaataccaagcaatcggagactcaagcggctgtatcgaagttggatgtagggtgaatgggtggcgacctcaagtggaatccacaatctaggatttgcatgaagaggttggagatcttcgtcagcaactcgacctcatcggcaaatccaagcaggctgcttcgagcgcgtcttccccttgtgtctcattggcgggtgaggaaaggaaggaggctgctccgagcacgtctttccctcgggtcccgttgacgggcgaggaaaggaaggcgccattgctgccgatgccgccactgacaactcatttggccgcggcggagggtgggagcaaatgggcaatcggccaccacgttcaacctaatttccggggaaagacaccgggggccttagcgaccctgggtcaaaccccgggcaagggtacgtatgactcgaatcactttcagttccagaagtttgagcattcggggtttgatggtggggaatttgattctgattttggggagcgacaatacaattatagagtgccgaaattggattttcctaagtttgatggttctaaccctcaggattggcgaatgaaatgcgagcactattttgatgtgaataatacctttccggggctatgggtgaggatttcgatcatttatttcatgggtagagcagcatcatggctaagatcttctagggcgcatttgagatttccaatgtgggaagatttttgcactgcagtttctgaaaaattcgatagagaccagcatgaggctttgattaggcaaatggatagtataaaacaaactggaatggtgtgggagttttatgagcaattcgatgaattgatgaatcagcttttagtctatgacccctctgctagctcaaagtactgacacactgttttactgaagggttacgtcgagagattcgtaatgctgttcttttacaacgtccaaagaatctcgagactgctttggctgttgctttgttacaggaagaggtgctggagaatcctcaaaactctagcatcaaggacataaagaagtctgaaggaaattcagcttataagtctgctgtgaagggggcatggccattaccactaccaccaggaaaaggaggagttccaattgttggccgttctgaagacaagaggagcactaacagtgttcgtaatccgagaacaatgtctgataaggtggcagcattgaaaacttacaggcgggctcaagggttatgctatgtttgtgctgagaagtggtctccaagtcgtaagtgtgctccatcagtgcaattgaatgttgtgcaacaattgttcagtctaatcttggaagagaacttgcaggaaggaccggaaaattcagatcaattgaattctgaaactggggaactaatggcaatttctctgcaagcagtgtagggatctgaacctgatgggactatgagaattttggggcatgttcaaggtaaagaattgctgattttagtggactcagggagttcggtcagttttgtcagtacgcagttagcttctggattgacaggattgcaaccattggcacaccagttaattgtcagggttgctaatgggagcaagctgaaatgtgaagcagtaattcctaactgtgagtggcatgtacaaggacatgtattccacacaaccttgagagtgttgcctcttcctaattatgacatgatactaggtatggactggttgaaggaacatagtccaatgtcaattgattggtttaagaagattattgctctcagcttacaaggaactcaagtgacaatacaagggtgtagtccgaactggctaagtgtaatatgatttctgcaaatgaaatgaagcaattccattagaggagagcaatggctcatattgttcagttgtgttccataaatgatcaaaatgtatctgacgaa

SEQ ID NO: 79291 - DNA, 3573 bp, Oryza sativa
ttgggatttatcggcaacattactctttcagacatagatcatttattcaattgcgatttattagtttgaggggtttttttattccgataaattttcgttaccatattggcgcctgttcgttttcgctccgttttcggtttcgataatattcgattccgttttcgtatccgaggtttccgattccgattccgaaaaaaaatatgaaaacgaaaataataaagatggtttccgtccgtttccgtaccgttttcacccctagttaggggtgatgagcggtgccagttgccacccaaaatcctttgaagatgagatgcactactctgtttcaatcataactagcatggtggcccgcgcagatttcgcggtaattccgaatttttctgtaaattgtatttctatatagactctatgctcttcttccaatattatttatttttatttctgaatttttattatttctaattgtattcctatatggactctaaactcatctttcaatattctttaatttttaatttcgaatttcagttacttctaaattgtattcctatattgactttaaactcttcttcccatatttttcttaatttcaaattttagttatttgtaaattgtatgtttatacggactctaaactatacttttaattttattctgtttattccaaattttagttagtttaaaattccagtatggactctataatcaacttctaatattcctttttttaattctgaatttctattttttttcttaattgtatttctatatggactctatactctacttctaatattccttatttttaattccaaaattgtattatttcctaattgtatttctatatggactctatactccacttctaatattccttatttttaatttcgaatttctattatttcctaattgtatttttatatggactctatactccacttctaatattgcttatttttaattccgaatttcagtgatttgctaattgtatttctatattgactctatactctacttccaatattccttatttttaattccgaatttcagttatttgctaattgtatttctatactgactctatgctctacttctaatattccttatttttaattccgaatttcagttatttcctaattgtatttctatatggactctatactccatttctaatattccttattttttaattctgaatttcaactatttctaaattgtatttctatatagactctagtctcctcttctaatattacttattttttaattccgaatttcagttatttctaaattgtatttctacatggactctgctttttctttttctctgattaatgtgagaatttctaggccatgagagtgaacgtggaggcttctttttctatttctttaataatatgatagattttggaaagattctggtgacctcctgcaagttgctctgtggggaggttgctgcggctagggatgtcttaataaccatgcttgctgtatacatgtactaaaaacttctcctcacttaataatcggccagcgtacttttgccagacatatgaaaataaaatactttcagaaagatataaacaatgataactttgtaccagcatcatgtcatgtcaagaaatgacacaacagatttcactcctaatattttctttaatgagacatgggaatctttttattagcatgatggagaaaattatgtagcagaccctatatagacaatagaggaacggtggcttctggaatgtcaaaaccgatgaattgtcttttctgcaatttggcgaaaaacaaactcctaatgcacactgcgacagacagggcatatcacctaacagcatcttttgtcatgtccagcactgctaaaggctgtgaatactccaaactaaacgagctgcaccaatttcatatccgtcttctcctctctgccactgcataatctaggtccagtatatcaccaggaacgtgctcatcgtcttccttgcagccggtgatgctgtggctgtacgcacctaaggcctctggggactggggtgagtctttcttctttgccatatggacttaatatatcttctgctttcccttgttcaattcctgcttcctgtcatggttggagtcgatcgagacgttggctcactcagtcatcttcttcttgtactccagcagaagacgttgatccggctcatttcagcctcacacccagcaacacttcgccttccatgcttaagcaaaacctctcaacttgttgcccatttcttcttcgtcgttgcccgttgacccaagaagctgtctaaaggtaatcccattgttctagttctttcagatttaatatgttctagttctagttcttaccatccacatgatgccctcgccaagtcaccatgatatcatcatccaagatgaattggaactttgcacaccaaccaaataggggtagagggatcactgcactatatgaaatttacagcggttagtatcgaatatgattttatgaaataattgccttcttccgttcattttagtatgttagactgtgtattgtttgctgttaattagttagtcttattctcaccagtcctatatacaattatgtaattgtaaaagataaaccattctttagttgtagtcccatattaagagtagatacactacactacacagaaaaaaaacatacttctatgaatacctcacatgataagaatgtaatacttttagtgttggttatgtacctcatactgtgcatgatttgtccctagaactttagtttaagtatgataagctaattattgtattaatataaatggcaattcagtagttatacccatggatgtctattttatcaatacaaaagttttagtgaacattatatatttttcagatcatgctaacagatatcgtgcattccttgccaacctacaatgctgtcactttctgaaacgttaaaagtggatctcccttgctgatttttcctatggcaaccatattagattctttggttggatcatgtgccaataagttgaaagagattattactgaagaggtgatacttattctagggatacaagaagagctcgcagagttgcagcggaagactgaactcatacattgttgtattagtgatggctgtgatgctgaggcaaggaggatggaagagtcagcagttgacaattggcttggtcagctaagagaagttctatatgatattatgatgttgatgatattattgacttggctagatttaaggggagcattctactaactgatcatccttcatcgtcatcaaggaagtcaattgcttgcactggcctgtcaatttccacttgcttttctaatgttcaggcacgtcatgaggttgctgtgaagattagaagtctcaacaggaagatagaaaacatttcgaaggacagagtatttttgacactcaagagtacggttcctactggaagcagttcagtattgagagtgagaaaaagttcccacctacttgagcccaacattgttggcaaggagatcatacatgcctgcagaaaaatggtagatttagtgcttgaacataaggggagaaaactttat

SEQ ID NO: 79292 - DNA, 4877 bp, Oryza sativa
gaaagcgaatgtggtaagtgcggcccatataataagtggacagttcggcctcttccaagccattttcttctccaaaatgccggctcaatttatcagcgagaaaggtatctccctcgtagtatttgtaatgcattgaaacaaatcaaaacaaacacccagcgatctgtacatcatttctccaaattattgcaaagtttctatcacaagttccttcatcagtttatctgttacataaacctagtatacaacttttgatcagcagcttacggcaacaagcttcagaactcagaggcacagaacatggagacatgggagaagcagtggtgatgatgccgtcagatctggagcttgctggcgaggtaccaggagtgcattgcaaggctaccgaacgccatgatgttggccagagacgacaggccatggatcatcccgaacttcttgttcatggccgccagcgttgggttcgtcctcgccacctccgcgttcttcgaaaacccgacctcgctgccgatgccgaggtctttctcgatcttgtgccgcctcatcatcatctgtagaaagaagcctaagtcaaaactcaaaactgtatattgataggtactacaaaagagcaccctgaagtgaagcaatgttggggctacaggatgtttgttttcagcaatcatcattcgctgcaacttgtcaagagcataacagaagacgaatgttgagcactgaatgatggctcacaaggtaggagcaatccaaactcaaattcaattgaagaataaaggtatatctcttactgttctgcagtaacaccctgcaaactgccggctcacacaaatgattcaagactatgcaaccgtaagaccaaaaacatggtgtttgactacattaagccagaaacttttctatgttagaactataaaggtttacttactttcccaattcccaaagctatattgctaagctgattggaaactaagataagagcaagtgcccctgtgtcaagcacttgcatagttgcatgttatttagccggtgctagtgcgtgctacctatggaaaccactaccaggttactacatatgttcattcctgaaaataaaatgcaacaaaaagtcatttattccttaggcctcactgtcgcacttcagtcggactttttaatcaacatgaattgatccacctatactttatcgccttcaaaaaaaaatctacattacattacattacatggacatttacttatcaagcttaaatttcatgcaatgcaagtagagttaggtgaaaagcaaaaatcgtaacataaagaaagcagaaaaatggtaaaaaagatttacctcagtggtcatgggcgtgaaaaccagaaggttggaaaggtcaaaaccaagggcggagatcaagaatccaagctgatagcgctcaatggtagatgccgtcttccaaggatgtagatacgcaaaagctgccactgatatagccgagcatactgatatcaacatgaagtaggctgggaacattttcccttgtagactcccaaactggtgccttggcaaataccttaaagaatacatcaaagcaatgtcagtagccttattctgaaatattttggagtaaacaacttgcacttggtggatcaataaccaaaatagatgctgcatttctggttttaggtgatattttttctgcaaaatcacaaagcagcatgtactatgtgggtataataatacaacactgaaggcgcatttgaacaactgaacagatgacagtgctttctgaaatgcacactacgtattactctgaaacatgcagcttacacaataatccaacttgcttgcaaaaggcaccatgaacattggtgaaaccatgaaagagttctgaaaagttctccaggccaaatgccaaaatggtgagctcaagcatgacagtcacagcaggtttaaagttttaataagagaatttaacatctcaaatctctccattatccaaataaccaaatatacagtaattccaagttagaaattagtgttccatcctataggttgtaaattgggattctgtgcttacaagcatataaacacgcaatctttactaaaatgaaatcctagaaccaaaagtaaaaaactggatgaacgtttgggcaaggatactattctagggtcaaacccaaactgctaggagcctaggaacaaccaaattagcattttgagcatggccaagacagcaagactatgcaagctctccgcttaaatttgacaaaatctgatactgtttacaacatagtaacacttacgaaaaatctaacagcaacaataatcgacgtgaaaacccaaaattccactaaaatggagctgatagatagggaagcgattagagagctctttacttgaacatgacgatgccgccgatgaaggtgacccagagcgcggcgccccaggcggtggcgaagcagaggacgtgcgccagcctcgccgccgcgaccccggcgccggagcggccggagccaccgaggagagcgtccggcgcgaagagcacgccggcggcgaggaaggacactgccgtgaggaaccgcgccgcccaccccatcgtgcccccaccctaccaggctagggttcggattccgagagattgaatggaggaagaagaagaagagagcaaatctgtgtgattggaaatgaaattgaactcaacttaagcacagagtgtgaaatgaaagactagtcaatggagtactagtgcttgcttgcaaggaaagttctggaagcttatctagaacgcattaagttataatatttcctcattaattttataggaagcaatttaagttaattgattgattctcataatccacacaaattaacaacaaagaaacagagctttacttgtacagtactatttctactcaatggcaattctctgaagtctgaagttccaagagaggagtcagcgtaggagaacttgtgttacatgtgacagaaggcttgacctttttaaactccttttagaaatgatgagttgaatgaacactgtattaggcaggaatttgctcagttgaacctcatttgtttgtctgttttgtcatgaccaaacaaacctatgggctatgggctttaggctgtgtttggatccaaacttcagtccttttccatcacatcaacatgtcatacacacacaacttttcagtcacatcatctccaatttcaaccaaaatccaaactttgcgctgaactagtcacttagaaaaatttctaccagaaacctgtgggcagttgggcctagaaaaaagagcaacacacggttttggaccaaacagaagaaatcaaagattcagaactgcacaagatttggagtacgacaagtataaacagtgaacagcactagcaaaagaactgaccctgttcgcagtagaacatgaggtcagacctgcagtactttggataacattacagatcacagtacttacaatgcaggtagtccatctgccaaaatcaactgtaaaaatggagtgtattttggacaacagaagaagaacaagtaatgaatgatcttatgtatttcttcagttcaattgtttgaacctgaatacttgatcaattccaaatttccaatagcaatgtgatgcctttccaattgctctctctacctttgtagagacagtggcagtggcaccaacaataacaatccacaaatcatcatcaacacccaaaagatacaattccaaatcttgttgaataatcctatgcttttaattgatgagagtggctttctttctatacccctagctgctcgagggcgatggtgacggtgtgcgtgagctcgccgatgatgaggcggtgctcgccgacggggatccttcggaccccgttccggtcggcgacgctgagcccgtcgcacacgtcgatgcccatctccaccctcgccgtcccgccggcgcccacgtgcaccttctcgaacgccaccagctgccgcaccggcgcgccgtggcccgccgccgcctccgccgcggacgacgccggcgccgcggcgtacacgagcaccgtgtgcgcgccgtcgcgttctcccacgttcctgacgtcgacgtgcaccggcatcctcagctcctcgcaccgcgcgtgcgcgacgcgcacggcggcggcgcggctgaggcgagccgtggcgttgagcgaggcggaggcggaggcggcggcgtggtgggcggagaggcggacggtgagctgcgacggcgcgtgggcgatggagtgggtgaaggaggtgtagctgaggccatggccgaaggggtggatggtcgggccggtgtagaagcggtaggtccggccggggtagcccttggccggattggcgcgcatcgccatgttcgtcatcggcaccttctgcaggtaatcttgcgggtaccatgtcaccggcagcttccctcctgcaggaacacacaacaaaccaaattccaaattaacttgattaagatacatatttttttctcgatttctattagtatgctttttaaattgctaaacgatgtattttgtacggaattttttatgctgatgttattttaaaatattagagaaacgtttaggggtcttctatcttcgcaggtggtggcctaaatgatctgggtttgaagtctcaacccttctaattatttgatattagatcattccataatattcgcgtcttttgttttaaaatatcagacatatacattttttaagtttgtaataaattaaaacttaagtaatcttgtgttaatgactttatcattttacgtaccatcatttttttatcttcgttagattcaaacaagactttaatctcctttttgaaaagattagtcaaatttcacaatcaatctccttttcattggaaactaggggcggatccacaatgggggcggag

SEQ ID NO: 79293 - DNA, 20868 bp, Oryza sativa
ttaaaaaatttgtgatttattgcatgatctatgatgtatttgatttgtgtgtgatgtgaacttgtgatgtatttgcgatgaattttgtagaacttgtgatgtaatttgatttatgtgtaatttttttaggatttgtgatgtatttgatttgtgtgtataagtaactttaagatttgtgatgtggatttgggatgttactttgatttgggatttggagatatgcatgccacttgattcgggagaaaataaaaaagaaaaaaaaggaagaaaggggaccatctggactgctgttatcccctctttagtcccggttggtaacaccaaccgggaataaagatagggatctttagtcccggttatttcgttcgggactaaagatagcgatctttagtcccggattcatagttagggggttacgaactgggaggaaagatggtttctccaccagtgacatgtacttgtacaaacgttcgtagatcgtcatgtggcgttctaataaatttgagaaaatactaaaaatactaagaaagaaagaaaaacattcgatcgttgattttctcttagagcccctttgatttggtggaaaaacatagaaattttggagaatttaaatcctataggaaaaattccaatgaatgcttttgaatcaaagaattgaatcctatccaatcctttgaaattcctatagaatggacaatcctatagagattttggaggaaatttagcaagagctctatcctcttggaaaatttcctttgagtctatctcttttatccgattcctgtatttttttcctacagtccaattaaacgatcattgctgtgtttttttatgttttgcaatcctttgttttatacttcaattcctgtcaaaatcctgtgtagatcctcccttccaaattgtcgtcgctcgtatattctcatgccacaaaccccagatcggtcatatgaatagtaatagacgagaagccatggatttcactcatataagccattccctatatgatacgaccgtcgcatcctgactcatagtgttcaacacatcattggacagtgatggtcttcatatcttgatcgtgttttacggcgactagttttctttagtagatttaagatgaggaagatgagttcggtgcaatgctgtgtcgctgataaaaaagatgtgtttgggatatattcatagaggaatgcgctatgtcatacaacatataaggaaagagggcaaaataaaaacacgcagacaacgggaattggggaggaactgacatagctaaatttattatatcaaaatcttaattatattgcacataagtattcgctttgttttgtactataaggcacattttgtttcgttaggattaaggtttcgactcatagttactttactaacataatacaaaagtataatgataatacagatctaataacatcgattttctattgagaaagcaatcttatgttatccttatctattatatctatctatctatctattatatactaaaagtctaatgaaactttctacaaacactctcaagtcgtcacgtggtgctcctaaaaacgctcctaagtcgccacgtggcgcattgataaatcctaaaaattcttaggaaaaaacaaaacatctaaccgttattttcatttaatcgggtagacccattattttcaactattttacaaaattaccaaatcaaccaccgttagatctatcttacgagtacaaaattaccaaatcaatttatctctcttaaattatccctcggtccgtgtacctgtacagcatgtacgtttgtacgtacgtatcatcccaccgtacttctttttctatttttttctttcttatttagattagatgaaaaacgaaaataaataattcaagtccattcacaaccattgattttccataaaacatggtggactaattagatttttgttattaaaaaattgaaaggtccacgtgtgccacgtcctctcttccatcatgtacgtccgtacttagtacatacatgtatatatcggtccctctacccattcggttccctctctctatgatgtattattagcaatcaaatcgtattcacaatggttgtgtagagcctcacacactatatactacatccgtcccataaaaattaaatttttaccttcgaaccttttcccataaaagttatatttctgctaatgtgggacccagtaaactgattatatttccttgtaatcttctttctttccatctcatctctaacctattctctttaacattccttttaatcaagtttatacatggaatgtgtatatgtactgtgttcattaaatagggttattgaagtcatttgtctatcgtcctaatatgtccttaattccctagaaattcaatttttatgggacggaggtagtatgaaatgttcccaaatgaattatctatcatataatgcaaatattttggagtatacaaacccatcaatttaccatagccttatgtcccatataatctatttattaataaataatgagaatctataccaatcttacttgcttattgatagtttttttttaaaaaaaaagttgcacatagggtgtaatgatgtcactatttgtcatatcatgcatttgaacttaaaataatatttgtataaaataaaacaaaagtgtaaaatgaaccaattctagaaaaccttataatttcttagaaccattgtggttcataactttcccttaaattgagacaaccatgcataaccacttcatcattttaagtgactacatatcaatagacttctctctgttctatgccatagcagaagatagttggctttgaatattatatttcttactattaaatttgggttttaacactcgggtttgactaaatgtatttaaacaaatatatagatcacacatattataggaagcgaggtctagaatatatctactctatatttttattgattcatacataagtacgtataacaaattgcatcaaatgtgaaccaattaaaagaaggaataaaacacatttattataaataacctttttgagattttttttaaataagagcccaaaacatttaattaaaaagaaaaacaacaccttactttaatttggatttaaagacccacgtcttcttaaatgatgaagatgattaactttatagataggtgcttatatagataaatcaaatattacatattgtaaactaacaaatatcttaaaagaaacatttaagctatgattcaggaatgcccgcgcgaatgcgcgggctaccatcctagttattaaaacagccttgaaagaaggcaccacgttcgctgtggaggctagaaattttcacattaattggagaaaaagaaaagaagagttaaagtagaatacaacttagacatatctgaaattcggaattaaaaataagtaatattggaagaagagtcaatacagaatcaaatacgagattaattaaaattcagaattaaaaataaaataaattctgaaattagaaaaaagaaaaagagagttcaattagaaatacaatttataaataactgaaattcctaattaaaaataagtaatattagaaaaggagtcaatatacaatcgaatacgagaataattaaaattcggaattaaaaataaaataaattctgaaattagaaaagagaaaaagagagttcaagtaggaatacaatttagaaataactgaaatttagaattaaaaataattaatatttgaagaagagttcttatagaactgaatacaagaataattaaaattagaaataaaaaaataaaataaatttcgaaaatagaaaaataaatataagagttcaagtaggaatacactttataaataaaaaatatcagaataaaaaatatggaatttttaaaaattaatcaacctagaactcaacgatgacaaataacaataaataagggacaagtaataggcccgtaaaacagtaagatggtgaacggttgatgagaaatctaaaaattataaacaaaaccaccaatagaacccccaaggacgattaagaggtggtacgacagatagaatgttaagcagcatagacacgatggttggcgggacttttataaagtaaaaaataaatcgcaataacaatcatgttttatttttaaaatcttaatgataataaacaggggaggcaatgggtaggccatacaggagtataatagtgtggagccggcggcggttggcgggacttctagaaatttaaaaaatgagtacttaaaattcgaaataaaaaataaaaaaatttaaaaatagaaaaataattctaagagttcaagtaggaatacactttacaaataacaaaatatcggaatgaaaaatatggaattttttttaaaaaatagtccatctagaactaagcaatgacagataacaataaagaggagagaaatattaggcccataaaggagtaagttggtggcagttgatgcgacatctaaaaactataaacaaaaccacaaatagaatctcaatgatgattaagaggggggacgatagacaagccgttaagcaacacggtcacgatggttggtgggacttctagaaagtaaaaaagtaaatcgcaatgacaatcatgttcgattttgaaaatctcaatgataataaaaatacattagtatagtatggcgaagccggcggcggttgggcagatttctagaaaataaaagatgaaccccaacgatagttatgttcaatttttaaaatcccaacaacaataaatatgggagacaacaggttgatcatgaagaaatacaatattgatgtttgacaacattcctaaaaattataataattgaacctgacgagacaatgaactctaaaaactagaaggtgtattttttagtggtttaaaggaagataaataaaagccgtgatatattgggtaaacaaataaagggttgataaaagagtaagaattaaggactggtgttacttttaaataaaaactataaaagattaaggatgataagattcgatcttttaaggttataagacaacgtaatggctatttaacaaattttaagtaatgacaaatatagaaaaatagataattttatatgggtgctagccgcgcaattgcacgggtcacccagctagttagtaataaaaatacaacttattcttttaaaggagtgagagtatatatatatatatatatatatatatatatatatatatatatatatatatatatatatatatatatatatatatatatatgtatatatatatatgtatatgtatatatatatatatatatatgtatgtatgtatgtatgtatgtatgtatgtatgtatgtatgtatgtatgtatgtatgtatatgtgtgtgtttgtgtgtctaaatatatgacggccgttttgtacttccgggagtacgtattcttattatcatccgattgaggttttgatcttattaaggaaacatatactccctccatcccataatataagggattttgagtttttgcttgtactgtttgaccactcgtcttattcaaaaattttggaattattatttatttttttgtgacttactttattatccaaagtactttaagcataactttttgtttttcatatttgcacaaatttttagaataagatgagtggtcaaataatgtaaacaaaaacttaaaatcccttatattatgggacggaggaagtataatttaccgttgcgtgcatgcacacctgattccggattcattgcagcgattcgttgcagcggcatgtgattcaattcaacttattaaatgttaaccataggatgaataaccaacatgatccttgaactttcgcttaaggattaatttagtccttgatattttgtattgtccaaacaagtccctaaagtccattgtatgatttaatatagtccttaaaccctctaaaaatgccatgtgtacatgccacatcatctatgcaagcatattgaatatttaaatatccattctacccttacgttttcatagaaaataaagaacaactattgagaaaaaaacaaaaaaaaggttttggcaattggtaaaaagatgtagcattggtaacaaaaagaatttggcattttcctttgttttatgatggcttcttcttgtttttccctttgtttttttataaaaaatgtaaggttaaaatggacattgaaatgttaacttgacatgcatgaatgatgtggacatgccacatcgcaatttaagtggttccaaggactatattaagccgcatgataagtttggacattacaaaacatcaaagacgaattgacatctgaacaaaagttgtagactggactggctattcacccttaacaatattgctaatattccaattagcatatactataagttatcagatactactactctttcttttcttgctaactgcttcttagaagtatatgctacttacgcaatgcaacagtacatatatatatgtatatatacgtgtatgacgtgaccatggttgctattgatataaccattgctcacatcatggatcaacaagaattcatcacgatcaagtcatctaagtgctggaatctgattcggccacctactacgctgacttcaaacggccactccgttttcgggccgcgagtacttgatgaaaagctctcggagtcctctttccaatggatccagccacatctccaaattctatctcagtcagctgtaatcgtataaacaaggtgttacgtcacttataatgggcgtatgaacttgtaactttatttgggaccccggcccatgtggggtgcgccccaaccaggtggagctcgactctggagaccccttgatcgtcctcccacctccttaaatagctaggtatcccttcagggtttcttgggttttgtttagattaaagtttcgcttcgcaactttgccgtgtgatccactggtcgattagatcgtcgttttgctagttacggaatccgaacttatcatttgtgttcaattcctatttgcaatttagattgtttttatcttgttctgcttgtttcttcactttttttttgcaggaataaggttgatctgcaccggcaagatcaacaacccatggagggctgtattgatcgctaaggcggaacaccacaacatctcatacgattgtagtcgggtcgtcaacgtttcacctaaatcgtagttatcatcaactcatcgaaagatcggaccaatagaaaatagccagaaaatattgcacccattagaaaatagccatagaaaatattgcatccattacctagccatctttgtgcccgctgcattggtcttttaagtttttactttgttgagttttgcgttgcatcgtcgagtcgtgttactggttttagcgtctagttagtttgaagtttcgagttatggtcacgtttagtaccactgttgtcaccgccgccgtgagtttgttgtcgtcgggacctgcaaaaaggggctcgtctcaccaccgggggttcgattttggtagtttttagaaatttccatcggtccatttgggaattgcatgtaaggtttgcctagacgtctaggtctttgcagtgatcgagagcttctgtttttgcatgcgaggaataaggaaggggacaagtagattagattggatcggttaaaagttagtttccgtttatatcttgtgcaagtccgcactcgccgtccttcaacacaaagaaatggcacatctctccttcgaatctgatttctccgtctactctctgtttcaatctataacgtgagttgcccaacagcttggtggaattttatcgagtgtcggattgaagatctgtttgcaaaaacaaaacctatgaatgagagcatcccattttttataattttaattttaggtttgcacttttgcagttgagttcctataattttcatatttacgtttgagtccctgcaatcttacattaaggtacttgaggtctttttttaaaaaaaaatccaaaaaagagaaaaaaaagtagaaaggtgctaaaaaaagaaaagaaaagccaaaaaaaaaactactgttgcctctagctggatccgccgcaaggccgcatcgctgcaggtgcaggaaccacctctgaccaacacccccttttcatcgctgctctggatgccacaaccattgctccctccacgcgctgccacccgtgcccccgcacggtgctgctgcagcttgagctcctgcagaccaccaccgtagaactcgccaccgagaaggcctgagatgaatggataagtggactggaaatgtggggatagggtttgtatactaaggggcattttggtcagtttaggatagtaaatacattttttttcctatatgaaaccctaaaggtgtagtgaaaatagggttagatgattgcttcgattgtaatagttacaaacttataaaagtgggatcgaatgagcaaacttataaaagtggggtcagatcggtagttaggcttcaaaacaaggtcaaataaaaaatcgccccatatataaaatatattatttttgacatatggaaattggacaaaatattctaactagacccaattgtaatacttagcaagtgtaaaccctatacaaaatactacttggcccatctttcaaaaaaaaaaactacttggactacttgtcatactctagacttaaataaataaaactacttgtggtggagtcgcatggtcgcaacgttaccactgtagtcgtgcaagtgctgagggtcatccccatggaagagcacgtgttgcgggtcggtgccggggcactagtggtcggccatatccggaacaagagctggggttcggtgtagcgccttctccttcacctatgcagccgccagcatttattttcagctggccggcaccctggctagcggctcatctagcggagccacagccacgcaagcacccccccccccccttcttgcgactccgcttcgtggaactcctcagctgcctctttcttcacgcttccctccacagtcattgccctcttcattgtcatcggagttagagtaggagtcgttggagtccttcttcggcagggccctgtactatcacttgaagtcgttgtccctttcattttcgcctgtcattttgcatggcaatggaggctgtgctttccactctaacgaggtggtgtcgccggaggagctgccggtgtagccttcgtcctcctcctcactggtgctaatgtattgggctgctgcagtgattcgctaccgcaggattgtgggtggagaaaggtgagacataaagatggtgtgccaagaaaacccacattacttattgttgacggtcgttatcgactagtttcgaccgtcaatattacccaattaatgaagactaactatgcttgtaatgcattattccataaataaaatattctattccactatatgcttggaaaactaaccatgcaggagaagctatcaaaatggaggagaatcgacagtacaacaatcgatcaatcaaacagacactgccgagaatcagacgtgtggatagatgggctgagaactcagatatgacatgatcaaataagcccaaaattctctgttctgagttaaggggcaaacgaggaatccacctgccgaattgtgggctgattgggcctggctagggttcggccgaaccaccagctggcccaatccagtccattttccaccggcagttatctacaggtatcctatgatggttgggagcaattctactagtagaaaccgtcataagcatggacacatggcacaaggaggtgaaatatgctctttggatgcttcatcatgctacatgtcaagaggagagcaaagatgctcctaggatgcttggagcatctccacactcccaaggcacctcatgggctataaatacccctcctctcattcattcccacacacacatcaaaaagaagatcaagagctctctcaagtattgtttagtagttctagtattagtggagtaggaaatataatagtctttatagtcctcgagtcttcaggagaattcgggtatggctttagtagcttttctctcttcttttgtaagacttattgaattaatagaatattcttctttataccctttcgataatttattccattcatattacttgagtgccgactttactttatacttgaattaatatagtcgtgtaactagctttccagataggtgtattggtgtgggtttagtgtccgattattcggttgctctatgtcggttgcaaggatgtaaagtagtatttagtaatataagcgcggtgcttagattattagataccattaattggggttgtatattgcggatgagaggtgggccgctgatggtgacagctcagtacgggtattcctccgcgccggtatataatcctaagttaattctctggggagggtattcctccgtatttagccccggttgtacggtcatgacgggccgtcgtaaggaactcggcagtcaggggtggcttctcgaaacaccaggaggacactgggtacggggtattggttgcatgactgtataatagcaagtatagactaaagatgtatgtactagaagtacaagaatgatacttttcttattctttctccacttagcttagactatattttagtgagagtagttcttagttctttcttctgtgtgtcaccctaccctttgaactaaattaacccctgcatagactattagcatagtactctcttatcatatcttctcttgggataaaataaatatgataccttggaatactcccgggtgaaatgctacaatagtatatccgtgcgcttgcggatcacatctgtaaccataatataccaggaatatttctagtgctactgctgggaattatattttcagtagtgtcgctaagaaataccaacacttatcctctatttatagcacaatagttgttccatgggagctaagaaggtgcagcatggtagtggaggacatgaccggcattcggcagttcatcctccggggagaagtgactacagtccacgtgaaaaccaatggtagtggatgttgttgaagactttaaattagtggaagggaagaagaaatgacatcaacacaacatggaaaatctgttttatatggcagcgcgtagtagacgagtcatatgtgaactagctactttgtggggattgggggaaggattggacaatatgcatatgtgaaccattttgtaattcaggatgttgatttggtgatcgcaattgaattattttttatttgagaagttgattttgggattacaacgtgtcgacttggctcggctcggctcgacttggcttggctcgttagagataacaagctagctcgagctagctcgcgagctggtcacgaccttaacgagccagagcacatgagctgtgggcctgtggactgtggcatagctgcatagaatagaaggcccaacagcctaacttggcaacagaaaaccctagctagtgtcgatcggtcaataccctttcatgactcctcgagtcgatccccttctcgtcgttctcgactcctctttcgcactgcaccgccgccagccaccaccgcctctgccgcctgctctcctctcctcacgcgttggcggcgccggacttcttctctcaattcctgcatctggccatccttagccaccaaaggagcggcgccagcgtcttctctcgccgcccgcatccagccatcctcagctaccgaaggagcacgacgctagcgtcttctcttgccgcccgcatctggccatcctcagccaccgaaggagcagcgccgacgtcttctctcgccgttcgtatccagccgtcctcagccaccgaaggagtgcggcaccggcgtcttctctcgccgccgcatcaggccgtcctcagctaccaaaggagcaccatcctctcctcctctgctggctgcgactgaaatggatgaagaacaagaggtgctgctttgacttctgagttctgtttggatggttttgctcgcgagcctaacgagctagctcaagctttcaaacgagtcgagccgagctaggtttctagctcgttaggatgatgagccgagccgagctagctcgttaggagctagactaagccgagccaagctggctcgctatccacccctatctatgcctataggtattgggggcgatcggctcaatttgaaccgattcattgagctgcttttttaaaaaaatttgtcactcctcttcggtgcctgttgtcaatcaggcacagatgagctcaccctatcaatgccgaggtgcctatcccaaatctggtgtttatggggttttggaaccgacgcatattagtttttctgtagtagtagttcgtggtatcccttctttcttaaacttaatgccaaaagttcaaacctcatgcttccacgtcatcatcaattgtgaaccgttagatgaatgcattagattgcttctcagtcgttggatggaacgcaacatagagcccaacccatcaggcaccgggtgagtctcttcgcctcttcagtgtcaaatgtagcccacatgaacacattggcccaacttcatacacatctacatgtatccggcccaacaatccatataaaagagctttatggttgaatgcccattcagataacattacaatttgttaacttacgtcataccattttgcttctttgtagcttatgctttgaatgtgctgtttgctaaaaagattttctccaagaaaaccatttgtttcttctgtttcttcttgagattgtacctcctatctaacaaattgatgttaaccaagtcccgcagcaacgcgcggggcatcctctagttctatttatatgggtgggtatttaaccctcttaccgggtaaacattatgtagtggttatgtatttttattcgcccgtgaaattaacgttagggggcatgtgaaattgatttctctagtagtgtctgatgtattaattactaactcagcatcatgtttacattttcgagggcagggcataagcaagcactctgtagacactggttagctcttccaaagaaatatacatgccaccttaattgacagcttttttttttaattctcttgctttccattcaacagtttggcagtcccctgacgatggatgtgtaccgtagagtcagcaatatatattaatttaagtgattcgatcaatccgatccgctggatcaccgatccgatatgcatgtgtaccacggtgacgaactaattaatctttatatgtttagcactccctgatggaggagcactaatgcatgcgtcgatcatgcatagggatggcaatcgggcgcgacaggcacgggtagtgcctacccatacccatgcccgtgagattatttttgcccgtgggtatacccattactacatgacgggtaaggatggttgtccatgcccattgcccgcgggcaccttatgcccgtgggcgtgcctgtttacccgccacaacaaaagcagtggaacaaaaagtctacaagctactaagttcgaatcgaacttaaaacatcaaatattctccgcctcggtgtcgtgtctctcctctggcggcgatagagtaagaggagagaaataataagggaaataaaagagaaaccgtagaaaacaaagaacgtggcttatgtattctagtggattttgctcctaacctacatgtaagttagattttgcgggtaaacgggcaaagcgggcatgggtagtgattacccatacccatgcccatttatccatcgggcatagcttttgacccaataagatacccatgggtataaaatagagaacaaacccaaccctaatagggtttttacccgtgggtaaacgggcaaacgggcacaattgccatccctaatcatgcatatgccactcgaacatataagctagtggggttgggggtgtgccagcgttatactggccttttgaggcgacatggcatcattagcgtcacgagtggtgagtgcaggtgaaaaagcaagtcaaagaagcttttatgtggtcgatcatgtacaaaaaacttgctcacggctctgctaccagcttatacgagcaggggtgattgatattttgatgagtggaagataactacggtttagaaaaaaaaaaaaaccttgagctaaaatcgtacaatacgtggtcatgtttttccatagcttattgatattattatgtagatcaaccttattcctctaaacaaatcaaacaaataaaccataactagataaaagtaatcaaacttgtagataaaaatcaaatctcaccataaatcggacactcggtaagatggggttccgaggacgagtaactaggaggttttatcgacacgcgcaactataaggttaaatagcaatgattaaattttaatctaaacagtattaaaaaaagatttttgcagatagcacggaaagggttttcacgtgcggtagggctagccgtgcgtgctaaatggtatgcaaaaattgctatttttgcatgcgggtggcgcaaccgcacgcgaaaattttgattttcgcgtgcgggtgattacgtcgcccgtacgcaaaaataaaaatatgaaaaaaaattaaaatcctaaaaatcatgaaaccctaaccctagaagctgccgctgcgccatcctcgtggtggccgttgtcttcgtcgtcgcatcgtcccttgttgtcaccgttgacctcatcctcgtcctcatgggggtgtaggaggcaaggggtggccgggtccagccactcccatcaccgtcgccgaagccggactcgttgcccctgtgcctccccatcatcggatccgccgctgccgcacctcctcatcgtccgatttgccgtcgccagcatcctattgatggtcgttataaaccaatttcaaccgttaataaaactataataaaagagaattagttatgcttataatacatatttgttttagaataatatagttctacttgtgcttggagaataatttattgcaggaattgagcaaataaaataaagaaaaatgaggaaaactcacttccaagcaagcttatggataagatgggcccacaagtcaggtgtaaccgtcctgaaaactgcgtcaactacaataacagtcataaggacccacctgtcaatgacccagagaagtgtggaggcatgctgggccagcctaggttcggccgaaccaggggttcggttgaatcttggctgctgcggctccggctggccttacacgtggacgtctaggatggcttgctgatggtggttgccgggtagaatggtcatttcgccttttctacaaccttcataccgaccttataaatggaggagctcattttacttcacacacactcaagcaatctcaagattcctctctacactttagtttagtatttttagtgctaagtggagtagaacataatagttcccagagtccttggagtcttcgaaagagttctggtatggctctagtagcttttctatctgcttttgtaagactttcagtattaataaaatattcttatttatatacttcggtactttacttagtctgagtatcgactttattttacatccgtgtcgttataattatgtgggtagcctaccagagaggtgcagtagtgtgggtttaatgtccgatttatcggttgcactatgttcttcgcgggagtgtagagtagtatttattaatgtaagcaaggtgcttagattagtaaatatcattatctaggcatatatgccgcagggcagtagagttgggccgctgatagtgagagctcagtacgggtatttctccacgttggtatatattcctaaggcaaattcctggggagggtactcctctatatttagcccgtttggatggccatgacaggttgtcgtaaggaactcggcaacccggagtggtctctcgaaacaccaggagggcactgctaggaggtattggccacatgattatatactagcaaatgtagactaaagattgggtgtgtcacatcctgattttcgtcttaggatttataaattatttaataaattatttttacaatttatattaaatgttcattaatttacaagtaaagttaaatgtgggaaataaaatttcctaaatataaagcatagctggatttaatttttattaaattctccatggttaattataatctttggaattttctcggatttttcggagctcaattcctaattttaataatacaaagagcatttcagaaaccatttaaatattaaattagtcataaaatggtctgattataatcttgttaagtactttgagtgtccaatcagtttcaggattttccttgaaattatttgagcattggaagtacttttaacaattcaaagatcatttccgtgattaatttaattggaaaagtatttaaaatccccttctccttttcgggccgaaataggaaaagttcagcttcagtcctcggcccattctcccttcctttctgctggccttatccctcctccaaagtccatttgtggtccctccttcaatcgggcctagtataggaaaccacacagaaaagtctagtttgcgtccccgcgctactgttcttcttcaagctccagccgcccgtgctgagctctgtgctgccgcttcctccgttgaatccgccgcatcccgtgcttcgtttgcaaaattagttgaggggatttgtttcccttatcctcctctatcttttcccccaagaatcggactttatcccgatgaaatcaacacggaatcgagctcgattcgtgtttatctctccaaaccaaaccctaggttttcccggcgcgattacttgcgttccaagcccgatctctctcatccatgcctatataaaggatcccctagccgccctctttcgtttgccacccttggccgagctcgctgtcgcccgtagcgccctagccgcctccaccctagcgccgccgccgtcgtagccgctccagccgtgccgctcgtctccgtccatcgtcgccttcggtcgccgtcgacaccatcgggttcgcaaggaggagttgcacaccgtccacccctcggccgaagccgaagcccgccggagcgccgcggacgccgtcaagccgagcccgtcgccgcttcaatctcgtcgccggccgtcgtttgtcgtcgttcgtcgttgttctttgcaccggtgagttcgcgtcgtcgtcctcttcgtgttggtgtcttcggatagcccaaccgagctctctatcgccggcgcagttgtggtccagtgccatggctgcgatgatgtcatcgtgacatcataaaatcttttttttagtttttctgtattagatgaaatctgattaaacttcggaaattcataagtaaatcatcgtaactcggatttaagttgttcaagttgctaaattcatctaaaatcatgatctacatgtttgtttactttttatgtactttttatttggtttttattagtctttttctttgtgttgcgtgttagcttgtcgttttcgtcgttgcgaaggttcgtgagtgcgtcagaagagattcagaagactaattgaagaccgattattgcaaggcaagtcacatagatcccaaacaaccctttgagcatgttgaacccgtttaaagctaatgttttatttcaacttatgcattattttttgaatgtcatcgggtggtgagcctttctcaattaattaatggccgaagatgactttattttcctatgggttataatttgattagctagaaccttatatattagtttggttcaactaaatgctacatatgtaattgattagccatgcttagaaacattagctcattaatgagatgaatcatactacattattatttatgattatatttaatggtagctcacgatggttaatcgtgttatgataattaaatgataattaaaacctgtcaatggtgggttgtgagcacatggttttgaaggtcgtgttcatgacaattaaggaccggttcgcgagctaccgttgtgagacattaaccgtaacaaccagaagccagcgtgggtaacggctttaccttttgtatagcatgattcattgcggggtgccagattgagaagtggcgagaagtctgtgggggtcgctggggagtccatgcctctggttatatttatagagggggtgattatgatccaggaatggtgcactgtggtgagttgtgttgtgcagaaggtactgtcacagcctctattcgggtactttccagtatcgcgacgcatggaagacatgatgttgaggctgtgtcttgtgggtacagtggtacacctctggccagattaaaactattcgaatagccgtgcccgcggttatgggcgggttgagcaatgtttttcatgattagtctcacacctctcacaataattattgatgctataattggtaataatttgcttagctcctggtatggagttagatctgtgcagccgggtttggttgttcagaatggttgggcctgagcagcatgggtgtgctgttcagtgttgattaaaattgatgattactctactgttttactattcttaaatatttgctaaatactgcttttgcaaatgagcctatattatgcaatcctttggtatccttgtgcacttgcatatttgctgtgtggcttgcggagtatgtcatatgttcaccttgcaataatcaatcaacctcagttgaagaaaaggatccagaaggagaagacgtttggcttataccccagttgagctgcctgtgggagtggagctgaagccatcgctagaccgttaattccgctgctgttttcttttcttttgtaagtatgtaacgttattattacgatggatttgtatattaaattgtcagtttgtgtacctcggatgatttctggatgaggattttatgcacaaattagttcagaaattactagtgaatttccgggtgtgacagggtgtatattagaagtataggagttgagttctttctatttcttcttctacttagcttaggattatttatttgagggaatctaaaagcttcgcttcgtgtcactctacacatatattaaattaaccccttcttagactttgatgaaggcaagtaatatatatgtgtataattattagcatggttttctctttcacatcttcccttgggattaaataaatacgataccttggaatagttcaaggtgaaatgctaatagtggtatatccgtgcacttgcggattacttctataaccataaatatactagaactatttccgtgccattgctgggaaatgaatatttctagtaatatcgttaagaaataccaacacatccccaccaccagatctgccgccgcgccttcccaccatcatgcctcaccactgccagatccgtggctgccgcacgtgaggagtgcagccgccgtcggatccgcgtgggcgacggccagcagatgatggccgccatcagatctgcgccgtcgcacgcctcctctacccttcctcgttgtcccgccgcaatcgccactgtcgccgtcggagtggggagaagtgggggagtggggtagtggggagagagagaaagagtgcagggagagagttatgggagagagagaggagtggagattcagtaaaatgagagtgggaatctttggggtatttttgcatgcgggtgagttaagagcactgcatgcgtaaaaacccttacttttgcgtgcaaataatttaagcgggccgtctaaaaaaaatggatttttgcataaagatgtctgaaggagacacaagcacacacgtgtgtgaaagagatttagattgtagaaggcagaaaggctatgacgcgaccgcgcgagcggagtcagatgcgccccgctcgtgtgacgaggcccctttccttttttatcccaaatcccatttcctttctaagtagttcattttgtggtttctattttttttttggaaaaagtacaccgaaggtcccttaacttgtcatcgaattataaaatcatccttaaaccgcaaaaccggatacaacacatcccccaacttacaaaaccagtgtaaattatgtcccttggcagttttgactccggttttgtccgatgtggcagctgactcagcgtcggacccacgtggatcccacatatcagcctcttcttcccctctcctctccacctctctacctctcatccactttccacgggcgacattgacggagagcagttgggcatggtgcagcgcgcgtgggcggcggggtagcagctgggcacgaccgatggccggctggggaggtggtgggcacggccgacggccagcgggggaggagcggggcatggccggcacccgccgggaaaggagctaggtagcggcggcggggaggaactggatgcagccgccgcccggtgcgggaggttggagaggatgctgaggttggtgaagaaggcgatgacgaccgtggcgaggagcatgacgacggtgccggggcaggcgcggagctggccggcctcggcgacgtcctggcgcttccttgtcgtcgccgttgaaccccatgacggcagatgggcgggggcaacgctggccctagtagagtgatgatggcgagaacgcagtagagcgcggtggtaagcgaaggtcgcggtaatggggaaggaagagaggacgagaaccgctgtgaggaggaccgagcacgaggtggttcgtcggcgaggtgggggagagcaagcagaggacgtcatcgaggccttcgagcgggagcgctggaaaaaggggcgcctcggcgcaggcgtcacggaagacggtgtggagcacggattccgcggtgggaggaccgcacggcctcccgcccgccctcccctgtcgccgtgctcccccagccgcgcaccgctccacaccgctcccgacggctgcgcgcctgtgaccagctcctcccttgtcggtgtcggcgtgggagggtggg

SEQ ID NO: 79294 - DNA, 2238 bp, Oryza sativa
agctttgcattatgccatgaattggtatatgtttactagtcaaatcgagggataagacgacaaacaatgagtatgagatgccattgagcccgtgacggaggaaacaaaactcaagcatgtgtatgctcacccctttgtaaaggcaataaagcacgcagctggtttcacatcatggaatcttggaagcaaactctaaattaatcacatcgaaataaactgtaaactaatcacatcgccagagcccaggcgccagctaatcgttgcaatatactattgcagctgttgatcagtgccctagaatatgtgagtgtagctaatagaagtacgaaaaggaaaacgcaaagttccctactaatctgtaaggtctattagtaggaattaagtactctctcaggagcctcaccatttgcattctaacaaacctaacgttttgacaaagaccattgcgtttccatggtgttactagaacaattgcttcagcgctagtgtgcaggaaatcaattaccatttagtgatgattggggatatgaataagaaaaggagtagccatagctaactatacggttcatgaatatacacaaaatgttgggttgtgcagcatagacaagtggacaattacttaaaatttggtcagtgatagtaacatgggaaagataaaagaaaagaagagtggttcagcagttgtctagctagtctgaatgttcagctatacaatatatgtaaggccttaccaccttgcctaaatcactccctagcctcctgcagtactgttgctttgttccactgtgtcgcattcttacactgcatttctaccggctgtgggtaagctcaatacatatagctgaatttacttcctttatttccttaagttaatccgtaaatgctcatcttgactgcagggcacggattttcaacaggatcagttgcgtccatttctgtctgctttctgattgattgagatgagatctactaggaaggaaaaatctgcttcatctgagtaatcccatatatactgctcttcttgaagcactccttgatcggtgaatgtcaacacatcaaccagtatttctggtactctcccgttgattcttctagttaaccttctgaatcatttcagttgtacatatataatacacacttcacttttcttctgtcccctttttgcagttgtagcagtgcagtctgcggttctctcttgatgactggctcataatgttctgaaatctattctatactctggcttattcaatcagattcctttggtcttgattaatctcagtttattgagatcttaagcacaagatgggaccgagcaacctgttaacctgtgcaagatggttgctactatactactgatccttgttatgtaccatatgttatttttgtgctgaatgatcgctctgtaaggtaagatttgcatcccggcgaaaacgaaaaaagatttgcatgtgtacttcaagtttcgaatgcatcattctgtgatctttttttgggatgcagctagtagagtagtaggtagggaggtgtatccgccatgcaacttttaggttttcatgtgtgaagctacctaaataatatagaccctgtttggatgcttgggctgtggttacataaccataaatgtcaattttgctagccattagactcaacatgcacggtacaccgaattaagtggaaactcttatacaaagaatagatggataatatatttactgaacttcatcttgcattcatattttgtcagccttatctaacttttaaactatgttaacaaagtttggttacatgtcaggctgcattttttacattgatcaattatatatggtggattaccccttttgagtttgtcggatggcaacaatagtagacacattggttggatcatgcatcaataagttgcaagcgatcattacagacaagacaatactcattttaggggtaaaagatgagcttgaagaactgcaacgaagaacaaacgtcataagatcttctcttcaggatgctgaggcaaggaggatggaagattcagtagttgaaaaatggcttgaccagctaagagatgttatgtatgatgttgatgatattattgatttggctagatttaaaggaagtgtcctactgcctgactatcctatgtcatcgtcaaggaaagcaactgcttgcagtggcctttcactttcgtgctgcttttctaatattcgtatacgtcatgaagttgctgtaaaaattagaagcctg

SEQ ID NO: 79295 - DNA, 18948 bp, Oryza sativa
  unsure (1)..(18948): unsure at all n locations
cacaatggttcataatgatgttgttccttttacataaaaaggcaaaaacacagttggaaccgaaagtctgaaggttgagttttctcttgactgtactgtaacacttgtggtacattagtgaagtgcagaagtaatcggttcaattctaggtcagctcatggaagtttgtcacctcaaagtcttacagaattttagagattagccccttctaaatgtctataaataatacggagtagaatatgtgaagttggatgagggctttctaagaacctgatgttgttactgcactcacactcagcaacaacaaaattcttctattatcacttattacatagaaaactaagaaaggtaaatatatatgactatataagattctaatcagcttaccattcacggcaaaacttcatggtactcatggctgatgcctatctggttcttgcagatcttcctctccacgttgaaccctactaagctgcaggcaactgagatgcttctagtacttctcaagaaggagattaaaggtgacaaagagcaaatctttgttatctcaaagagtctagagaatgggatcacacccgaccatccagaccccaatcagttcactctgctttgcatctgcagtgtgaaggagccgggcaatagagacaaggacagagcattcttggagaatttggatcttgctagtcatgtcgcattctaattctagaatttatggctcgatgaacatatcacgaagtcttcaaaaactcttggagtctgtgccattgtaactatttctcatagaatattatacataattactggagtaattgcttagatgagtacttgttttcatgacttctttctatttgaccaaaatttatttcctccagtttgatagtacttctgcaagtttgtgttgttgataactatgccttagaatacctctgatctgaaaccatctggtttgattgaagtgttgaactcaatattgcacagaacatttactcctagaaagcattttactcctagaaagcatccaattggattgtgacatcaacaggagcactgatctaacattgtcccaaacagatatgtgttgatatcaaaagaattcaggtgttgctttcccgggataatttttggtaacacaatagtatctgaagtttactcagcagtacagcatctctaatttggtatcatgcgcaacttgtctgatctgtgagacagagagaagaagatgaaagagccaaagcacattatggaaagggaagactcgaagaacctacgtgatgcaaatcttcgccggagaggagctccgtggccagtcggcggagctccggcgagcggctgccatggcggcggattctctcatccaggagactatcgctcttgcggtcgggccgattaatgggcgtacgccggaagcgacgtaggcccatgttatatggtccagcaagggattccatttaatttgtgggcctggacgatactatgggggaaaaagtacaccaaaggtccctcaatttgtcatcgagatacaaaatcatcctccaaccacaaaaccaaatagcgggcatccctcaactaacaaaaccgttcactttacatccttcggtggttttgaccctggttttgtccgacatggcggctgagttagcgtaggacccgcgtggatcccacatgtcagtgtggccacgtcagctcttctctctcttttcccctcttctctcccttcctcatctctctctctctctctcacttctctgctctgcgttctgcgaggcgggagaggaggagggcgtcagcggtgatggcgtcgcgcgagacggacgggtgcgtgggggagggaggggaccagacccacgaagcggcgacgggggaggggcgtcacgcggtcggtggggggaggggttgcgcgcgagcggcggggcaaccgctgcttgtgccgctccagtgtgggtgcccctcccactcgcccaatgcatacgcgcctatgcagtaccagatcaacgccggcgacaccttctggattgtctccaccaccaagctgcagagcctgatgcagtaccaggccgtcgagcgggtgaaccccacgctggtacccaccaaccttgacatcggccagatcgacatgttcccctccgttccccgctgcgtgttcccctctgttttgtcgccgcagcgtggtcgtctccgattgctgccgctgcctggtcgcgggacggcgttggcggcaacaccagacctacccaataaactcttttttattttcaccatcaattcactaacaatggccaagctagcccgagcannnnnnnnnnnnnnnnnnnnnnnnnnnnnnnnnnnnnnnnnnnnnnnnnnnnnntgacgatgaggagagagatcacgacggcggcggcacgggtgccacggacgggagtgcctgcgtgagcgccgccatggcgccttcgccttgctcggcagtggcggctgcgagcgcgcggtaggcggcgggggtgtggcgaggcgcacgcacacgcgcgcgtgcgggaggcgaggcgaggatggcaccggctccaccgcgaccgccctcgcgcctagctcctcccccgccgccgccgctcagttctttccggtcggccgccggccacgccgtgcccagccgcccgcgccccgcctctccgtcccgcgcacgcccgtcgcccgtggaagggggattggaaagggcagtagagagaggaaggaataagatgctgacatgtgggacccacgtgggtcccatgctgagtcagttgccacataggataaaaccggagtcaaaaacaccaaaggacctattgtgaccggttttgattagttaagggacgtgggggacaattttgtaactcgatgacaagttgagggaccttcggtgtactttttccatactacggggacatgcggcccgtcagcacagctgcacagggcaggagcaaaacgaggcccaaagtgtatggcccatcaaagagtgtatgagcgcttcgatgagtcagtgagtgagtttcagtacaggggaagaataatttctagtccagttgttaattactcggaacagttgagatgaaactagagcactgaactgcaataactgaacacaaaactcgattctgatttcagagtccatataagagggttgatgatttgggggtgaactctaaagcataggagagttaattgcaactcaatctgctgttaattgcagttggcatttgaaattttccatttacaattttagccagatttgtgtgtacagtaaccattttgtggcaagaactcgagttctgaatcctgtacaggagatgtagcacataagccattgctagtagagcagattacaatgcgaaaaattaggaaaacagcttacatggaatattaggaaggttgaagtatccaaaaggggcactttttagcatcccatcaaaactacagttaattcaacaatatgacgggacaacaaggggaaaagctagggtatttgtcataatatctctcctgattcctgaaccaatcctgatgacagagtaacaagctgttctgttcagcgtttaaatggaaaaggatggactcaataaaaaacgatgttggataatggaaggaatgattttcttttctgttcatcaagatatacatggattttgtggtcataaagcatcatctggtggaggaaagagggccttgcacacaatcattgctgatgtaaaattcagttaaggtgggctgtaaccatcagggagactaaatgtaccgagatagtccaagagggattgcgtaattctacaaaagtggagacacaagatatgagggtgtggcatcctttctcattcatccattgcattctcaagtgtacaatcctcctctctactcctctatttatagccattccctcttccaccttccatatttagtgatgggcctaattagtgggtaaccgagccgggccttcatgggccggcggtttcctaacaatacacacagtcagtatggtactcctaccatctacccattgatccattcattcattcctgctcaatagaagtttgatgttctgataatgagctgcatggaagttgcagaacctgttggtgtaatatgcaactttatcagggaactgcttgtaattttgttgaataagatatgtatgtgtgggggtgctggccatgggtgatatatatgcatgtgaagatgaatttcgttcagatcattgctgtgagaaacactgttgattttcgtttaggatgctgtggatttggcgattgggatttgtctagtgtttacctgaacgccctgaattcgattgtaagatcttcctattcttaccataggtagcgctgccgagcgtctcgctttcgacgaccttaatcgtcttgctccacttccagtgtcccttgatcttcgcctcggggaagaagaaccctgcgtgacacaacgacttgaactcgcccattcctacccggatcagcattgcttgtttgcattgctgctggaccatttcctgtccaactctgtttgttgagaactccgctttcctgccaggcttaatgtgatcgaacattcagtggcaatttcagtccagttcagtatccgctttaaggtatctttcaaaaaaaaataaaaataaagtagccccctccaggtgcagtttgttattctgttccatgtttacctttttccagtcaagaaacttgcatggaggtgaagtgattatgtaaagattcactagagcaatgtacttcagtaattactgaccatcgctggaaatcattcttgtcaggacatcaagcacgcctctctgtttttctggtttttgccaattccatttttcatgaatttaaattcatcatttttatttgttgatcatgtgcttcataattatgttctgaacctaaatagcgtgatatgtgataacagatgttttctgcaccagttttgatcatgaaaaatactaaagcctccaacaaacagacttgtgcatttgtggtctccaaaatatcaactcttgtgatcattgatctggcactgataactgaaggatgtaggacagaccgacagaggagaatgaactgatgcatgtgttcatccaaattgcttttactggaaaactggactgtaatgaggtcaaactaaaatagtctagaatcagatttgttgaacaattaaacagagtggatgactctccataactattctgatccattactgaagatgaaattagcttgataaaagtgcagaaacttccaagaaaatatcaaatgatgtatttagcagcagagcatcatttcaatatagaagtatacaagattatatcccctcctcctttttccgggcttgggaccggctatgtcatttagttacgccttaagatgacataggcggagttacctacacacctacaataaaaaaagttttaaaagaaaacaaacgcaagcaaatataacaaattatatgaagatgtattttacaatagctaaagaaaatgctttttttttcaatttttgacatttcccctttttttgatgcttttgttttttttttgttttaaattttcatgttttgtgatttttttttcattttattctctgaggaatgactgcactccaactcttcaagattaacaacctacaaaacaaataagcacacaaaaattaatcacggatgtatatatactttatacatcagacatcagttttaataacttaattaaggaaataaatataagtgctatcagtttcgcaacaatcatatttcgtggaattaacttaccaaacatcaggcatgcattacaaaaagtataaggaaaagacacatatacagataggcatgtcggtaatatcctccgcttattttaactgatagaatatgaaaaaaaatattaatcaatttgaaccaatgcaaagacatttaggtggatacttttggcactaaacaaaccttaattaggagccctacagtagaaacagatgttgggcacaaccctttcatgtttaatatcctgctaacaggtcgcaaggaatctgtaacattgggcctaacctattttttgtcgtaaaaaaaaattattctataggtctaatgtcttgcaaaaattcatgtgtatatgtgtttttacaagatagtaaatgctatcttttgcacacatgcatgatctgatatagaacacacttgtgaaattgaaggctaaatgcatgtaagctggtctgcatcatagctggtacattcaagagtcaaattaagggttacttatctcttggcctaacgaagcccaatatgtttagtccctcacttttgcagcctatgaaccaaatgctaaaccatttatgttgggacaaatcattggatggatatatccatctatgatattcctattgacatatagtgaatagcaatgccatcatagcatgtttttggcgatataacccatacagttttgttttggagtagcagtagtctctatctctgtcttcaaatctttgtacactactgcatatgatcatgttgtagtacctataggacgatacacttatttaacataccatacaggatgttaataagaccatgagtggataaaagatatggtcaactaattaatttgttgatctatatctaccattttatgaaaatcttgaccacggtgaaatggttacatgcagcactaatgaaaaagagcattgctccggtcattctttttgtaccgcaaggtactaaaatcccatccattaatgatggcatatcgaatggtcacgattacatggtacctcagggtaccagcttgatcgtggggtagcaagcacgagtgagccatagtggaagggtataatcgtattttcgcgtttggaaggatgtttggatcggtggtttgtttggggaagtgccgcagagtagcaaaaccctaggcttcctcccgacggcggcgcgtggcggacaatacgacggcggcggcggcggcattcgttggtctcgatgctggcgtcttccccttgtcccatcgttttccccttcgcggcggcgcctcatccattcctctcaacgctgcgactcctgcgaccatgctgcggatggggtcctggagatccactgcagccacggcccttgcagcggcgccgagacgactcctgtgaccgcgatgatgacacctacggctgcagcgatgacacctgcggcagcgacaactcctgtggcgctggcgaggacaactgcagcggccacgattctgggacgattgcggatgccatcgcccttgctgcgtctgcctgcggcggtgcggccgatggggtcgaccttcacctcgacttttttctcatgtgccctgcggcagcgctagatgcagaaggagaagggaaagcgagagatatcgagacacacacgctatttggaccacacgtgatacccatcgtacccctcagcaatcaacggccggatggagactggtacctcacagtaccagtaccgcgtgctacaaaaggaaggccgggagaaaaactcaatgaaaaaagaactaaatcatataaattattaaacaatcacaattcacacaacatgaacaactaaggagactatcaaatgctagagtagttgcatacagctgaagagcagagaagaagcatggatgtacaacccaatgattagtttattccagtgaaaaatcccaaccaattagtgtacataccttgtgccatctaattaattggctcttaaaaccactcgttgacctccaacttatgctcatctccatggagctggcgatgttgctcctcaagccctgggacccacagtgaagagatcttctgcatattctttgacagccatagctgctccaaaccacccaacatctcaacatgcctcaaattcgggcaatgatttacaagtagctctctcacttggggaaggttggagattatctccaggccttgacaactttgaacaaaaagtataccagagaggaatgggaggtgttccaccatcttcaagcatcttgctcttcttatatcgagctccttcaagttggtggcctgctgtccaagctgtggtgggagagccctcagcttggggcactccacaagttgcaactgcttcaaacaaggcagcagccacgacgaccttggagttggagacggggcttcctcccccttttgcttcgaagcagcagttccatcctttcccccttcctgggctgctgcagctgctttctcctcctgcaactcttcttctttgacaaaggaccactcctcccagttgggcatatccttgatagccaataattcaagcctagggaaagcaactgtctctgtggatatgagattaccctcccagcagccaacaaattcgggtccaatcttggtgattgcacttgctccatcaattctaaggtatttcaagttggtagctgtccaattggtggaagatgcacacaagatttgcaatctttgagtttcaaatatgtcagtgaagataaaagggatgtactaagccaggtggggaaccttcgcccaaagaataatacaatcataagatcttctaaattgcgtggaggacttagctgctcaaagatcatctcgacattgctaatgccttcctctgagcatgcttcatcagtcggttcagtgcagcatagatgtagacttttaagatgctttttgtcagttagcaacaatgcatctgtactgctcctaggagttgctctttccaatttgttcaagtcaagccggcgtaactgtgaaagatgagctaactcctgcaagttccatccgtcttgcattttagtattgtcacttccacctccaacaggaaatccttctaaatcattgaggaattcaagtcttcctatccctcttggaacctgatttattggtgaatcatcaagaccaagccgccttaaattgcataaccgagtgatcatgctgggcaaactgtacaaagattcacaccgctgtaagtgtaacatctggaggttttttagagcaccaatagattttggaagacaggatatgttggttccactaagatcaagtaaacgtagatgaattaaatatccaacacaatctggtatttcttccacaagtaagtcagtcaagtccaaaacacgaagatacgtgaatctcatgaaaaatgttttctcaattcccagtggatttggttgggttctaaaagttctcaacttaatctcctccttacccatgctaggtatgactaccatatctttctcggtgatagctaaaatgcggcgcaatttacacatgttattatccaccaatgatgttggatctccaatataacattcttctcttgatagatggcaagcaagttgccttaagagatcatgcattttgcatttgctctgatcaaaagatgtgtcaaccggttggaggagattcctacttattagctcatagtagtattcttctgctgtatcttctagtagttgatctttgtgcacttctacaaagccttcggcaacccacaacctgataaggtaatcacggtgaatggtccagtcttcaggatatacaatacaataaagaaaacattgctttaaatgctgtggtaaatcatcgtagcttagatatagagcacctcttatttccttaggaagtttatacatggaccaaacgtaattagctaaaatctttttccattcgttctctgctttatctttgcttgccaaaactctagcaataaccttgattgcaagaggtagcccaccacatttctgaacaatctcaatccctatgtctcgcagattttgcacttctttctcgtcctcaatgttaatgctcttccagagtagctcccaaccaacagccggtgacatttggtcgatatgatgtggttcctcaaccccaatttctctagcgacagtatcttgcctagtagttatcaaaactattcccgaggttgcagcatacagtggagttcgtagtagattggtccacacatcagactgccatacatcatccaacacaagaaaataactcttatctttaatagccgattcaagcttgctttgtagctcgccaactgattcttcttgtttgcattgagcgtcgatggttctaagtagttgtcccaaaacagaggctggggagtagtcctgagaaacacagatccatgcatgtttgtcgaagctttgttttaatttctcatcattgaatactttctgagcaagtgttgtctttccgattccccctgttccaataatagcaagcttgtaagtcttcttttccttgtgtgtaagaacctggctcaccaattttctagaagcatgtaatatctctttccccacaaggttggattcagcaatttgagaactttttctcaattctgatgttgaatctttatgagatgactgtgtattctcaagtgttacaaatattttatcctttgctatttcttctagttttctgttcaggcttctaattttattaccaatctcatggtgaacccgaatgttggaaaagcaagagagaagtgaaagcccattacatgcaattgtttttctcggtgaacaagaatggccatttaatagcttgcttccttcaaagctaaccaaatcgataatgtcatcagcatcatacatagcatcttttagacgagaaatccaattgtgtattgatgagtcttccatgccccttcgctccacatcacttataaagcatcgtatttgttccattttttcctgcagttctctaagatcttcttttacacctaaaattagtattgcctcctcggtaatgatctcttgcaacttcttagcacatgatccaatcaaagaatccagtatggttgccatagagaaactcgtcgagggtgatgctccaatatatccaagtttttttttttggcgtaagcaatatatccaattaaatcatgcaagagtaataccgtctgaaaatggacaaaagttgaattggtttcagagtatctttgtagctagcaagttattttgcaatctgttttgagcaagtatatactgattactgaagctgaagaactgaaatcattaaggggtttacctttcggtggcttctttgtatcaacaggcaaacgagaaagaagtaaccggctcaaattgcggtgttaattttgctcaagttgacaaagctaacttgcttggtatgaaagccgagctgaggctgaagtgaatcggatcgacaggaacggcagtggagcaggcgggtgtcttctggaatgcaagatgatgaccgagcgagccaacgtttcgattggctagctcctaacgtgacaagcagaaaattgttcaaaccctatgttgtgagagaaaactcagctgagcctgagagcaaggcctttgatgcgtgcagccgaggcatcgccggtcacaaggaagacaacgagcaagttcccattatgagattatgtctcgtggactagatgggctggctctcttatgcagtgttcaaatagtacaatggctcttttatccgtctcaccatttatgtcccactgtgcatgaggagtttgttttccagtgtgcaaattgcacggaacaagacaagccatcttagataaagatgtttgaacaagtttgcaaattgtgcaaatggcagtctgatgtatgaacaagatgtttcagctgcatatataaatttctccatcgtgctactaaaaagattcccatgtcaggaaagatatttggactgaaattcattcagagtactccaccctagtaaatagagaaagaaagacctcctaataccgaaggtatcgagaaataccaaattttacattagaaaatatggtacttcttccgtttcatattataagactttctagtattgcccatattcatatatatatattaatgaatcaatatatatatatatgtgtgtgtctagaatgtgagcaatgttagaacgttttataatatgaaacggagggagtacctcctagtatctcttaaggattggggtgcagctcatcttcaaaatcttaattctgccctagtaagtagagaaaaaaaggccaagaatatttcaactcatgtaagtaagaaagaaagacgagatatagtgttatttctgaatctaatccattcaaatggccgtatgtgagccaagaggaaagtaacatggctagcagtatgttggcttcttgtcttgatgtcagaatcgatgaaccatcgactaaagaaaacgataagaacatttgacttgctgacttatatatgttaggaaacatacaagaaaggatttatgggtggctaggatcatcacccctagtgctgtcgacttatcaggttcagcttcaccatggttgatgctgatcagttgctcaccattcactgtaaaaatgatcaatgctcaccattggaccattttctgtccttttgtccaggactattctcctctgaaccgagtggttctgcgtttcgcaactgttccatctcttccgagtgaaataatattaccattctcaacttgtgcactaatgcacaaattgcacacaacatattgctgcacttgaattgcaggccgaattgcagcagcagccctgcttcctcgtcaagagatgttgagaactgcagttaaacgtattaacagattgaacatgaatatttgcctaacacgaatttggtcctgagttgaatttgattccaactgtagcattgatcgaacattctcccaaacagatacaggtttgatggatgctatgaattaaacagtgaacacaataaacagcagtgcagcatctctttcaattcatggtgttgatgatatgattatctgaactagtgaactctgcagaccaacgaacaaacaagagctcaacttctatcgaccaaactctcttcctaccagtttggagattgagattcctctgtaaatttcgctgcgccccgctggataaacaagaactgaacagcctccctgatctgaacgaggataggagcccaagaaccaacgggacacgaaccgcctctggatacgggcgccgagatttggggtttccggagggagctccggcgagcggctgccggttagttctcaagcaggagagacacgcgtcgttcttgcgttcttgccctcaagtggccccacgagtcagggagacattatatgtttatattgccgttgatgcgacgacggcaagcgagcgagcgctccgacgaggtaaatcgccgccgagtcccacgtcgccggcgccggagaacctcgagcacaaccgaggtacaggacccctcgttttcctccccctttttcttctcatcgctggatgcgctatagctgtgctttgctttgtgctgcgttgatcagtcacgataagaataatttgtccgttgtagatgaacacagaatgattcagatgaaaattcaaactgaatagctcaattgtgtacatgaatgaacacaaacctcgattctaatttcagagtccatgagaagcttgcagacctgcaggtcgactcgagctccccagcatcagtagtgagcatctttgaacataatgatcaaatgccatcaaatgaaatgtcaaaaccgaatatctcaaaccctatcgttgctagtagaacacattacactatgcaaaataaggaaatcagcttacacggaacattaggaagatgcaagtatccaagaagacactggtttgcatccccgtccagaaaatacgaaggcaataaaaccatggttaatttaacaatgtaatgggataacaaggtgaaaagctagtgcactgtcataataacattttcctgaaccaatcctaaagacatacaagctgttattttcagtgttcaaaaggaaaaaggatgaattcaatgaaataaacaaaagttggatttacttctcttcctcaagttatacatgggttccatcccacataagcagcagctggtggagaaagagccttggacacaatcattgccgatgcaaatttcagtcaaagatgtgttgtatccatctattaacacaggtattgattgtcaatacgaggtatcatcactgagatttcctcaagtactgaaacattgtcagtacaaaggaatgactaggaaggttatccaccatttcctctcctctcgatcacaattcacaaagcacaatcagtttctatcatgatgggaggataaatatatttttgcctcagtgatcttcattgatttccttgtcctgcaggcttgtcattaaggactgacaggagaatgattggtgcttgggtttagcccaattgcttctggtgaaagaaggggttgaaatgagctcaaactaaactggtttccaactcaggttcgtccaacagagaaacagagtgtatgtgcctctgaaagtgttttcataattattccatcacaaaaaaaatgcagtagcctgacaaaggtgcagtttcaagaaaactttcaaagacctggtagcagtagactattccgtcattgaaaataagactggatgagtctctagaagtgtctccataactattccatcattgaaaatgaaattaatctgataaaagtacggaaaaatcccaatgatctactatatagtaggagagcgtcatttcaaccaacatctatacaagattatcccctcctcctttttccgggcttgggaccggctatgtcattcagataaacctaagatgacataggcggagttacctacacacctacaataaaaaaaataaaaagaaaagaaacgcacacatctaagaaaacatgacgatgtattttacaagagctaaagaaaatataaccttttttttgacattttcccattttttgatatttttgtttttttaatttttttaatatatttcaaagaccagtagctaggtaaagacaaaagtacagattacaggtgactgcagcccaaattcttcaagattaacctacaacacaaataagcgcacaaaaattaatcatggatgtatattcataagcaatttggtaattaaataacttaattaaggaaaagaaaatacaagtgacatccgttttgcaacaatctattttctacaattgaacttaccaaacatcatacgtgaattacaaaaagtataaggaaaagacacatagggactatacataggcatgtcgctcggcaatatcctctgcttataacagatgtaatacgaacaaaaatattaatcaatttgaaccaatacaaagacatttaggtggcttttgttttttcaccaaacaaaccttaattaggagccctacactaggaacagatgttgggcacaacccttccatcttcaatatcctgctcacaggctgcaaggaatctgtaacattgggcctgacctattttttgtgaaatctaaaaaaactactctattgcctaatgtcttgcgaaaattcatgtgtatttgtgtttttataagatactgagtactaaatgtgcacattgatatgacatagaacacacttgcagacttgaaggctaaatgcacgtgatctggtcttcgtcatagatagcgcatttttaaataatggattaaataaaacccggcctctacatcccgaaggatgtacacggccaatcatagctagcacattcaagagctgaattaaggattacttatctcttggcctagcgaagtccattatgtttagtcgtgcacttatgcagcctgtgtaccaaatgctaaaccatttatgttgtccccaagtccttggatggatatatgcatttgtgatattactactatcatatagtgaatatagcaatgccatcatagcattgtttggtgatataacccatacaattttcttttggagtagaagtaatctctatctttgtctgcagagctaggaacactattgcacatgattatgttgtagtacatataggacaattcatttatctagaatacaccgtatgtacaggacgcatgttaataagatcacgagaggattaaagaaatggacaactaatgaatttgtcaatgtatatccaccattttatgaaaatcttgaccatgatgaaatgcttacatgcagcataaatgaaaataaaactaaatcatataaatcattaaacaatcagtcaatgcacacgacatgaacaactaaggagactatcaaatgctagaatagctgcatatatacagctgaagagcagaggggcagcatgaatgtacaacccaatgattagtttattccagtgaaatgtcccaagcaattagtgtacataccttgcgccatctaaattaattgggtctcacagccactcgatgacctccagctcatgctcatctccatggagttggcggtgttgctcctgaagccttgggacccacagctgagagatctcctgcataccttcatccagcaatagctgctccaaaccacccaactcctcgacatgcctcaaattggggcagacatttagaaacagctctctcacttggggaaggttggagaccctctccaggccttcacagccaccaattgaaagggcaccagagaggaacgggaggtcttccaccgtcttcaagcattctgcttctcttataaggaggtccttcaagttggtggcctgctgtccaagctgtggtgggagagccctcagcttggggcagcccacgagatccaacttcgtcaaacaaggcagcagccacgacgaccttggagttggagacggggcttcctcccccttttgcttcgaagcagcaattccatcctctcccccttccttggctgctgcagctgcttcctcctcctgcacttcttcttcttcaacaaaggaccactcctcccagttgggcatatcctcaatgaccaaccattcgagcttggggaaagcaactgcctctgtggatctgagattaccctcccagcagccaacaaattcgggtccaatcttggtgattgcacttgctccattaatttttaggtatttcaagtttggtagctgtccgattgggggaagatgcacacaagatttgcaatctatgaggagcacgtatttcactgaagacaaatggttactaccaagccaggtggggaaccttcgcccaaagaaatccccgatagcaagaacttctaagttgtgtggaggtgctagcttctcaaagatcttctcaacattgctaatgccttcctctgaatatgcttcatctgtctgttcagtgcagtgtagattcagaactttgagatgctttttctctgttagtagaaatgggtctctactgctgcaaggagtagctctttccaattttatcatatcaagctgcctcaactgtgaaagatgacccaactcttccaaattccatccatcttgtattttggtattgtcatttccaccaccgataggaaatccttctaaatcattgagaaatttcagtcttcctatcccttttggaaccaggtttattggagtaccagcaagaccaagccgcctcaaattgcatagttgagttgttgccaaaggaagtctgcgcaaagattcacacccctgcaaattcaatatttgaaggctttgaagggagccaatggcctctgggagagaacatatatttgtcttgtcaagatcgagcaaccgcagataaatcaaatttccaatcgcacctgggatgtcatgtacaagtgagtcagacaaatccaaaatgcgaagacatacaagtctctcgaaaagtgaattatcaattcttgctgacttcccagataagtttgtaaaacacctcactttatattgatccttgtccatgctaggtaacaccactatgtccttctcagtgacaactgaaatacgccgtactttgcacatagtattagtccctagtgactctgggtctccaacaaaacattcttctcttgacaaataagaagcaagttgccttaagagatcatgcatcttgcagctgctgtggtcaaaatataaaccatctggttggagcaagttccgatggatcagctcataataatatctctctgctgtatcttctagtaattgtcctttttcctcatctataaagccttcagcaacccacatcctagtaagatcgtcacgcaaaatgcttgcatcttcagggaaaagtgcacaataaagaaaacattgcttcagttggtgcggcagcacttcataactcagatataaagcaccacttaattcacgaggaagtttgctcatggaccaggcatttttccccaatatccgtctccattcattctctgtttgttcttggcttgctaaaactgtagcaataactctgattgcaagaggaaggccaccacatttgcgaacaatctcaatacctatgtccttgagattttgcacttgtttctcttggttgatgttcatgctcctccaaagcagctcccatcctacatcagctgacatcaaatcaaccctatgagtgtggtccaccccaattactctagcaatagtgtcatctcgagtagttattagaattactcctgtggcggctgcatgaagtggagtgcttagtaaatctgtccatgcttcagagttccacacatcatccaacaccagaaaaaaacttttatttgcaatgtgtgatttaatctttctttggagctctggaactgattcatcttgctcatatcgaattcccatattacgaagaacttgtctcaaaagagaatccctagaatactccttggaaacacaagcccatgcatgatggtcaaatctcccttctaattttttatcattgaatattttctgagctagtgttgtcttaccaactcctcctgttccaacaatagcaagcttgtaaacattctttttcttgtgtgcaagcaccaaatccaccacttctctgcaagcacgtatgacctccttgcccacaaggttgggttcaactaggctggagctttctattggtgtccatgctgaaccacttccattatgatgtctgcggttgagttttaaaaatacctcatcctttgaaatgttatcgatctttttgttcaggcttctaatttttacagcaacttcatgacgtatacgaatattagaaaagcag

SEQ ID NO: 79296 - DNA, 16105 bp, Oryza sativa
agggggaggaagccccgtctccaactccaaggtcgtcgtggctgctgccttgtttgacgaagttggatctcgtgggctgccccaagctgagggctctcccaccacagcttggacagcaggccaccaacttgaagaaactctttataagagacacaagatacttgaagacggtggaggacctcccgttcctctctggtggccttcaagttgaaggatgtgaaggactggagagggtctccaaccttccccaagtgagagagctgtttgtaaatgaatgcccgaatttgaggcatgtcgaggagttgggtggtttggagcagctatggctggatgaaggtatgcaggagatctcttcactgtgggtcccaaggcttcaggagcaacaccgccagctccatggagatgagcatgagctggaggtcaccgagtggctctgagacccaattaatttagatggtgcaaggtatgtacactaattgcttgggatttttcactggaataaactaatcattgggttgtacattcatgctgctcctctgctcttcacttgtatatatgcagctattttagcatttgatagtctccttagttgttcatgttgtgtgcattgactgattgtttaatgatttatatgatttagttttattttcatttgtgctacatgtaaccatttcattgtggtcaagattttcataaaatggtggatatcaatcgaaggacttgaggtagttaggaagaatcattttttcacttttggtacacaaactgcataagtaaaggagacatatgggccaagaaataaatatcatttagttcagatgcagaacagtttacttgcatttagccctcaatgacccaagtgtgttttgtatcgagattatgcatgtacataggagacattgaagggagcacatattatcttgtaaaaacaagtagagacgtcaatttttcatgaaatatttcaactgtgtaatatattaggcatatacaacggtcaatttagacttgcaagcgatacaacgcccaattctacagattttcggcctgcagcctgttggcagcaggacattgaacacaaaaggggcagcgcccaacatctgctcctaggccactaaggtttgtttggaaaataaaaagctgcctaaatgcctttgtatttgttccaattgattaatattttagttatatccctaacaaataaaataagcagggtacattgccctgcctacatgcttatgtgtagttcgtatgtggctttttcttagactattttttttcttgatgtctagtaggtttaactccagaaaacatgattgttgcaaaaactgatcacacttgtattttattttccttaactaagttattgaagtaccaaattgcttatatatagcgatgcttaatttgtgtgtgcttgtttattttgtaggttgctaatctcgaagatttgggcagtgcaggcactttcttatttatttgttatctttacctagttaccgatctatggaagatttaagaaatccaaaaaaaaagaaagaaaaagaaaaatccaaaaaaaggtaaaacttagcaaaaaaaaagaaaaaaaacaggggcatttgctttacctcatgaaatgtatttcatttttttttatgatttgtgtgtgtttcttcttcttcttcttcttcttcttcttcttcttcttcttcttcttgtagctgtgtaggtaactccgcctatgtcacttgaggtgtgattttaatgacatagccggtcccaagcccggaaaaggaggaggggataatcttgtatatatacttgtctagtgaaatgatgctgtgctgctaggtggatcattgaaaattttcttgaaatttgctgcattcttgtcaagttatttgtatattcaattattagaggcacatccactctgctgctcgcctgctctattggacaaatttgattctaaactattttagctcaacctcattacaatccagttttcaagtaaaagcaattgaacacatgcaccaattcattctcctcccagtcccctgtttgagagttgagaattgagctactgagatattttcattagtgatatctactgcactgtgcaacctcattacaatcacaggcagaaagatgatatgtctattagtactccttgttctttattttttcactttcatgatgtgtgaccaactgatggtgaaccaattccttctactttcacttttcacttagtggctttcaaaagcatagcccagatgctattgggacatgttacatgtaccgtttcacttcaattcttggttcctgtaaatggtcccttctcctatgccactatggcaccatccactagtaaggacagaagttagctccaagaaaactactagtggtactatgtatttatggagcagtgttgtaatgtcaaagcaagaaaactactagggtgccacttctgtaaatcagtatatgaacttccctactgaaaatgctgaacaactatttgtctgcaacagcgaaagacgcaaggtaggtacttgggtagtgttgtcctatgtcaatgcaagttaataattttatgcttaagaccgattcccccgcgtcgctctcgtgcgggcggctcggggggcgaaaaaaccctagccgccagcgcctccacttcctctccgttgcctcgccggagtcggagcttgccggcggcaagccggcagcaagcacggaaggcggcggcgaggctctccctcttcttggcgtatcccaccccggcgcgacgtggacggggcgcagccgacgaagaccctcaccgcggccagaggtgtgacggtgggatggtgtggggagacggccgccaaggctggatctggccaccccgcgcacggatctagcacggcggcgcgcggtggctgggagcggcggcggcacggcagcccgcagctcggcacggcagcccgtgcaacggcagcgcgacagcccagggcggccgcatgcccgcatggcggccctgcaagtcctcgcttccggggtgccgccacggtgcccttcacgaccaggtgggcggcagggcgcggtagttggacaacggaggcgtcgacgggttgcgccagagccggagtagcagtagcgtcaccgtcgtcggtgcaagcccagatggctgtgtaaagggagctggcggcggtgggtcatcttcctcgttgccggtcggcaccctcgcccttcctggagctcctccccttctttgcggggagtttctaggttggattgaggcggcagctcgtaagcgggggaagctcaggctgccgaagcaatgccacctagtcctgggttctccttcggccaaaactagcgaggcggccggtgggtagtggaacggaggcgtcctaggccagctctcaggggtggtggttcgatgaagtcggccgacggaggggcgtcggtgcggtgtggtggatgctgcgtgctgccatctgtctgtgtgggggttctgagttggtggacggcgatccgcagtcaagggtgtagggtatcaagcgaaagcctagtccggtggttcaccgggctggcagcggctatgtcttcgggcgttgtaacctccttggggcgttgtcgagggttaccctctcctttgctcgacgagcttctctgagtgaaaaccacatcttttttagatgggcgatggcggtatccttggatgtcgtgagcaccgtggtggcatcgttttcaaagcctcgtctgtgtggtgttgccgtaggcctagcggcgttcggccacgcttagcgggggtcgtttggtgctaggcttcaccctagcggtttgtgcttgggtggtagcgcgtggtgtatggcaatgcaccttggtgtattttgatgttttttcttgtaacttttactccttcttaatatacccggttggcctccttcagccttcccggtgaaatttttttttttatgcttcaatactgtaaattttgcacccaaactgcagaaaacatggagatgattccacaagtccacttccgaaggttcctagtagcagtgtgttgcctcatgtcatcatgtatgaatccaccgttctgcattacttctgtccatggccataagcacaaaaaggccacttgcaagcatgcaccactcaagtggaaccaaactggatggcttcagctcatggaattcagcagttgtagatgtaggtttgaagctgaggctacactgcacaacatgtggtactgactgcatgtagaacaggatactgtatatgctcaaacagttggtgaagtaatgggagcaggaatgaatggagggatgataggagtaccagactgacagtgtatctgttaggcaaattgagtcatggactatattgagtctctctgattgtatacagcacatcttgactgaattttgcatctgtaatgattgtctgcaaggctctttctcccccaccatgctgcgaaatgcatgtatatcttcagaaacagaaaacaaaatctttccctccgttatccacctttgtttttttattgaattcatcattctacatttaaacactgaacagaacaacttgtgagtcatcagaattggttcaggacagatgtgatgaccagtgccttagctttcctcatagctgtcccactaaattcttcaaattaaccgtaattttgatgccttcatatggtctgcaggggatgttaaccagtgctcttcttcgatacttgaaccttcctaatttttcacactgtattctgttctactagcaatgccttcccttccctgattcatagctcgagttgttgtctcaaactgatttctgtacagtgtacacataattctaggtaaaattataagggccatcagagattaatagcagttgagagtagctgatggaggtgtaatatggctcttgtattgtatctgaagagcagtgtggcttgtcagaagtactctaattgcacttccagtttcacacacttatctcttatcaacgtttcacctgatggcatttgatcactacagtatgttcatagacgttcaattctgacgcttaaaagttcactccccaaatcttcaacctctcatggactattaaattagaatctagcttagtgttcattcttgtactcttcacttattcagtatttcagttcactagttcagtgctctagtttcatctcaaccatttcgattttcgggtacaaattattcttcccatgcatgagtgacgcacaaaacaatcaacggtgtttggcgtttcatctaacctgagcgacgagaagggaaaggaacggcgacgacttggggtaggttcttcgagtcttctgcaggcttagggtctttccatctcctctttcagatcgaacaagttcagcgggtaccaagtgcgaatttgcagaggcatcccaatcgatagaggatgagttcgtcagtctgttccaatttgtttgtctgtagcattcacagattcagatcagataatatcatcaaggtaccacagtacctggtgcaaacctgagaaatttgcagagggattgtaaagtccaaactggaagaaaggtttccaagaagattgagttgttaaatgttcagtttgttcttgtttgtttgtctgtagaattcaaaaattcagattatgtcctgaccttgacttaaaatatacaaatgtactaaaattcagattagttctcctttgcaatggattgggctagcactatttggggattgagaagcactctaaaaatatgctttactgaacttgacgatcccatgtcagacgcttgccgatgttctgtaagctatgctgttctgcacacaacttatttattcagatgacagaattcagttttatactcgctccgtcccattttaagtgcagttgcggatttccatgtacaacgtttgaacatccgtcttatttgaaaaatttataaaaaaaattataaaatttataaatttggtggtacatctggacagccagaacatgaggagcagcggtgccgccccatgtaaagtttgtagctctaaacttgatttgaccttttcagaacgggtatataaggttatattcagtttaaaaactagctgggtggcccgcgcaattgcacggctagcatccaaacaaaatcatatattttttagtatgtttttacttaaaatttattaaatagctatctcattgttttaagactttaaaagaccaaaccttactatcctcgtgtttctgattatatagtttttaaaagtcacaccagttgctaccctttatgtcatctccttctttatttgcttgctcgatttaccactatttttattcattcttcttggaacctttataaattggattttatagttttagagtttattgtcacgttgggtttcgtttttataatttctagatgtcccatcaaatgttgccattatactcctctatggcccgtccagtgtttcttctctttattgtcattgagattttaaaagttgaacataattatcgtttgggttcatttttactttctagaagtcctaccaaatcatcagcggctttgccattgtactcctctacggcttgtccgctgcctcccttctttattgtcattgagattttaaaatcgaacctaattatcattgggtttttttactttttggaagttccaaacctttaaaaattggacttgtaattttattttttttataatttttagaagttccatcaaacgatgccactatgcctctctacagttcgtccatcgcctactctttattgtcattataattctaaaaatcgaacataactattgttggaattcattttttattttctagaagtcccgtcaatcgtcagcggttctgcaactatactcttatacaccccgcccgctgcttctcctttttattgtcattgagattttaaaaatcgaatatgattatcaatagggtttttttttactttctagaagtcccagcatctgctttacttgtttgcttcacggcctgcctagcgtccctccttttaatcgtcattagaattctattttgtgttttattaacaatttttatatgtcatatcaaccgccaccactctactcctttataggtatgttacttaatttatctcgtcatgtgttttagatggtcttttctttcaatagcctttatttttatcacaaactttagttatttataaattgtattcctaattgaaatcttatttttctttttctaatttcagaatttattttttttaaaaaattagttaataccgtattgtgttcttttaatgtttttatttttttattttcaatttcagttgtttcaaaattgtattcctacttgaactctcttttaatttttctaattttgatattattttattttttattcgaaattttaattaatttgtattgggttcttatatggattcttctttcaatattgcttatttttaattccgaatttcagctaattttaaattgtattcctacttgaactcttcttttattttatttttctaatttcagatttatttttatttttattctgaattttaattaatctcatattgggttcttatatgaactcttcatattcttacttagactctcgtttccttttctaattttgtattttattttatttttatttcgaattttgattattctcatattgggttcttatatggaaacttctttcaatattgcttatttttaattccgaatttcagctatttttagattatattcctacttggactcttgtttccttttctaattttggattttattttatttttatttcgaattttgattaatctcgtattgggttcttatatggaaacttctttcaatattgcttatttttaattccgaattttagctaattttagattgtattcctatttggactctcctttccttttctaattttggattttattttatttttatttcgaatttcgattaatctcgtattgggttcttatatggaaactttttttaatattgcttatttttaattccgaatttcagctatttttagattgtatgcctacttggacttttcttttcttttttttctttttctccgattaatgtgggaatttctagcctccacagcgaatgtggtgcctccttttcgaggtgtcttaataatataatagatagatgattcagttttcaaaatgttctatagtcgacctgtaactcgttttttaggaaaagtcaaactttaactgaaatcatagaaaggaaatcgtcatgtggtttctggccgatgttagtgaacggccatcttctgaagcagcacacaagattccaataatcagtctagggacaaggatgcaatagtgacgtatacgagtctacattaattttttatatctgcagctatcgtgtgaggacaataagccattgtctcgtcacaaccagaaagtaacataagcatacttatattcttatgctagaaaagaaacaagaggatcgaggcacatagtactatagtagcagcagaaactcatcgctgctgcaagcttttttttttttttgaacaaaccggcgagctgccaatttgaatagagaaggagcatcgctgctgcaagctcaattcatggcttcatacaaggtataataagttgctccctttgtctggtattgctactttacttctcagtgttgtgtaatttttgtttccgtaagttctccaccggcttccctcaatttaccactggtctcagtgctagctttgccctgatccatccatggcgggcttaccagcagaagcaactgcaacaaaggtagcgatgctcgctgtactcaggccagcgtctccaccaccttcagtctcatggaatatgttctgctgctaattcttacactccaattgttgctttgtttctgctacctgttttatgccaaactgcagtgaacaggtgaccagctacttttttctttctcccctttgctggcacttgataatttctcacatgtaaaatgaatgaaaaatttgagttcctcgccagtccagatatagacaccagtgccctcgacaagtgaccctgatcttatcatccacacgatgccctcgccaagtcaccatgatatcatcatccaagatgaataggaactttgcacaccaaccgaataggggtagagggatcactgcactatatgaaatttacagtggttagtatcgaatatgattttatgaaataattgccttcctccgttcattttagtatgttaattagtattgttttacagttgttagtattgtttgctgttaattagttagtcttattctcaccagtcctatatacaattatgtaattgtaaaagatgcaccattctttagttgtagtcccattttaagagtagatacactacactaaacagaaaaaaaaacatacttctatgaatacctcacatgataagaatgtagtaatagtttttagtgttggttatgtacctcatactgtgcatgatttgtccctagaactttagtttaagtatgataagctaattattgtattaatataaatgtcaattcagtagttatacccatggatgtctattttatcaatacaaaagttttagtgaacattatatatttttcagatcatgctaacagatatcgtgcattccttgccaacctacaatgctgtcactttctgaaacgttaaaagtggatctcccttgctgatttttcctatggcaaccatattagattctttggttggatcatgtgccaataagttgaaagagattattactgaagaggtgatacttattctagggatacaagaagagctcgcagagttgcagcggaagactgaactcatacattgttgtattagtgatgctgaggaaaggaggatggaagagtcagcagttgacaattggcttggtcagctaagagaagttctatatgatattatgatgttgatgatattattgacttggctagatttaaggggagcattctactaactgatcatccttcatcgtcatcaaggaagtcaattgcttgcactggcctgtcaatttccacttgcttttctaatgttcaagcacgtcatgaggttgctgtgaagattagaagtctcaacaggaagatagaaaacatttcgaaggacagagtatttttgacactcaagagtacggttcctactggaagcagttcagtattgagagtgagaaaaagttcccacctacttgagcccaacattgttggcaaggagatcatacatgcctgcagaaaaatggtagatttagtgcttgaacataagggaagaaaactttataagcttgcaattgttgggactgggggagttggtaagacaacattagctcagaaaatatacaatgatagaaaaataaaaggaagtttcaacaaaaaggcctgggtttgtgtttccaaagtgtactctaaagcttctcttttgagagaacttcttcgaattatggaagttcatcatgatcaagatgaatcaattggagagctccagagcaagcttgaaatagcaattaaggagacaagttttttccttgtgttggatgacatgtggcaatctgacgcatggacaaatttattaagaattccgttgcatgctgcagaaatgggagcaattctcataacaactagaaataatattgttgccttagaaatcggagtggaccatacttatcgagttgatttgatgtcaaccgacgtaggatgggagctactttgcaagagcatgaatatcagtgaaagcatagaattgcaaactctgcaggatgttgggattgagattgttcgcaaatgtggttgccttcctcttgcaatcaaggttattgctagagtgttagcgagtaaagaacaaacagagaacgaatggaaaaaaatattgagcaaaaatgcttggttcatgaacaaccttccaaatgatttgagaggtgctttatatctgagttacgatgagttaccacgtcatttgaagcaatgctttctttattgtagtgtatatcctgaagatgcaaacatttaccatgatgatcttacaaggatgtggatcgctgaaggctttatagaggaccatggaggtcaactactagaagaaacagcagacgagtattactatgagctgatccaccggaaccttcttcaaccagatggtttatattatgaccacagcagctgcaaaatgcatgatcttttaaggcagcttgcttgttatttgtcaagggaagaatgttttgttggaaacccagaatcattggtaggtaacactgtgtctaaacttcgacgtgtttcagtcgtcacagataagaacatggtaatgttacctagcatggacgaggtgcaatataaagtaaggacatggaaaacttcttatgagaaaacactcagagttgataattcatttttcaagagatttccttatcttcgtgttttagatttgactgattcatttgtaccaagcatcccaggttgcatcgggaatttgatccatctacgtttgcttgatcttgatggtaccaatgtatcttgtcttccagagtccattggcaacctgaaaaatcttcaaatattgaacttggagaggagtgttgctttgcacagtcttccttcagcgatcacccaactgtgcaatttaaggcgccttggcctcaattattcaccgatatatcaagttccaaaagggattggcaaattggaatttctcaatgatgtagaagggtttccagtctatggtggcagtagtaatactaaaatgcaagatggatggaacttggaagagttggcttatctttaccagctaaggcggcttcatatgattaaattggaaagagcagcttaccgcactacttacccattgttaacagacaaagggtttctgaaatttttgtatctatggtgtactgaacgtacagatgaaccatacacagaaaaagatttcagcaatattgagaagatctttgagcagctaattccgccgtgcaacctggaagatcttgctattgttaaattcttcggtcgccagtatcccttctggatagattctacccatttggcttatgtaaaatccttgcatctcttcaactgcaaattctgtatgcaccttccaccagttgggcagctacccaacttgaaatatctaaaaattgagggagcagctgcagttaccattattggacccgaatttgctggccacagggcgagtaatcttggacgaacagttgctttccccaagcttgaagagttgctcattagagatatgcccaactgggaagagtggttctttattgatgaagcaacgtcaactgctaaggaaagggttgatgatggagattctgcaataccaaaagagaaagcattacctccaaggatgcagatactgtcacggttgaggaggctggaactttctggctgcccaaagctgaaagctcttccacagcagcttgcacagattaacagtctgaaggagatagagctaagatgggcaagcagcctgaaggtggtggagaacttccccctcctctctgagatgcttttgattgcgacatgtcaagccctggagaaagtctctaaccttcctcaagtgcgagagctgcgcgtgcaagattgtccaaacttgagacttgttgaggatttgagcactttggagcagttgtggctttatgaggatatgcatgaggtctctacattgtgggtgcctgggcttcaacagcagtgccggcaacatcatggagaggatcttgaagtctacaattggacatagtaataatgtatggatgcccaaaattatttggacgcttcagttgtttgatgcaaggtatgtgattttatatactctggattcggattgcgcccattttttggcgtgctattgtgtacatagatatatattttttgctttaccagttctcggtcttgaggatgaaaggatctagtactttgtaatatcggatattacagatatgacaataatcccaaagatatggcagtataagaactaaaaaactgtacttctagtttgttctggtaatcctctattaggttctgcaacttccatgcagctcattatcagcacatcgaccttctactgagcaggaatgaatgaatggatcaacgggtagatggtaggagtaccagactgactgtgtgtatattcagcaaatttagtctccctgatgtttacagcctaccttaactgaatttcacatcagcaatgattgcgtgcaaggccctttttcctccaccagatgatgcttaaggaccacaaaatacatgtatatctcgatgaaccgaaaataaaagcattccctccattatccaacatcgttttttatcgagtccatccttctccatttaaacactgaacagaacagcttgttactctgtcatcaggagagatattatgaccaatacccccaggttttccccttgttattccgtattgttgaattaactgtagttttgatgcattcatgtgttatgcagggggatgctgatcagtgccccttttggatacttcaaccttcctaatgttccatgtaagctgttttcctaatttctcccattgtaatctgctctactagcaatggcttatctgctgcatctcctgtacaggattcagaactcaagttcttgccgcaaaatggtttctgtacacacaaaaatggctaaaatttcaaatgccaactgcgattaacagcagattgagttgctgatggaggtgaaaactcactatgctttagagttcgctcccaaatcatcaaccctcttatatggactccgaaatcagaatctgagttttgtgttcagttatttcagttcagtgatctagtttcatctcaactgttccgagtaattaacaactggagtagaaattatccttcccctgaactgaatcacaaatgcatcgcaaagcaatcaaagctgtggcgaaattcatctatctagcgacgagaagagaggaagggagggaggcgtcacgtacctgggttgaactcgaggaggaggaagaggccgcggcgtcgaccccgggcgccgtggcggcgaagggggcccatggagcgctccaacttctcctccgtcggatctctgtcgctccctgcggcccaccctccagctccgcctccgcctccgctccccgacgccatcgccgaggtggggggttggatggccgtaccaggcgctccacgatgtacctcactcactgactcatcggagaactcgcccgcagcaatggtagctcccttctccaccatcaacttcgccactcgtcggagcgccgccgtcgccgtcggcgaccaacgcgcccttttccaacgacaatacgagataatccgagggcttattcgaaaatgatcctccaatgctcaggcgcccttagatatcccggcccattaattagggcccacacgtcatccgcaaaccccttgatggcccataaaatatgggctccacgttgcatcccgcccatgttcacttgcagcacgttgggctgtgaaagggtccaaagtccaagtatcgccccagagacggcccgtacactttgggcctcacattgctcctgccctgcgctgacgggccgcatgtccgcgtagtatcgtcccggcccacaaattaaatggaatcgcttgctggcctacgcccattagtcggcccgaccgcaagagcgatagtctcctggatgatagaatccgccgccatggcagccgctcgccggagctccgccgactggccacggagctcctctccggcgaagatttgcatcacgtaggttcttcgagtcttccctttccataatgtgctttggctctttcatcttcctctctctgtctcacagatcagacaagtgcaaatgagagatgctgtactgctgagtaagcttcagatactgttgtgttaccaaaaattatctcgggaaaccaacacttgacgagcatgtcaatacctattgatgagagatgttgtatgtactgctgtttaagctatagaacctattgatgttatacagatctgagtgcattttttttctttgataatgtcaggtgtgagctcatgaaactgggattgtgttctgttcgtagcatcctcttctttcattctttgttgtgaatcaatggtcctgttgaagtcaccaattggatgctttgttctctatgttctgcttctgtagctggatgagtatcagtcactgtatctgaacacatacagagtgaactctatggtttcagagcaggtatgttccttctttgacatggtcatcaatctgaaagcatgtcctccactagcatgtgcagtagtatgattccatgatggaggaaacaaaacttaatcatgtgcacgtctttctttttcttttctaatcaaagtgcgcgcctgctttaacaccatggactataatattcacgtaaactaattataatcacatcaccacgtacgtccagtgcgcttcatgcagccacggggaagctgccttcttccaggtcaggattgtcgatcagagccaaaccaagcagtttgttcagagttcagaattacatagaaactactgaaatctgaatgctgaaaatgattttgttgttgcatgcaggcacagcgaggggaaaggaaggcatgacacttatcttcgtgtgctgcaaccccagctgcaatcacagatggagggagtgacatgtaaattaattgtaattaatgctactattatgctgcatgtaaaggcaatagagctttgcattatgccatgaattggtatatgtttactagtcaaatcgagggataagacgacaaacaatgagtatgagatgccattgagcccgtgacggaggaaacaaaactcaagcatgtgtatgctcacccctttgtaaaggcaataaagcacgcagctggtttcacatcatggaatcttggaagcaaactctaaattaatcacatcgaaataaactgtaaactaatcacatcgccagagcccaggcgccagctaatcgttgcaatatactattgcagctgttgatcagtgccctagaatatgtgagtgtagctaatagaagtacgaaaaggaaaacgcaaagttccctactaatctgtaaggtctattagtaggaattaagtactctctcaggagcctcaccatttgcattcta

SEQ ID NO: 79297 - DNA, 7473 bp, Oryza sativa
cccccaccggcctcctccccacccgccgggtgccctgcccaactgaggagaaaagtgagagaaaagaaaaagagagaggaaggtaggaggagaggggaggggaagaagaggttgacatgttgtaacatcctgaaaattcctcacaataaaaattactaaaatttcgaactttttaaaacttttgcagcatgctggttgttatgattgctatggcttgccaaaccgtaaatgatcacaaagaaagtaaagaaaagatcgacatttaagcaatagatataatttacaagaatatatttaaccctacgaatatttatgcacaagatattaaaatcaaataaaagaaaagttatcattaagctatttcatcaaatattaaaatatttgaataatgtaggtgggtgccataatatgagtacacatgaaatgatgatcattcaaataaactaacatataaataaattgagctaatgctactgtgttaataacggtctcattaggaaattatagaatctttaataaatcttaaatatcggacaatattaaattttgggaaaattcacacttggacacttaatatggtcacccaaatgcataggagtaatacaaatttaatttataacttttctcaatttataaatcaaccaaagccctaaaagtaggaaaataggaatacttaggaaaatatataataaaaataaaaatatgttcaatattaaatttgaatacaaatttcgatggagtaacttaggattggtgtattttacattgtgacaaaattagtggcaatagtatatttttcctaattgcaaaataccctctaaaataaaaaaatagttggctagcactgttcattagccctctaggtgtttgatttggttccctaaccaccacccctcctctgccgcgctccgcctggaggcctgcgtcgcccctgcgtgtgctgcgccgctgccttgcaccccgcgccgccgcgcgccgtcttgtcaccgccgtcaccctgccgcgccgccacgtcatgtcgccgtcgccgcgccgtcttcattccgccgcacgccgtcgctgttgtcggtcgcatcgtctcgagccccacccctctgtgcgtgccgtcgccttcgccgtcacgtcgtcatcatcgccgcgccgcgcgccgtcgccatcgccgtcgcgtcggcttcgctgccacgccgcgcgccgtcttgtcgcgccccgcgccgccaagccatgtgccgctgctgcaccgtcgtccgtcgcgtctcacaacgatgagccccgtgccacgtcccgtcaccgcgcgaacgtcctgtcaaggcgccatgccatgtgcgcctatgccctatcctcctctagcccagcatctagcccggttggcaatgggttggcaagcttatcttctccggcttgcctataaaagcatccccaccatctcccttcctccccacgccatcttggctgccatcacaaggccaagcccccataaaaccccatccctctctgcctcttccttgtacacatttcgtcgaacatcttgtgggcgtgctgcaccttcttctccacaccaccactgcagccgatcttcgttgtcccgccgtctatcggtaagtcctcgctcctctggcctcccctagttccgtagaaactagagccccctttaatttcaccaattagcaaccgtcgccgtgccggtccggccaccgttttgccgccggtgagctcgccgtggacaagccattccggagctcctcgtagtcatctcgttagtaaaatggaaccctcacacgtcgtagatactcacgtcctcaccaatttggtcgaaaaccctccgtatcgccctagcacctagctacccgtgcccggccatggcggccatggcggccatgcggcgccgctcgccctcgcgccgtcctgcgcagtgactgccgacaggtggacgccggagccttgccgctccctcccctggtcaccgtcgggtcgccctcggccggccttgccgcgcgcgctgcgtctcccctgctactcccgctcggtctggagggagagaagaggaaaacagagaaagagagagagaaaagagaacagagaagagaggttagagtgggcccacctgtcaatggttcataggatttgctttagaaaaataatccagtaggaaagcaaatacaatcctaaaccccacatgtcagtcacttggagttttggataaagtttaggaataaaaataatggattaggaacagtacctttttacaatttctcggatttattcaaatttgaaactttaaactagcataactctctcattttaactcggatttgagtgaaacttgaacctaaatttatctaaattcataagctttccaatggtatataattcactattttataaaatacatttataattattaaataactaatactaagataatgcataatagttaaaaatgtgctaataaataaaattgatattgtactgtaaagtagatgtcaaataattgtctttaacacgctttttcactgtaaaacctatgtaaactaattaggagcattgtttcaaattaattaaagcataggaaatactagtgccatttattaatatatgtcatgtcaatatataattatacccataacgtccaaactatataaataatgtttagcctcatattttgtgactaaaatataaacacatgttgatgagtctttaacttgtttatgagaaataatagcagagcttgtatgattaaaccaccaatatgaaattaattaacgacatttccaatacagtagtatatgtttaggttggaaatcgacccttaagttgtatagacagtaactcactcataaatccacttaaaatcacatgtactatatagcttaagaaaatagcagctattcaaataaatgattcaatattaagatattgtgcactcacatatactgtacagtccattatagctatacgttgtagtattaaatcgcttgattgcacatattaaaattaaagaggatatatgacaaacatgtatggtggataaatactaattatagaccttgaccttatataacccaagtccaattgtagattaggattattcattgtaaaattatgtgatgggataatctgtaaccataatatgattaacctaaacaactctaacatacaaagcatggataattattaaccttttataatttattgtgacaagtaaaatatgttcataattaaagcaaagcctccatcaattaaataataatacaaatgattcattatttgattgatactaaatccatctaacaacagaacctctggtatgtaaccgtgctatttagatagatgcatatatagccataatccttccatagccatttgatagactaaaccgccgattagccaaatatatatgtataccataaatgctatgttggttaactcctaaatagaccacgatgaaaatagaaagattaagaaactttagcccttggcatgattggaatccattagcaaacacgaatagtacattttattgtgcatatttgattgttgttgaatattagtttttctcgcgtattatagaccttgtgtatcggttagtcgtgaggcaacgtctgcaacttctaggaggtgaaggttgatcaagaattatatcaagaataaggattatcctgagcaggcaagtcatcactattctttgaacatgttgatcccaattgcgaaattattttgtttacaaataaaattgcatgcaatgatgaacatcccacttgattatgccatgccttgattgttgtttacccttaaaatctttgtaaccatgattacgtatgagtccttgtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtgtccggaaaaggctagtgccgtccccggtcaattaaggaccgagccatgaagttaagcatgaaacgacccccctacaaccgcacttctcgtatgggtatagacctagcggagtagatagctgagcggaggcaatatccatgcatagtggtttcttgatgtgtgaggcaggggctctacggtggggcagccattggtaggaccacgaggcgggtgtctacagtggtgtcgccattggtaggactgccatgtgagaatttaaacataattataacttaatgcatgtgtgagtcttcccttcccgggtgcgccagaactcctctcactgctagaaatcgtattacgcctagagtgcatgaggatgtaaagttcatggagcgggtactgccaatgcgaggttatcaaaaggctttgccgtgacgcatctcatgtgttgggatgaggctcatgtgttgggcagtcgcggagtgctggtaaagtgtacatccaccgcagtgtgagtaaaccaaatctattcgaatagccgtgttcgcggttattgagcaccgggacgtgtattacacttggctagactctaaattcttaacttgtgtgggatgggttattgcatgatgattttatgctgtgggagccacttcctgagaggagggaaggtggacgtcctcagaaaaccatgacgactcaatgggggggaagcaatccttgggatcacaatggatggtggacagaaccgtcgttgtttaatgtgaacactggtattaaaatttgatcaatctatgctaggtcttaggcttgtgaaaagatttgcaaaacttgctttgcgcaaaggaacctgaagccattccttgaaataccctatatcatatgcatcgttgctgtggtggcttgctgagtacggttggtactcacccttgctatttatatattttttaggagagtgttgaagagaagcccttgtcggtacgcttgcgtatccaacaagatgatcggagtgcggtcttgttctaggtctcgtttccccagtcgactgcctgtggcatgttaaccgggcccttatattattttgtcttccgctgttgttctctgatagttgttggcctacctggccctaatgtaagtatttaactcttttagcctgaattcattcgtgatatgttgtgatccaactatgtatgtgtgtaccaactactgatccagggattggtacggataaacacagaggatttccgattttcaaaatcgggggtctacacatgtgggacccatgtgggtcccacgctcatgagtcagctgccatgtcaattaaaaccgtagtcaaaactgttgagggacctagtttgcactggttttgtaagttgggggacacgttgtatccggttttgcagttcaaggatgattttgtaactcaacgacaagttaagggaccttggttactttttccttttatttttttttcaacggatggggctacgagctacatgcttgggaggcccacgactgcatgcgcgcccttatatacccacctttgggcctccctactagttgggctatttttacccaaattcctaagaatacaagtttttttttaacttttttttatcgatgggaactgcacagtatcgatattcaaatgttcgtatttttataaaaaaattgtatttagaaagttttagggataattgtgttcttgtccttactttgagttacaattgtaattttgcccctcttttttagggtttgtgattttaccctactttttttgaattgaagcttcggtttgcccctgttttagatggcattaggtgggtccagattctgtaagataataaaatgaataaggtaaagaaaaaattgtttacaaaatgtagaaagaccattgtagccctgtaaaaaacacttaccagttaccaccacccagccatccaacccatcctcctctcccatcccaaacaggtggatgcatgcgacggaggtggcggcaccggagcaactcacgagcaggctacgacggcgcaagtggtagcgcttgccggcgtgagcagcggctgctcggtagagagggagtaggcggtgctgctcggtcaacacgcgagcaggtggtggctcagcgacgcaatagcaggggaaggggtggctcagcttggctcagagacgctgtagcttgctgcgaacatcgtttagagtaggagcagccacaaggacacacgacaagcaagctgtggagattatagataccctatacccacatggtatatatatccgactgggtataggggtactgtatgtagatagaatatctttaagagacttgggttaaattccaaacttgtgtatcaaggaaatacccggagtcttagtcgtttacgattgtattttatctttactcgcctattccgttaggaatatgggctgtaccttgtaatacggactccttcccctatataaggaggggtccgggtgcctcttggggcataacttttctcccagatcatacgatcaataatacactcgacggaccaatccatggacaggagtagggtattacttctcattgaaagggcctgaacctgtataaaattctgtgtctctaaacccatccacttctccagattgatagctacccctttttgtattgctgaaattttgtttcgacaggttgcgtgccaggtaggcgtagcgtcaagtttttcgccgactagtgcgatgggttttgtctccggcatcgacgacttcgtcttccctcccgggcaggcgttccagttcggcagcctcgacttcatcactaacgactttggcaatatttctctccttgactcggatccgaaccagtcagggagaggtcaggcctctgccccgttcggtctcccaaactcggccgagatctactccaagatcatctcatctgagtcggcttcaaactactcggaagagatccaatctacttcgacacgacctgatcaagacgatggggcctatccttcaatcctgatgaagctccccgatgacttggctgctatttttaccacaaggatgtctcctccccgtaggtctagacgggatctggtctctgctccaatccaatctagctccagggaagtcggcgtcatactccagcctctcgggacagtttcgacggaagaattggacggctacctcagcttccccggtgtcgactctcgaccgacggagatcctcgagtacgacaacttcggctaccactacgactacagcaacctcgacgacttcgacgaaggctacgaagacaactacatgcctctcttctttggcgttttcatggctaataacgagacggcataacagcgccaagcccgagaagcagaagaacaacgcacatgacaagaagctgagcgtcgccgactggaggaggagcgactagcacaagagcgagaccggctgcagcgtgagcaa

SEQ ID NO: 79298 - DNA, 13758 bp, Oryza sativa
gattttaagattatcatcaaacaagcctcagtgttgttgccgtaggatccaatagtaggagcagggatcatggtgaacgatctgttcactcacctgtcgataggcatagggagtgcagggctgaacagcaccgctcttcgcgtcgcaggcgtcccgtcgatcttcgcgatactatcaatcggcgtcacgcgaaagaggctatattccccaccattcaccagatcgttacgacgacgatgtggatggagttgccgccttcacaagcgacctgcgtcgagtggattggccagccggcttcaagccgactggaatcgagaagtacgacggcacaacaaatcctgagtcttggctcaccgtctacggtctcgcaattcgtgcagcagaaggagatagcaaagccatggctaattatctgcccgtggccttagtggactctgcccggtcctggcttcacgggttaccccgtggcacgattggatcttgggcagagcttcgcgagcacttcatcgccaacttccagggcacttttgaacgccctggcacccagttgacctctacaacgtcatctagaagcctggagaatcccttcgagattatatccgacgtttttctgaacaacgcaacaagatctctgacattaccgacgacgttatcattgccgccttcactaaaggtattcgtcatgaacttttagtcggcaagtttggacgcaagcctcccaggacagtcaagcagatgttcgaaaaggccaacgaatacgccaaagcagaagacgatgtcactgcatctaagcagtcgggcagtacctggaaacaaaagaaagatgcgccaactacaggagggagtggaagtgccaatcacaaggatcgcaagcgtaagcccgaggaacttgtggcaactactacaccatcttcccgacagcaatcacgtgtcaatacctttgacaagattatgaatgcccaatgctcacatcatccgaactcaaaccatgcggccaaagattgcttcgtttataaacagttcgcagaacaatataccaagaaagcgcggaagccaactgatggagaacagagctcgtcaaaaaagaaagatgaagaagacgatgcaccgattggctttcaagatcctcgaaaggaactcaatcacatttttggtggccccatggcatatgagtccaagagcaagcaaaagctgactgaacgggagatcaacgccgtccagcccgatacaccccaatatcttcggtggtcggagacaacaatcaagtttgactgctcggatcatcctgaccgagtggtccacccggggcggtaccccctggtactagacccagtggttcacaacgtcaaactccgacgatccctcattgatggtggcagtgcactcaatatcctttttgccaagactctggatgacatgcggatccctcggactgagctgaagccgagtagtgcgtcctttcatggagtcatccccgggctatcttctactcggccagatcactttgccggtcaccttcggcattcgggagaactttcgcacagagaacatttgcttcgaagttgttgatttcgagacagcgtatcacgctatactcggacacccggcgttagccaagttcatggccgtcccacattacacctacatgatgatgaagatgccaggacctcgaggagtcatatctttgcggagcaacatcaagcaagccgtcacctgcgataaggaaagctgcgagatggcccagacacgtgagatcacacttgctcgagaggagatccgactggctgcatcaacgacaaccgaaggagaagtgcctgcacccaagatatcaaagaacagagaaagcgacgccaagaccaagaaaattccccttgacccttctgatcctactaaaactgctgtaataggtgccgagttagattgtaaataggaaagcgtgctcatcacctttcttcaagctaataaagatatttttgcatggaaaccatctgatatgcctggtattcctagagaggtgattgagcactctttacatgttaaggaaggcgctaaacctgttaagcaacgactccaccgtttcgcacaagatagaaaagacgcaatcaaggaggaattaaccaagctgttagcagccgggttcattaaggaagtcctacatcccgactggctggcaaacccagttctggttcggaagaaaacaggacaatggcgtatgtgtgttgactacaccgacctcaataaatcttgtcctaaggatccctttgggttacctcgcattgaccaggtagttgactcaatggccggctgcgagttactcagctttttggattgctactcgggttatcatcagatcagcttaaaagagtccgactgcttgaagacctcattcattacgccttttggggcttactgctacatcactatgcccttcggattgaagaacgttggagcaacttatcaatgcatgatccagaggtgtttttcaacttagattggccgcaatgttgaagcctatgtcgacgacgtcgttatcaagaccaagtagaaggatgatttgattgcagatctagaagagacctttgccagcatccgcgcattcaggatgaagttgaatcctgagaaatgcaccttcggagtaccgtcagggaagctgcttggctttatggtgtcccgtaggggtatacaagccaacctggagaaaatcaatgccatcctcaacatgaaaccgccgagttcccagaaagatgtccaaaagctgactggatgcatggcggcactcagccggatcgtttcacgactcggcgagcggggatgccctttttcaagttgctgaagaaaaccaacaatttccagttgggacccgaagcctagaaagcctttgaagacttcaagaaacttctcacaactccaccagtcctggcttcaccacatccgcaagaaccactgctattatatgtgtcggtaacatctcaagttgtgagcacagtcctggttgtcgagcgggaagaagatggccatgttcaaaaagtccaacgaccaatttacttcgttagcgaggttttggccgactccaagaaaagatatccccaggtacaaaagttgttatatggtgttttaattaccatcgggaaattatcccactattttcaaggtcactcggtcacggtggtcacgtcatttccactcggagatatacttcgtaatcgtgaggcaaatggacggatagcaaagtgggccctagagttgatgtctttggatctatccttcaagccacgcacctcaatcaagtcccaggccttggcagattttgtcgccgagtggaccgagtgccaagaagacacgcctaaggaaaagatggaatactgaaccatgcactttgacgggtcaaagaggctttcaggcactggagcaggggttgtactgatttccccaactggagaaaggttaagctacgtactgtggatacatttttctgcatctcacaatgtggcagaatatgaggcacttcttcatggattaaggatcgcggaatccttagggattcggcgtctgatagtacatggagattctcagttggtcgttaatcaagtcatgaaagaatggtcctgcctcgatgacaatacggctgcttatcgacaggaggtacgcaagttggaagataaattcgatggcctgaagttaacccatgttctccggcatgataatgaagcggccgacaggttggccaattttggttcgaaacgagaaacagctccttgtgatgtgtttgttgagcatctttatgaaccaaccgtaccaagaaaagaaataaccgaggcggtagacattcaaaaagtaagcatgatcgacaccgactggagagagcccttcatcaagtttttaacaaagcaagcactccctcaagataaagacgaagccgagcgaatttccaggcgcagcaagctttatgtcatgcataagaccgagctgtatgagaagagcccatcaggaattctgcaacgctgtgtttctttggaggagggaaggcaattgctaaaagatatccactcgggcatttgtggaaatcacgctggcgcacgaaccattgttggcaaggcttatcgcagggttttttctggcccaccgcagtatccgacgccggcaaaattgtgcgaacatgcgaaggttgtcaattttttgccagacaaattcatctaccaactcaggagttgcaaactatcccattgtcctgaccgttcgcggtttgggggctcaatatggttggccctttcaaaaaggctaccggtggtttcactcatctttttgtagctgtggacaagttttccaagtggattgaagccaaaccaatcatcacaatcacagcggacaaggctagagatttcttcatcaacatcgtgcactggttcggggtacccaatcgaattatcactgataatggtactcaattcactaatggtgtgtttaaagatttttatgaagactttggcatcaaaatttactatgcctccgtagcgcatcctatgagcaatggacaaattgaacgcgccaatggtatggtacttcaaggcatcaaagcacaagtctttgaccgactacgtccctacgccggcaagtgggttgatcaactgccatctatactttggtctctgcgcactacacccagtcgggctacagggcaatcaccgttttttctggtttatggcgcggaagcaatgttgccgagtgaggtagaattcgaatctttgcgatttcgcaacttcaaggagcgctacggagaagaccgagttgatgatcttaaccgactggaggaagctcgcgaggcagccttgattcagtcggcccggtatttacaagggttgcggcgctatcacaaccgcaatgttcgatcgcaggcattcttggtcggagacatggttttgaggaagattcaatctacacgagatcggcacaagttatctcctctatgggagggaccgttcataatttctgaggttactcggccatgttcttatcgactcaagcgcgaagacggtactcacgtcgacaactcttgaaatattgagtatcttcgttgtttttatgcttaggcattactcatgtatattcttttcctttttgactgccaacatcaaattatctcttgaagttaccagtcgggggctattataataataatggagtgtgatttttatcaattcaatttgcttacttaatttatcattgccctgtctgattttttggcttagctaatgaggattgaaagttttttaaggacttttgcgggttctaggctcaacaaggtctgacgagaacttttaagaaatcgaacgctaagtctagattatcaagcacagcataaatacatcagtattgtacaaattgagcctccagcatcaaagattacatcatcaattagattcagttttctcatcgtcagattcatcagacccagtcggaccaagattgttgtcttgaaatctctcaacaacatcagcagcaatcttgtcggcagccttctgtgcattgttgatgaggtcaagggcatcttcttcacttgtcccatccgcaaagcagtcgatggcgtcaatatcgatcttcggatacaaggacttggtcatcgccaatgccatgctcgctcccatgcatccagcttctttgatgttcttaaagtatgtatccggagtagttctcagcttgtcaaagatttcaacaacgtcgaatgtactcggaccattgttattaaaaaacatagcttggatgagtggtgtagcggcatttgtgccttcatccctagctccttctagcttcttaatcttgttgaccaagacttcgaattgagcctgagatttaattttgcgatctgcataaaaggttcaaatcaatgtctgggcacgaagacaagaatagttctagagttctaactacaaataccttcaacgtccttgagagctgagtctcttcgcttggttagttcacccttgtctttttccagagctttgattcgcttttctagctcggtgatcttggcagcttgtactgtgatacatcctagtggttaattgaatgcggatggcggcttggagtaagttaatcaaggatagggaatacctttggatgaaccactcagctcgaaattggaatcttgaagctcagcaattcgatccctgagatcatgttctgtctttctggctagctccctggtttcatggagttgggttctagttgcttctagagtcccgagatgagggaccagtttctcaagggttgttgtttttgcttcgttccgaagatggattctctgcatcacaaatttattcagttcagcggagtggccgacaggataggtaaagctatatgcaggaaacatacatttacaaaacgggtggcttgattgagtgtttttgcaagcagagacacttcctcgtcttctttctgcttatttattacgatcccttgtggctgcatttcatcatctcaccatataactaagatgggtgggcgagaatcttcagctgattgaatccgaagaacttcttcttcgtcaccaatcattgggcctttacatatgcatagatggtggtaaagcaatcgaagagaatttttcaaatgtaaatgaattcagagaattgattacatgctataatcttcggtggaggacgagcaggctcttgcaccttatcagatgaactggatttcgggccggtgtcggtatcttttgggggagggctgcttgcttgtgcatctgtttccgggatatccttattatgttccatacccgactggtctctagtcgggggctcctgattagcatcggcctcagcttcagccgactggtttccagtcgggggttcatccccagtctttacattgtcggtcgccggctgatcaccagtcgggtgattttcgtcagtcggcccggtttctttggtggtcgtagatccagtctccttgtcagttgattcagggtcttttccagatagagcaatgtcagatggcttcctgcagattcaagatatgccatcaacgatatcttgatggagtgtttgacaatacaggagaaaattgcaagatgactcatacctggatgacttcctgattttgggtatcggacggctggatgttttcttcttcgggttagcctgttttggctgctttccagtcacctctttgcttaaagttttttcagcattgtcaccctcgtcatcgctcaagactaattttctcttctgagagcccgactggttagtcggctttgggctgctcggttgaacagttggctggaattttggactgccactggcctgaccagtttgtcggcgaggagagcggcattgagcggttggaggatcagatttcattagagaaaattcctatgcatgatatttctagttctcagccaatattacaaaagataaaaggatatcgtaaggaatgccggaatatttgatacataccggtggaggagggttgaaggcgttatatggcaccactggcagtaggtgcgaatagctgaccacaataccggttaagaaaattttatacatcctctccttcatgatcttaaattcgagggactccggatcttcacggttggggtcatttttgccatcaaactcaaaggcggtgcgggatctttctttgataggcgccagtcggctcttgatgaagtgccgagtgatttgctccccttgcagaccttgctctttaagtttcagcatgcgctccatcagggtaagcgcttgaacagcttcatctcccattggaagcgagttccaggtgtcttgatatactggaggaaggcaagagtactcgggaagcgccagttcaggattctgcacatagaaccagtttgcgtgccaacccttgtttgatgttttgaagggcatgaagaaatatttctggctcagggtgccccttagctgaaaaccggctcccccaacaacgcacggcttacttttgtttggctggggcttcaggaagaaaatgcggcggaatagggcaaaatgtggcctaatccccagaaaagctttgcaggcatggataaagttggcaatatgaactatggaattggggttcagatgatgcaagctgattccataaaactccagaatctccctaaagaatttcgaagttggaagagaaaaaccaccataaaagaaatgggagaatacaacgacctcgtgcgtgtccggggtcgggaatgcttcgccatacgctggacgccagccgatgatctcctttgtcagaagaacaccgtgcgccaccatctctttcaagttttcctccgttacatcggagggagcccattgactctcgaagctttctctctcctctgccatggatgtgagatagatgatgagatttgaagtgggaatggcaaaggaatagatgggagattgatgcagcggttgcgcggaagatcttcgcggagctacaaagcctcgtcaaggtggattgatgtggatttgtgaaccctaattttcgctggagtggttgttgtactgtagcgaagaatggggatagtggcggatgtttcggcggggaagacgaaacgactcttgttctgtgtcttttgttagggtatcgggaggtactaacgggcccgggcctacacagtactttcagcccaacttcattattggcgtggttggtcgtgatccttagggatttaagcatatatttttgccttggtaaaaattgctcacaacagaatagcccaatgccgttaaaatcctttttgatgcagctagataattctttggaattactacaatgcgaaataaaaaggtgcccgacagaaaagtgtaatactaatttttttggccttcttaggctacaaagctgcttgggttttattgagatggctaatttcagatggctattctctcagcatgttatatgcttatttcgataatgacataagtcatagcttaggctattttgacttgtcatttgtcattctttatacaacggttgatgaaccctttaagagttttttactcggattcttatcatatatgttggtctatagatctttagagtatttttcactcgggtctttctctgccttttcgggcattttaaactaaagcagtcggccggatattttatcaggtgccacatatgcttaactatataatcaccttggagattcagttgtaaaaccactcggatggatatttcatgtaccttgactatatgtttagttcttatttaactaatcacatagtcgggggctacacctaattaggtgcatctagtcgatgcacctgattttttattttttagcccttcacagtctttgatttaagtattcgggagaccaaggcaggaataattaaagcacttgggatatcggttttcaagattacaagagaaggctattccgtcgactgtaaaggcctcaggggctactgtggagattatagataccccatacctacatggtatgtatatccgactgggtataagggtactgtatgtagatagaatatctttaagggactcgggttaaattccaaactagtgtatcaaggaaatacccggagtcttagtcggttacgattgtattttatctttactcgcctattccgttaggaatatgggctgtaccttgtaatacggactcctccccctatataaggaggggtccgggtgcctcttgggtcataacttttctcccagatcatacgatcaataatacactcgacggatcaatcctccgacaggagtagggtattacttctcattgagagtgcctgaaactgtataaaattctgtgtctctaaacacatccacttttccagcttcatagccacccctttttgtattaccgaaatcttgtttcgacacaagctcatccacgaggtcaatgcaagggatgctgcctcctgattttctttttgtttttttgcccatctcatagtatatatttgggagaattttgtttggtagattttttttcttgtgaatgcgatgaatccttggtgaattttttgcgccctgtgcaacttctgtaaaagtgatatccaagctctatcaaaatctgtcaagtttggtcaaatttgagagcaaatgtaatgggtatatatgtcttcttgcagctcatttgacaccgttagttggtcttaacagagtaagggcaaattgaaacttcgtttgaaaaaagcaagggcaaaatcacaaaccttaaaaagaaggggtaaaattacaattacaatccaaaataggggtaagaatgcaattgccctaaagttttaatatataaattttctacctatctctactataataaaaattgaagatgtttttattggtattttgatatgtcattcgtatttgagtcggtttttaagtttattttttggaaatacagatccgtgtatgagtcggatttaaattcgtttgcttttagaaatacaaaagaagtcgtataagaaatttctttaaaaaaattttgcatgctatcttgaggtaaaagttaaactcctaattacagctaatgattttctaaaaatactatctaagtgaattcacataatgattttcatcctagctaaatgttgacgtaaaacatgaggcctgggagatctgcttaactccagtgcaggtccaaaactcgccttcgggtatactagtgtcccagttgatttgatcctgcaatcaataaggaatagagacaaagaaaccgcgattaaacctataaatgatagccgatcggctagatgccgatgacatatcatttatctttgagccgatgtcatatgtaaatcaatcagcgtatagttcttatatcgatatatacttaaatcatgtgattaggatagatcggtcgccatgccgagacagtataaatcacttagatcgaaatatatattaataacaggactatatatgtttatagcatagccgatcggatagatccagcatgtatcggctaatattccgatacgactttatgttaagatgttaaaacaggcagaatataccaaacagaagcttaatatatttgtatgcaatgaaatcttaacataaagggcagatttaacgtgttaataaagcatatagagcaaatatagttaaatcagataagatcggctgaaactccgacactaccttaatcggcaaccaggaagcaggctagagattggtattctaagcacgatttaatagatcaaactcaactgatgcaacattaagtatgaaaagaagagcaatttctagacaatcaagccgctggaagtttcatagagtggtggatatcttatataatataaatcaacgtcattgtctaacctaatcaactgccctcttccaacagatgttagccgattgtaggttaaataacgatattgccaaagattatgtaagatatatgataactcgacagattacataaacaagattagagtatcataaagatggaagcactaatcccgagaacacaagccgttataacaagttttacctcttgttgaagatcgaaaccgatgcagctcaacccgaaagcaagaactcgtcgaaataaaactaaagcaaggcgatgcgctaaaattgtattgaacgtgtgtgttaattgattacatggggttcggggtctatttatacctgaaaattacaaacaatgtccatatcggacacgactcttatctctaacaaactctaagataccataagtctttacggcagacttttgcccaaacatatctctaaggaaattacataaaatatcctaattaatagatacaattgccttctcaggactctatccatgtgcggcaatcatcttgaagtacctcgatccaacccgatgtcataaaccaagtcgtattgtcggaatcggctgcatcggcttacctagtccgactcagacccagtcgatcctaatcgtagccgatctggactccagccgattctttctctgttctcgaaccgatctccgccttcgactccacttcaatctaatcttctttttcgatgccgatattaccaaatttggttgtcaacactaaaccatataataataataaaattaaaatagcaatcacccgttataacgcacgggtattttttctagtagttatatacattgaaactttacacatacaaatgcatatacatagaaagtatatacatggaagaaatatctacgtataaagtatatatacaagaaaatatctacaaagaaagtttatacatagaaagaaatttgaatggaaagtttgtacattgaaatttgggtatataacacgaatagaaaaaagaaagaaaaatatgtgcattcgatcaagaagataaaattaaaggtgctcgtgaacctgtgtgcacatgtcattttttaaaacaaaattatacgtgtatgcatttttcttttgaaacattcagactttcgtgaccaggggcggagccacatgcattaggggggtgcccagaacccggttcataaattttgttaactatagtttatctattttcaccatatatatataacctgtcaatttaaacttaggcacccgtatcaagctaaatttgatccaaaccaaagtatagcaagcgagtggaacccccctcattttattctagctccgcccctgttcgtgaccttaggaaaagacctcgtgcaagtgtgagttacacattgatactgatagacacaatagactcgcgccggccgactagacgaagcctgcgatgcgatcgcgtgtggcccaccctcgcggtcggtcgcattctagaggtacctgtagacggaagaactctgctttcggaaccaaaataagggcatgtttagttccaaacaaaatttttcacgctgtcacatcaaatttggacacatgcatgaagtactaaatgtagaaaaaaactaattacacagtttgtcaggaagttgcgagacgaatcttttaaggctaattgcgctatgatttgataatgtagtgctaccgtaaacatttgctaatgacggattaattaggtttaataaattcgtctcgcagtttcctggcggaatttttaatttgttttgttattaaacaacgtttaatagttaaaatgtgtgtctgtatatccaatgtgacattgcatggcacaatttttttttgccaactaaacatgcccttaaaaaaagtaaaaaatgaaaaaaatagttccttagccttggaataagtccactttgactcccttaaaagtgacccgaatctaatccgtaaccctcaaccgcaaaaccggataagacgactccccaaactattgaaaccagtgcaatttgacttccttagtgttttggaggacggttttgctgatgtggcgctgacatggcgatgttgacctagccttcgtcccacgtggtgcttacgtggcattagaattaaaaaatatatgtggggcccatatgtaattcacacataaaaaatattgtgggcccacatgtcatcctccctctctcttcttcttcctcttccctctctctcccttctctctctttctttctcgtggcacaattggtaggcaggggctacgacggcaggcgggagttggagcggtgggcgagcaatagccggagcggcaacggcggcggtaggcgagggccggagcagcatcgggcaagctgagatgtcggcgagcggcggagacacgggcatggcgtggcggcccgcgagcggcggagactcatgattggcgtggcattggggaggacgacggtggtgcttaacctctcgccggtgatagggcaggtgcggcaccccgcctcgatctcca

SEQ ID NO: 79299 - DNA, 14266 bp, Oryza sativa
cggaggtggccaaggcgctctgctctgcagaggctcttgcggtcgccggacgctgccggagctatcgctcgacccgcctccgcactcctccaccccctccccactcgcgccactagggtcgccgcacgccaccggagctgctgctcgatccgctcgagttcctctcctgctcatagagcgccttcgctgtcgacgtccctcacccgccgctgccgccgtggggttccatgacgctcccgccctcgccctaggtggcgctcgccgccgactggctctaaatcgacatgtgaagagaaagagggagggagaagggagagagggggagcaagaagaagagaaagagagagaggacgacatgtgggtcccacatgtcagtggggcccataactttgtgtgtgtgaatgacaaatgggtcccaccgatatttttttaattgtaatgacatataagcgccacggtgggacgaataccggtcaacaccgccatatcagcgccacgtcagtaaaactgccctccaaaaccgctgagggagtcaaactgcactggttttaatagttcgggaagtcgtcctatccagttttgcggttgaaggtcatagattagatcgggtcactttaagggagtaaaagtggacttattcctaatgtggtattctctattgggcccattgcccatgggctctaagcccatcttccacatcttcatttattgaggtgtgttcgcatgtggtggccgggaacttattccctcctcaccaaaaacacgcgtgattaattaagtattacctaattttttttaaaaatggattaatttgatttttaagcaatttttgtatataaatcttttataaaaatcacaccgtttagcagtttgaaaagcatgcgcgcggaaaatgagggagagtgctgggaaggttgcaaacacagctgcgcccctctcaaaaaaaaaaaagaaacctatacctgcgctgtcgctgtccacccgtccgtccgtcgtcgatggcgtcgtcgtcgccgccggtccggccatgggcggacctgcagcacgacctgctcgtgatgatcatgtcccgggtgggcctccccgatctcctctccggcggcgccacccgcgcctgctccgcatggcgggcctcggcgcgcgacccgctcgtgtggcgccgcgttgacctccgcgactgggccgtcctgacctcggcccggcgccggctcgctgcgggagacggtgaagcagcagccgccgggcgcgggcgtgtccctcttcaagccgctctctgcagtgtgctggagatcgtcgtgcggcgggcggccggtcggatggaggccttgctcctaccggagttcgccgatgaggagcacctcctcttcctcgctcagaggtaacgcctccttctcactgtctctttagtatatgttttgtgattgatgtgaagatcccgtaacgaaattagtgtatattcctcccaaatccgctcatttctggttgaaagagagatattttcttagttcattgtggtcctttggtactgtagatagatagaaatgctgaattcttgcaaccttaaaaggaatgatgtcacaacagatgttctattcatttttcatgggaaatttcatcttattgtcataatgggatgaaaatttcatttttgttgtttcagtgttggaatttagatggattgggttcacctgacttgaatggtgaaatatcacgtttaaacgaaattaatcctctttttttccctgaattaaggatgtcccagagcatcttttgggacctaattatcccagatatcctctaacctacctgactattaggatatctttgctaatagcttcaccatattgcagtcaccctaaacaggaaaaaggccagactgtactgtgaacaaaagaacacctttccattgagcggtaaactgtattcaatgcttttccaatttgtcatgcatggatcttggtataggactataggagcccattgcttgtggtgggaagtttctccacaccaagtatactattgctgtttcacttttcaatataccttccagaacggtaggaatgtacaagcatggaaggttatgataccaggacatcttagtcatactgccttctttcaaaacaatatccttttttttttcaaagaatggctgctaaacgaacatatgagaaaaatttctacaggttacttttttggttacccagtaatggaaatgaactaaagaaacagcctatgtcacaagacaaatgctcgtagtggtatggaccactttgcccactacacctggaatgatacttttctattgtttgtctgtgatatgttaacaaagagcttgcagggttcccaacccagtttctcccccacaagttattcaaatgactccctgttcaatttttcaacatatttaaacttaagttgtattgtgcttttccaaatatgttcatgagataggttctccagatatctaaacatgtgtttgcactttgcacagaatttgcagtgaagtcaccagatttttcataaccatgagaatgtgatctatcacttttactgttagttagaaacaatatgaaaaaaaaattgcttttcttttgtggggttcaactactacatttatggagttaggatggctctataattttcacgaggcataataataaaattgaaagatagtttgccaccgtcaaatatatgattgccattcctggctggctggctggtcataagtcaaggataagtagcgaaccagcaacaacacctttgctttattaactgtatcatatcattattggctattttgttgcattcaaaatctatttcctacccgttagttgtgttcaatactctattagctatgttaaggaatagacactctaatataagagttcattgtgtcttaagtttggcaagcagaaaaaatcggcaaaacgtctatgtctgcactgataacaatttggaactgccaccatgccacattacaattaaatgttctcttcaaaataagtctaaatggaaatgtaagctagtgcatggaaattcgacaatgtctggatgtggtagcaagtgtttgatttcagtgcatgatcctacaatgtttttttagataatggattttcattaatccgtcctctatatccataaagaatatacacaaccaaaacatgcactagttcttagactccaatcctcacactaaggaatacacacaaacacacacacaaaaaaaatgaaaagcttgaagacttagcttaaaccttcatcgacaacctaaactttccaccttagtgcgagagggtggaagaggagaattggaactaagtccgtgctgcccatcgccgcaccatctccgtctttgcagatcacaacaccatctgttgccaactgatgttgtccgccatcatcgtccaaaaccccttacgctgccactgcattccgaacgccactactgcaccctgagttgctctgctgcgccaccatcatcttgcgcatactgtcgaactcactgtcgctcttagagcaacgcgaagccgtccagcataacatgcaactgactttactgccatcagctcacggcgtcaaacacctaaccgcagctagaccttggcgtcgattctcgcttggcaactgctgcctgtaggacaccgctgccgagagtctctgttgccactgccctcatccgcgtcaggcgagccaacgaccatcacatcaatagccactgacacccaccgtcctcccatcctcacctggctgtggtcagatccgagcgctggagcttgcctagacgctgccgcctctagaatgccgtcaccgagagtctccgctgtggttttctccatctactgtggctgacctgaccatataccatcgtcgccatgtgcaacaactgacctgccatcgagggagaagggttagcccccactgttgcccgttgtcgctaaccctcgctataggtgccgtggaagggatggaggactagccctgtctctgcccgatggcgccaccgccgccgcccaccaacgttgcctgcgacggaggaagggatggagaactagcccctatctccatccaacgcaatcgcccaccaagtctgtcgccgttgctagtcctcgccatcggtcacagaggaagggacaggggactagccctcatctctgctgcccaccaattccgccgatgacagaggaagggatggagggcttagcccccgtctctgcccaactccgccactaaccacgtacgctggtcctcgccgccacagcaaccacggccgccaccggagctcctagctgactggcaaccgcctcactgccacctccctcagccacctcgggcgccgccgccacctctgtcggcatcaccgccgctgtgctgcttgccagatccaggcgagtcttgccatgtcgccccatccaggagtacggaggaggaagccacgccgccagccaaccatagggcgccacacctccagccaatacagagcatcgtagtgatggctaggatttgaaaaactgcaactgaatctgaagaaccaaagaagaagggaaggaaaagaaggggagaagaagatgatggagaggaaacaaggagggcgggggtggcgccgctgccggctccaccgccggtgacagcctcgccggtggcagcagggtcggccggtggaggatccttggtggcgaagttttttggtctcccgggttgctccgtgggagcgacacggaagttggttcgactccttccgtcggtcacaacaattggtaggatcttagagaatctcacatgatcctacaaatacaatgatgcccttccatttcacagtatttctccttattataaccactttacctctttcaaactgtttaattactgagagtatggaaacactgaaataacatcttgaattctgtaatgcactaatattgacatagagacattgtgaggcggatagactactacgaaacaatcctgcattcgtaatatattaaagacgataacaaatactgcctaggatcctgatataacagtcaccgctacatacaggtgggatgtgctgtccacaaggttcggagttcagaataagtttattcagtatttctggaattactggccacccagtgaaatgttactatctcctttgatgtccaggaggcacatggaagcaagtgtagcctacacatctattgtcaaaattaatccaacggccattttctactaagatatcatctggtttaatgattcccctaccatcagcaaatgactgtacagctttcaacttctatttccaaatagcatttactagtgccagagtgaaacttgctgcagcgtaaagatgccatttcccttgcgtgtgcactctgatgtgccgtctggttacaccatcagtgctctggtgaacagtgcatgccattgctcaggcctcatgctgttgcactgagccactgaccatctggactcatgatcccgactcctctgatggcagtggcttcgatgaaagaggttggtcaatcaaccaacctgtctcaactcttcccgattcagcagcttcctaaactttttgctctgaatttccattagaatgatgtcggagcattgtgctctttgcatgttagcagttagcgcgaatactctctgccccctgtagttctttttttctcgtgttctacggatctgctcaaacaaagaactaggagaagtcatctcatacatttccaatttagtgccataaatgattactctattattttccctccaaaatgatttctttaagaaaaaagtaatgatttctttaagaaaaagttttgtgaatgaaccccgggcattggattaatttagacagtagatatatgtaggcaacatttcaccctaagatgcctcttggatgtcagatgatccagttcccagtgaaatctggtgacctgcggtctgcggagactgcaagctaccatagttattgagaccggaccggaccggaccggcggttggaccggaaaaaaccgaaaccagagcctccaccggtctggtccggatgaaagatcgctgtgcaattgactcggcagaaattggatggaccgtccggtttttcgttaaaaccagctagaaaaccagtccttgatccgccgattgatgctaactatggcggggcgcgtgcatgcatgagcgacatgagtggagaaaattgacaaaaaaggattttggtgggaattgaacctaggagcacatgcaaggaagccacgcaccttcccaccaggctaagcttgcccttatgtttgaatggaatcagtagtttatataaacattattgaactgctttagaccaggggttcaattggtcagaccaatgaaccgttgaaccaaaggcttcgccggttagattgccggtccagtctcaataactatgccagctactgggtagaaatttaataaaagaattgaattttgactggtaaccggctgatacatttccaaatttaaagttccggtttcaaatttgaatttatatcctctggctggtaaccgcccctaatttttctttcatagtgttggagaaacaatctatcacgtgaacgtgcctttttgggacccaagcaaatctcactccttttattgcgatattagtcaaattttccatcttttcactagctatttctgattcagtaatgcttgtcaaatattttttgtcagaacgttgtgaattatgtgataaatggtatttttgatgaggcttaaggccaaaactatccaacattgaattgagattcaattacatgtggttttgcagtgtgttctgttcctcataatactcttatggcattttgtgttaggtatcatttgtatgtaattatttgtggcagtgcgctatttgtttcgtctggatacttttggccaaattggctaacagttattttccagatatttatggaaatattgttatggttaaccatggactaagtgtatttcatgttatttttctgcaggaatccaaatctgcactatttcagccttcctgccacatgtataacttatgatcagttccgtaaggcaattgacaaattacaatttcttaaaggcatggcagtggatgagggtcttattaatcacgatgttctcagccatgtacatcagtgttgtccagattttctggagttgaaggtgtttgctctttatgtcgacgaagagatggcttcaatcatttgcaactcccttccacgtctgaagaagcttgagataccaaactctgatatgtcttgtgctgcaataataaaattccttgattgcctagaggagcttgagtacttggacatatctggttatgagacttcggcaatatcaagtgctgtgctccaaaaagcttctcggctgaacatcttcatctggaactcaaaatttgagcttggggagttcacggactgttcgaattgtggtgaacattgcattaatcctcaagagccttgtaagtgcgtgatggagcacagagtcatggactggctggctggaccttcacaaccttcctgatgcagtaaactgtgacttaagttaaattgacaatcctacctgctcgtcaaatttcaacatttgtctgggttacttgtcaatcaaatggtgggtaaggtggtaccacgctttgatgtgccttatgtggcactttattttggagtttaatatgtatgtgatatcacgatttccagcattttattgtcaatgatgtcttgtgagaacgaagcaacgcacgctacttggtgcagtgttgagccttgttttacaataaattttaagtcgttgcagtctcttgggcctgagcgagctggcaaacgcatggctgttcggctgttccgcctgtgcagagtactctgctttgtactcttttgttaagcaaaagatgccctgtgtttcctcgagaggcatttacgttggagatctccatgattgcactctttttttttaagttcttttactgtggtctgtggagtgtggactactgcatcgtggtgtgaattcttttaccgcctccgcctccccctcgcgccatcgccatcgtcgtctccttcggctcgcgtcgccactgccgccgctttctccaccgccgtcgccaccgcctccccctcgcgccgccacctccgcctccgcctccgcctccgtctccacctccgcctccgccgccgccgtcgcgccgccatctccgagctcctccgcctccccctcacatcgtcgccgtcgcggagcggcggtgaaggcgggtgctatctccatcggcgacgaggtcggagcaccgacgaccacgccacaggtcccagtctccctcgaccctagcagccgcccttagccctccgccctctgccgcctctgtcccatccgccgccaccgtctccgtctccgtttccgtctccgctccgcctgcgccgttgccgagcgtctttccctcgcggcacgccgtcgccgtcgctgggtgcgccacctctgcatccgcctccatctcacgccgccactgccgccgtcgctgccgaccgccgacgtctggatccggcctctggctcggcggggtccagctcggtggtgaggagatccaaggccgtcgagcgcatcctggatctccggcaccaatgaccgcgcgcatggaactggcagtggcagtgaggagcacggtgacggcgcgccaatttctgagataagttttttgcggtttgtactagaaagaatagcccttccaattttttctgcgtcgcccattggatgggaggaggttagaagaagatagaggcagtgttatacagggttccaccgggtggcttctcatggaggatgctggtacagggagtggtgaagcatggtggaggatgcaagacggtgcggtgctcgagaggcgggcgcgaggtgatgtccggatgaggtcggcatcgggtgggaagaggacggtggggtactttctttcttaatctaggcaactcgttggtccatttttgcttgattttgtttctgcttatgatggttgaaaagaagtttggtctttgcagcttgatgtttcccctttgtgactgttttcatgtacaggtttggagttgcactaaatcaaaaccgcatttcatcaatggtatagggagctccgtttcagatttggggaagcacagaacttgtccatgtttgaggatggcaccgttgtgtcaaagtccgaggaggctggatttacttactgttaaagatggtgattatccctcttccttaatctccctgtcaaatatttgctgttcagagtgttgaactcaatcaactgcttatattaactaatgaaagtttggtactttggttccaaggttcttttgtcctgcactgcccaaagctataaaaaccatgaaaaaaagcagacaagttgctccttacagctaaaccatgaaaaatattattcagtttacttactaaaagcaatctatctcttctgtcatgcagatgagaggcctcctgtgatttacctgtaggatcatgtgagaatacaccaatctgcaggcggtatacattcatttatctgttttttctggaaatcctataggagatgcaattctgtcaacataagtgtgtatagtgtgttgtggagtctgatcgaagtgctaagcattcatactcagttctgtgtccctgaaacttaattttgtatgtagattaactatcacagttgtctctgaagtgatgatacacttctttttttttaaaaaaaaacttatatctcgcaaactgacttaacctttgatatcaaattatttaatatgtaggaaaaaaaaagttcagattgtcgaagcaaagctgactggacaccatgccaattgctattgtttactgcacaatcaaggagatttttggctgattctactaaatttctgtttggtaaaggtaatttccttccatcatgattaccccttacaaatagtgcaaatgtctcctgcatggatcaatcttcgctaaatggtctgtaaacatttctactgcaccatgctaagggttaaattgtagccatccagtcaagaatttctttctttgaacctacagtaccttggacatacaagcagatttctctttgtgctgatgtcatgtgccgaatacttcgtaacaagggagttgtgtgggctgttaggattcacgtctcagtcattcagtttctattctagatagcaaaatttgctatagggcatccaaaaaacgtgtaatttcacaatgtgtctgtgattaaattaaactgattactccaaataaattacaagaaccacatccacgtagcttattaatttgcttaggattacaaatgattccgagcgccacagtcagtcctacaagatcagcgtcggcagtcctctctgccctggtacaatgcgagctccttcctcttcttgatctatcctcaattggactaaagtcttagaaaaaaatacaacttgttgatcatgcagattaaggagtgcttgaacaaggttgcctagacggtgtttttcctcgctcatcctgaaagccctgatcctgaaggttcattccttctattactgacatcataactgaagcttgcaacagtttatgtgtcatattaatgccattggtattcaatccatttcctgataatatagaattgctcttattttccttgtaaaattatgtgcaagcagtaagattttaaattggttattgtcttcatgatcattggctcttttttttccaatgaagtgtattgaactagagcaaactgttactctgaacatgtcaaatcggtcatttatctgaatttataaaatagcgttaacttcctttttcgttcacaaatttcttgctttgcaatcaatataaattcagacaaattttcaagctgttaatatatcaatgaccactacatatcctatagcaactaattaaatcttctaataatggagatatttactaaaatataatggagatatttactaaaaataagatggtgttacttatttcagattcagcacatgatttatatttcagattttgtatataactcagtttaaagttcagaatgtaaataggcacaatatttagttgaatcatttggaaataaaacatgcttatgctgaactgctggtatccctatagactgaacagctagaaaaacatgcgtacactgaactgctgataagacagtttaagttcaaacatttattaagtatactgaatcattgggaattcctgtagattgcttccccatttgaattttactgacattacccatgtactgtatcaatgttaaattttggttgcatcaataaatcttctacttgttaccagcatctttgtcgcacctacttaatttgtttgatataacgaaatgaacaaggatgtgaactacagttggtacactgaattgctaagagaaatgcttgtaacaacatgtatattgttgataatattaagtattttcagtaaatacctaagcacaacctgtactgattcactatgctatgctaaggtgcatccatacatgctgattctgtgctctcatcccattattctttgacgcaagatgatcaaccctgattttgtatgtgatgtctaaaaatttgcaaaggttgagtggaactgatttttgtatgatcaaaccattattcattgctcatcccagttttagactagattgatcaagattcatcactgatccaaattttgccatgaattggacgaggttgataaagataattgtatgatttcaggcctaataaagttgtatgctttagaatggtcaattaattgcatgttttagacccaagaaaattgaaattaaactacggatcttattttatgaaagatggcttctgtactcagctcactgaatcaggttttttaattgaactctccgatacttaagttaatgtgttgaaactatgcttgattgctaattatatacttttagttttgccggatgtcatatgtgatgcttctgagggagcctaatgtacagcttgagattatttactcttaacctgatgcgctcatatgtgatgctcctggaggatatttatataaatcgatgtcgtcttctcaaattataatttactgtttttaataatttgtactggcatatcaaattactgtttttaataatttgtactggcatatcaaattaactgatgtttttaataatttgtactgatatatcaaaatcactgttgttacgcttcatggctcataataaatcgctggtgcattgatatctacatgttttcacatttgctatttacagctcaggtactttcagtgaacatgaagcttactcataaggaatcaaaccaattgtgaagatagcaggtactctgagaattgacagagatgagagtctggctaaatagtcagccatgtgaaatgccttaatgaactctgtatttcgatagatgagatagctcatttaggcagtacatacatgacgtgggttcttcgatccattcaaactctagtgctgatccatttatagatatttctcccttgcatatgctctttgcattgactcccaaccatataacattgcggggccctaaaatttatattactacctacacgaaatcagtgtaatgcacaatttattttttatgtagatatattgtactcttaaatttgtttatacaaatgatttttatttttaggtaatacaatattgctaaagtacctaaatgaaataaatgtgacatgatatccaactagcaattttcgattagatgaaatgttatgtgatttgtttgtaaatcacattatatgtttgttgtggactaaggtagattgatgttttatcggataggaatggatccaaatggatcggcgtttgaagaacgcgccccatttcgagacataactaatatttcttcaggtattgtgacatgtatatattttggactttctttgtgatctctacatactcccatcgcatatattcatataccttgtctgctgatttttcgataagcatagatgcaagagctggaagtacaacttctactaagcttcaacgtaagaaggagatgcttattaatatcatattattatgcattatgacacgggggcacatatatatgcattatatatgtgcatgaattggcatatcatattattatactttatgttaaatatatttgtgcatgacataaattgaattaaagctcaaatgtaccgttcatatagtaatattttttgctaacatgaaaattttaaaaattattaaagacaaatagaattacaccgtagcatttagcacgggcatattactagtagatgttaatgtaccagctgcagcctgcaaaaactctctccatcagcaactttttaatgctcattcagttctttcacaaacaatgcaaatactaatagaagtattttcatacaggcaacactaagcgtacgcttgagctgtgtttctgtgcaaagaatgttgatccaacagctgacttgaaaaagtatatcgaagatcttgagtgcctagaccgttcaagcaaattctatgctgttgctgtgaataacacattcatgaagcaggatagagttgtaagttcctacacctgctgctcatttatttatatacaccatacatggctatctatcttaccaattataagtcaaggctgatatacaatgccaattacagtactttacgaaagaattttctaaagactacttaaagccattgatggacggcaaggaaaccatcagcattggagttcaaatggcaggtggtgtttcaaagaatatgatgctccagatgtcaacggatgatcgatgcaacctgaagaaagtatgggcaaaatttgcaacccgcaatcacatatacctacaatcactatgcaccttccatttcaacaaaacaactcgcctggaagccaccttcgatgttctataaagaacatagcaatactcatggctatgttgcagccattcttttgctgccaccaaccaggttgatcactgtcaagataacctgtattagttctaggccttacatggtaatcatggaacctcctaatatgaagaaacatctatatatgtacttactgctattagagacctctaaatatcaagatgcctgtgtgtaatttgtactatggacacttcctcatactttctgcccctgcttgcgtccaggcggcgcgccaacggcgcgcccctagctctagtgtgcttgtatcaatcaaacaaaatgttgacacatacagtttgtgctaaatctgaacatatttttcttcaggtgctgctacctgctagcctgctgcgattcacaagcaaaaccgag

SEQ ID NO: 79300 - DNA, 1124 bp, Oryza sativa
gggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggttagcgttggacagcggatgtttaatattaattaattgttacaactgtttaaatctttcaatttccgtttataaatgctcgctttatgcaaatgagccactctagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcaaagtttagtcaaggcttagctccagttatcttttgttttccgctgcatttttgtaagacttttatgatgtttgtaagacgtggatctgtatgtcaacattgtcgcttgtgtaccccggctggtcctggacggggatttttatgcacattctgcttggaattctattcgggaatttctgggcgtgacagtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaaataattaattaaccaatcacgattgaccatcgtgaactatcattaagccatcattaaataatagtgagtcataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggat

SEQ ID NO: 79301 - DNA, 619 bp, Oryza sativa
catgctttgtcaccatcttgcgagccacacaccaccaggtagcgaagccagatgtcggagttgcgcatgcgagtccttaggtgcatccggactcaatcccacacttgttgtgagaagacgcaagcttagaagatgtgggtacatcgttggcagaaagatgacatcggggggctagggatcaggatcctctgcagtcgaagtcacgtgactttgtcactaacatatgagcctgatgatccctaggcccacatgtaagtgacaaaagtatcgtgcatttgactgtagaggatctcaatccgggggctaggtgccaacctcagcgctgcaaatcgttcgttgtgaggcaagcgccccgcatcacacaaaatattggagaacttgcatctcgccggaattttttttattttgtttcgatcaaattttcaacggtgcgatcttctcccgtgaatgtatgaatgcaggcatgtagtggcacccttagcccgttcaattccaaaatcttggttcacattttaggctgtgttttgttgggccggccctgtttataagtaaacaaggtaacaattgtggcccttgtctattttagcaaactgctatagtatcatatgttctttccttg

SEQ ID NO: 79302 - DNA, 744 bp, Oryza sativa
ataagtataaaccaaaagatgaggcccattagtatttacatgtacttcctccggtacggtaaaatctctctacactaatttttaaagattaagatccctctttacttaaagactacggaagagtgcatgacagatggagtagtgatgatggctgtggccatgtgggtcccatcgcgagctcactacaaaagctgccctgatgctctgaggcctctccaatctccgtagccagttacccactgtcccccccccccactctctctctgtctctctctctctcttgccgcgagatgaagaggaacgaggtaaaggagaaggagaagacggacaagccttcgacccgccgccgcatcctcggcgtcaccgccttcatcgccgccgccgccgccggcaccttgttcctgctgtcggcgatcggggagagcagtggagacccggacaagacggcagatgatgatccgccgacgacccggacaatgaaggcgccgggctttgacggcaaggtgatgatctcccgcgacaagttcgagggtaacccgaaggagtacttcagggccagccggaagggagacgaggaagacgttggcgctttcaagtaacggatcggaggacgccggcaactaaacacagcctatatgtgatctgaaaactctgcatgtaccagctggcctggatgttagcttaaatacgtacgtatagtacgatgtactatgtcagtatatgtgtgtgatcgaggcgatgagt

SEQ ID NO: 79303 - DNA, 9667 bp, Oryza sativa
gtggatcccccctgttttcaccctctccctcatcgtcgtcgctgtactcggcccgctctatctagctagttccactagcgggaaggatggggtcgctagatctggaggcctaggcctccccgttggccgatgtgacagcggtactgggcagcagtggaggcgactgcaaccagcggtgttggaggcgacaacaactggcgacggtggagagagaagggaggagggagaagagtgggagagagatagaaagaggagggaatcagagggaccgagggaggagggagagactcgagggagtttggtgggcagtaggtgtggtgggctgtggattttaatagcgtcaaaatttgtttcgcagcggtgccctttacttaccgctaacaaaacccgattttcgcagaggcctgcctcgaaaaatagagttggttttttatagcggacctcctaattgtccatcagcgaaaatccgttttcactggtgatttgtgatccaaaataatctaatatatttttacaagcatttgtttcgttattccgccggcaaaaataaaagggtaacgccatgaaaaattatttttatagtagtggccatctcgatattacattatattgtcgaggaggactgcaagaggcgaaggctggagagcacgagcacctgttggagattggggttgcaaccaggaagttagatggggaggggagggaagatgatcgagggaaggtagaagaaacctgctcagagattcgtgctggacgcgtgtgaaatccttccgaaggagtgaaggacgaaagtcctctgtaattttcttcagctcgagggccagtcaagcaaatcaaggcatcatttctagaggatgctacgtccggaccatagaattttaattgaaacattccttttcttcttttttttttttttgcctacagcaattttcgtgtttggttacttttcttttaggaataacttgggccaaacatttgaagtataagagattatctggttcacagaatcacagccaaacgttaactcactttaccgcgtcacaaatagtcacgtttaataaacttcgctgcctatttggttgaggtcacactggagtataacatgattctttctcttccatctatattgtttgattgcatgctcactcgagattattcttcttaatgaaataaaggacatgaactttaattaaggagctgtgttgtattgtagccctttcatgcaaccatttgggcccacacggccatagtgaacgggcaaagggagggtaaggtggacacacgcagctggtgggaaaaactcaaaaactgttcttcaccgtcacaaatttgtttggcacaagagcataattgtggagattatgggtaccccatacccacacggcatggttatccgactagtcataggggatagcttatatctatggaatatgtaaccgatcatgacttgggtattacgtttccttttatattatgaagcggcctaaagtcctgatttgataatattgtaaaatagatttaggaaaccgataccgtattggttaaggtttctatcttgtaatcctgccccccatcctatataaggtgggcaggaggccctctagggggcatgagacaacctgatcgtcagatcaatacacactcggcggattcaaatccccaaacaggagtagggtattacctctcatcgagagggcctgaacctgtctaaatcctttgtctctgcatccatccacttttaggtctcgtgcgctacccccttttattattgccgaattcatgtttcgacagttggcgcgccaggtaggggttgcgtcgagtttcctatcaacgagcgcgatggaatcaatctcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccaccggcttgtcctcgccaccgccattgctgatagcaacaacgtcttcaccgaccggctggccttcgccgccgccgactggtgtttccgcctgcacggctggtctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctacacagtcggttggtcacaccaccgttgatgggcatcatcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgtggggcgtctacgacttcaccgccggcctgcctccgtcgccgccgattggtgcctccgcctacacggtgtttccgcctgcacggctggcctattatgccgccgttgttggatgtctacatcttcaccgttggctcaccttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtagcgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttttgcaggatccagatccggatatgcataaaagggattcatggctttcagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacagctggcctattatgccgccgttgttgggcgtctacgtcttcaccgaccggccgccgcatccgctgactggtgtcaccgcctgcacggctggcctgttataacgccaactgatgctaccttcttcacggctggctacatcgctgtcactactaataggcatcagtatcgtcaacacaagctgcctacgtttgccatggctgccgactgatttcttcacttccatggctgcatgattctgccagtgttgattggcctattatgccgctgttgttgggcatctacatcttcatcgccggtcgtctcgtctgctgctgactagtgcccttacctctacgtctggtttatacagctaccactactgatggacatcatcatcttccgtcgccgactgattatgctgccgccgattggtgcttttatcttcacaactacgcgtcttcactaccggatttctacttggacaccttcaacacatatcttcaatcaagcaatgactactcgacgacaagaagctataattctcgactctatgttcagttgtttctcaactaaccaaagagtcgggggctacacaaatataaggctcaaaatcaattaatcagccaatgagtcaactccaggagtcattatcttcatctttgcttcggagcagatgttctacttcagcaacttcaattatttcaccgacaattttggcttctcagcgctgccataatctactccaaaattctcaagtatcaagttcaagatttaatctacatgttcggaagtttggagttatcaaccaatcagctcggtttagacgagttggacaacaacatctactttcctccaagtgaagcatctacaacagctgtaacactaagttctacagtcatcttcgtaaatcaagaagcattgcattagttttctttatgcacacgctcacatcaaggaaacttctcaagcttcgatatcttctcaatggtttgatggattgttgtcactggcattatcaccagcacgtttacttcatcggccctgacgtctccgccgttgctaaggggtgactacgtcctcaccgtcggttacttttgtcatcaccgactttcatcgccgacttgttatttcgtcttcacggttggcctactatgcaactgccgatagaggatctcatcgttatcatggactgctacactactattgactagatcaacgacatggttatcttcatcaaacatcctgtcaagtctcttcaacatagcctactctgctgtcgttgatgggcaacttcgtcatcatagccggctatctctgttgccgctaatcatcattaccgtcggatgcgtttgccattgccgactattttcttcatcttcataattggtggatttcgccatcaccgttgatgcgcgtctacgtcttcatcgttggtttgcttttgtcaccaccgactgttctttcgttgttgttgggcgcctacatcttcactgctagctgacctgactgttgccgactggtttcttcacctccatggttatgcaacttcattacatttgattggtggcatctttactaccactgacatcttccgttacttctgatgagcaatttcgtcttcatgttggtcatttcatctccatgccgactgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaatggtgtcgaaggcatattttttggcctaggcctaatatgtctgcagcccatattttcaggtgtggcctgtcacgttcttttagggacttaggcacttttcgcttaggccaaagtgcgcgtaatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtgggaccatgtgtcttctagggacttaagcacatctgttaaagcagtgtgcgcatggcgtatgcccaatactttggaaatttctttattcacaacatacaagcttctttatagctattttgctatgtgaattttcaatgatgtagtcagctttaggttgcacgcatcatattttacaaagcagtcggtatatcactcggatcatgttattcagggattcacaccgcatatgctatatattaatattaagtcacttgtttgactacgattatcaaaaccactcagttggtgcatctattaggtacatctactcgatgcacctgactttatttttcagccctccacagtcttcatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagtcataggggatagcttatatctatggaatatgtaaccgatcatgacttgggtattacgtttccttttatattatgaagcggcctaaagtcctgatttgataatattgtaaaatagatttaggaaaccgataccgtatgggttaaggtttctatcttgtaatcctgccccccatcctatataaggtgggcaggaggccctctagggggcatgagacaacctgatcgtcagatcaatacacactcggcggattcaaatccccaaacaggagtagggtattacctctcatcgagagggcctgaacctgtctaaatcctttgtctctgcatccatccacttttaggtctcgtgcgctaccccttttattattgccgaattcatgtttcgacaataatcattaaaacagcatcaacaaaaagatctaattatcacgagatttcttcagtacgagctttgatcatttggaaaggcaaagcaaggggtccatggccacgaactcctgttcggaaaaggaaaagaccaggatgcatagcatagcagtgagagagtacaattaatgatcgatagcaaaaggacgatgcgacgctacatgaaaaccaaaaaaccacaccagcacacacatgcatcaatcggcattattgacgagtgaggaccccgggcatgtaatcgtcccgtcctctgtggagtgtggatccagcatattgattccagattcagattcagctatgcaccgaatcgaaacgacgttggttgtagcgtgctgcgtgcatcgtcactgtatggtggtggttggtccaggtacgctcgctcgagattggagaaccaaccgggcgggccagacggcggtggggccgcgcgcgcgggggccatctccccgtcgcttttgccgtaaaatccaccgtcccgtccccgtcccgcagagctgggccaccggtcgactactcatacatgtcgctgtgtcgactgctcgtttgctacttacgccgagcggcgcgtgcccccgccatgtgacggttttggagcatgtactgtacaaactagtagcacaagccagcggcagtggagttctcccgtggccagacagcgcgcaccgcagagtattacaagtggcgcgctagatgctgcatgctgtctgctgctcggccgtttcctccttcctgcaacgatcgatccagatccggtccacgggtagcaccgtgcggtgtctcgctgcttgttctggggcttgcacaccaacgttacaccgcacttgtacctttgggttacgtggcaattaattatctgtcattcgttgtctatgatatatgggtccagtggtaaataatttaattattctttgggttaattattctttgagttcggggtatctcacagcttgtagcttctggggcttgcacatgcgcttggtttctttcttttttcgtcgatttgtaatatacgtttgttgagcctatagatgttctgggatattgtttgatttcgtcgattttactgcaccgattggttttccactcaaactggtttgccatctttgttctcacgttttcatcggtttccaaatttctgctcaaacaggttttcattggaaacagatcaaaattctgttgcttttttgctcaaaaccggatgttgggattcttttttctttttttttggacgaggattaggattcaaatttcgatttgggaatatttattggttcaagaatttcattattttgctgatgcacgtatccttcaaatggtactgatgtacgttcactttatcaggaaattggaatggatgagaaaggcggaactaggctctgttctgcttttattatctccatcagcaacaattcaagaagataattaacggtaatcttcctaaacaactaaaggaaggcctccacagggaattgaatctgtggttagcgtcatctcgctagaagagaaggacgaggtaaaaaaaacacataacatcaacatttaaattactaggatactgaactgtattataaagtactgatgtataaatcatttaacctccattgtgtcatagaaatatcaggcaagatcaaaaattggtgacaaaaccttgctacgctacagaaacctgagcttgtgaaaatagccgaacaaatataacgatgctctctctctctaaaaaaaatgatgctgtatgcaaaaatagttgtttccgaaggtatgcaaaaattgtattatccaagtctaatagagcttcagttggcaaaatgcagggcggtgaacaacaccatcctagttcaatttataggctgcttgagtcccttccatagatgaaccgcctgccccaatcagatactaccagcatcctggtgcgccagctgaattgcttactgcattccataagagcaaaacgccattaaaaactctacacgacacgtccatacatgcgagggaagatgaagtgcagaaaggaagacaagcatgttcagtagggtggcattattaatacctggcatagacagaataccatagccattgggtgctgtgaccaacatgtatccaatcacccggcaattgagcggctgtttgctctccacccagtggagcaaactggccaaggtgcctgtacctgtaaatcataaagggcgaccattagggactgctgtattctggatgccatgcaaaagaaatctcgtgtatcagcaatatgtgacaagattggtaggcttttgtttggtttgctccaccaactttggtttggcaatgccaattgtttttagctaccaaccagttagatgactaatttattggtgttgtcgatttcttggcatagttgattggagtcataaacaaaaaaacgggggatc

SEQ ID NO: 79304 - DNA, 732 bp, Oryza sativa
gatcaaattatcagcccattagaagtaacgggccattcaacgtgtgactgagctaacttaactgatttcagcccagtttaacgtcgtcaggtgtaaacattgaggacacatcatatggcaagcaaatgggaaataaacgattctcaaactacaaaatctcaatcagtactcgcttcagcatcgaccatctcaatctgacttctacacatttcatcaggaaactgccttgagggaggaactcgctaagtaaaatgtcgatccatcctagtcagcatagtcaggttttgtacatcagtcgttctttctactacgagtaggcacgggaaagaggattgattaccaaaaggggagcaggagcgtcattctttggatgaagactggccatggctttgagggggctaagaagcacgaccttccaaaatcagctccttttgaatcaaccatagagggaaacagcatggtggtcatagttacaacaaatccagcttacagttgtctggttgggtgcaggttgggtgttctttggaacaggatcgcgtcataccaccctgcacaattcacaactgatctggtcagaaattaacacagttcagagtattaattaaaaagttaatttgctacatgagttctgaagcaaactgggaaggtccctaagggcagtcccaacccataacactagacatggtttccataaactccacatcatcaagaaactagtactagacactactc

SEQ ID NO: 79305 - DNA, 12543 bp, Oryza sativa
ttttagctttaagaaacatgtgggccttcatcagttgatggaattcaatatccatacattttgacggctgggattgaagaagattatcttttcctttggctaatgatgtaaaggccaagcatcccttttctctgtcccccagaaaacaggcccagttcttggatactgtaaaaaaaaaggacattgtcaaagggagggaaagtcagtagtatcatatattgagaaacgagtttaaaactatattgagagagagagagagagagagagagagaaatgcaggaaaaagaaggatgctctttatttatggtgaaaaaaattatagaatggaaaactgcgatttttatgtgcagtttaaaatacgatttgaccaaatgttaagctaagcgtgttctcaatgtttttgttgaaatcattattcagtaatagtatgtgtatggaataaaaaaaatggcactcttgttttaatgtataaatgatgtgaaagatgataatttccaataaactaacttgtatggcgtgaaatggaacgaacacaatcacaacaaaatgtgtaatgtaaacaaaaatcaacatgaagacaaaggaacagggaatatattgttctttttagaaacatggtgaatatactgccattactatgtagcatcaatgtacaaaatttgctaaactaatgaagaccatttctatgagctctctgagttggaccatagaattccagatttgttaattaatttaataataataataataataataataataataataataataataataataataataataataataataataataataataataataataatatccagtcaaatccatgtttttacgtcatctcttgaaaacttctctaagagtatatcttgtaatatatattttaactcggaaacttcaagggtatcgcttgaagcgataagttaaaaaggagaatatcaaattaatccgctagtaataggagcattttcttttgtaatttttttacttttaaaaagtcaaagctatttactataacacattttatcatcatttcagtattgggttgattataatacaagatctctcaaattttgccagactagatcgatttttgaagcagccatgaatttataagtttttatggctaaaatatgtgccaacacagagtaaattcagataccctattggttatacccaatcctcctctaggcctttttattgtggcctgcgtgaatcgtggtctaaatggctgtaaaataaaatcagctcacaatgcgctcgaatttccccttttaatccacttagattatgtttatcttttttagaaaaaataaagagtaaattgcattttgcactgagtaaagcgcacccggtctcactttacaccaggtgctagtttagcacgtacttttagtttataccaggttgccttcaaataaatttcagttaacaccgggatacatcattaaacctataaaaatttcatgaaattttatataaaatgaatgaaactttgtgaaacatggtctatttttttttaaaaaaaacataaggtccactcgtgatttataaataatttccttcagttatatgacacaatctactgctacctccgtttcaggttacaagacgttttgactttggacaaagtcaaactgttctaagtttgtagaaaaaataaaaatattttcaacccaagacaaatttattatgaaaatatattcaattactgatttaatgaaactaatttggtattgtaaatattaatatatttgcctcaaacttgaagcagtttaactttgatcaaagtcaaaatgtcttataacttgaaacggagggagtacaaaataaaaactatttttatatatcctgatgtaaaataaaaatatatagtaaacccggtgtaagtgcaaaatactatacaatttactctaaattaaatgtttttatgtttttttttctgttttggggtgttcttgttgcctctttcggaccaacccaaacccccccaaatctcactccccaaatgcctcctctccactgattcctctccgccgccgccgccggctcgctttctcgtcgccggctcgccgcgccggcggcagcattgtgagcctccctcccctccctgtggctgtgcctcccccggtggccagccgccggcctttggcagtagtccctgcgcggcggcgggccggcggcgaggctggtctggacgcggcggaggcgactccgtccttccatctcggcttcgaatcgaattcgaaggtatcccctctctccctcctccaccaccgccgccgccgccgccgccgcggcgtggactgggaatcaatccgggcttggattggtttcgtttctctctctagtgaaaccctactagcttcttcaggatttctttgatgggtgcgtggtgtagaagaagtagaactaataacatcttgtgcttgcagagagagaaaaatttggggggtttgagctgagctgaccaccacgtctaggtcaggtccacccccctgctgttcaagctgtggagtgaggagatgcgtctacttttgccaaggaattagcgaggcattgccaggtttccgatggataataagcatcataagaatgttgaggcagggaaaagctcattccacaggatggttcttgggcagcttgttggggaattcggtttcgacgaggagaatgttccttgcaatactccgagaagctcggttcgctcgcggttcggtgcttcggctagcagaatcgtcgcgtctactagcggtgcgtcagttagccccggtgagtatgtcagagatcctgggtccatattgagcctgcagccttggatctttaagaggagtggctctcagaagaatgaggaaaagatgatgctcgcaagtggtagtagggttgttggtgaaggcaagaatctgatggattcctttcgagatggctcggctgttgaggtctctccaaggagccctggtcttggttctggacctgggagaggtcgaggtgctcttaggagcagacggtcgcgtaggcacttgattaggccactcgtgccgatggagaattcctacattcctcaactttatagtgcagattttgaaattgatgagtgcacgtttgggccagctccctcccccgcttctgctaggccgttcatcgtaacagatggaaggagagtcattagtaagtcacgttatcaaccagtgcctgtaccatttcatattggatttgagaaggaagggcgtcgaaacagctcagaaatggtggaaagtgtaattgggattgctcctctacctgagctgaagaaatcaaaaagggagaggcagggatcacacaatggagggatgggtttgtctgctttcgagagtagtaagccatcaaaatcaacaggtaatttcagcatcatgctgcagttattgcaatacaataaacacataactccatattctaaatattttttctcctcatgtttctgtcacctagaatactagataaaattcattggatcaaaataggtcagtgttccttggagttgatcctcatatgctctgacatgtcacagtaagcacaactcctgaatttttgttttcaacagaacacttttattaggttaagtgttgcaattgatgaagtaaaacttttttttttcaagtgaggtcaattacatcgttcttaaaataaatggaaaccatacaaattaggctaccatgcctattagagtttggctatgttattcattggttttctgagaacccagacacccagttctttgtcctgtgtttcttggctcaaccacataggaataggataggagacttacatctatcatctgatgatgtggtcaacactgacatctatgccccagtgctatactggaatgcttgcagtggctcttctgttgaacttctgttcgttgtgatgagattagttcaattattatgtgcttcacttatgcactactcttctcaagtcagtttccaatgtttaacaatgttctcagtggtttaaaatgtattgatgattatttcaagaaattgtttaatctgtgctcattactttgtactctgagaactagagctcttaattgctgagataatttagaagagattacagtccatttatcatcgagccttgtatgtcaacatgatttcgtgggcatttgtctcttctgatgtcctctttctcaaacccaagtaaagcctattaaagtatcattttttaagcatgaattacatgctaaatacatacatttgatctgcagatttacttgctcgactgcgcatattctctactggtgtcagtattggtattatatcatccactttatcaaacaagaatgagcttgatgcattaaagggtacagtgaaacgaatggagaacttgattcaagatctgcatgatgagctggagatgagagagggtttaactgtaaaggaattgcctaatgaaatgtctgtaaaaattgatggtaaagtatcaactaccaaaacaaagaactttcttttacatacacaaactgaaaagaattgtattgtttgttaatgctagatgatgagagcaaagctcatgtaactgattcagagcccatgagcaaaatcgaagaagagcttgaagctgagcttgcgagattggaattaaatataacttcaaactgcttgaaagaacaaacatttgacttcagtgaggtaacagttatactgaaacattatgcattacatctgaatgtggccaccttctacaagtctactgaatagataatcacttttctaggttgaacaggatctcattggagatattgtccagggagaactgaagatcgatacaacccattgtgatcttgctgaccacagcagtgagagtgcccatggcagggatagtagagaaagctccccagattacacacatgatgcaaactatcctgtctcacctagggatctcagcctccgtctccacaaggtaatccaacagagactcgaggagcgaatcaaggaacttgagacaacacttgcccagagtgagatgcagacgcaggtgcaagtgatggccaccgagcagatcttgtgtgaaagaacctgctcagacagtgattctggttctcccaaccaggaaagtccagtgtatatacaagaaactaactccttggtagaaccgttctgtctaaacctagctggagacgcgctagaggcttacgatgaagcttatgaggaattcatgagaattgcggactccccttgcaccacaagtaccaacgggaagcctcaagttcatgaagattactcggtggaccgcagcttgatctggggcttggaggatggcagtgcaaggaagctgaaaaaagtgcccacttgggagcgaattttaaagagcagagagcctaacagaactcaggagagtgacggagatgatgaagatgaatttgaagatgatgaccaggatagtaagatgctcatccaacagattatagagagaactaaacaaggctcacctgtactaattcatgctcaaagaatattgttttctgtggatgattagattgttggactatattgaattagaatttagtgccaattgattgtttagagaaaaaaacataatattattcttttcatcatcttccggtgatacaatttttcaatgtgtgttataagctctgctctgcttctcttgaaacacttatcgatttcaaaatgttcttattcattaccgggttgcgtttagtccagggaggactgtgttgcatcactacaggtaacgttgacgactagtatggctagaacacacaaaataccgaataatttgaacgttattacaattttgatttgaccatgttaattgaacaagaggtgtttgagggcgttttaatatgggttgaagggtgttttaatacatgtattcgaacaggtgtttgaattcaatgggtgagtgtgttttactataagtattatgtaaagattagaaggtctcacccataataaattagaaaaggtgtatgtttgtgtgtctataaattgaaaaggagtgattgaaaaaggtgtatgttttcgtgtctgtataaattgagaaggtgtgtgtttccgcccatgataaattgaaaaaggtgtatgtttttgtctctgtataaattgaaaggagtgattgaaaaaggtgtatgttttcgtgtctgtataaattgaaaatgtgtgtttctgtataaattgaaaggagtgattgaaaaaggtgtatgttttcgtgtctgtataaattgaaaatgtgtgtttccgtgtctaatcttgtacacactgatcaactggaacttaagatgagattgaactaagatgaaggagccaattgtggtcttgtacccactcatcgattggaactaagatgaagaaaggagccaattgtggtcttgtacccactcccaaactaagatgaagaaaggagccaattgtggtcttgtacccactctcactcatcgattagaactaagatgaagaaaggagccaattgtggtcttgtacccactcatcgattgaaactaagatgaagaagctaatgtcgacatcactactcctctgacagcctaaaacacaaacaacataaattagatttaaaaatatgaatgaatttctattttatactatgataattcataggaaaaataagtaaaatgggctgattgacagattcttaccagtagatttgtttcccacaaatatcccataccctgaaacagctgtagatagaaatatgaacgtcaagcccatctcccagaaatagcactctctttctatatataatcttcttacaagcaattagttgaaatcatgctagaactgtgcagcttccatataggagatgtgaccttcacaatttcattatagtttgaagagtcactcaagaagtgtgatgtgtgcattatgtccattgttgttgccatgatgcttgcaggtgcagcggctctctccgatctacaaagcaaaatggaaatgatattagttgcagcatccaaaacatgttctagtgcatagtgcatgataatgttgttcagttgttcttgtgttggtttaacttttgctcgctaattctgattgtttgtttgcaaaatatcaccctgaatgctccaaatgagtgggaaagtggcatgggtttgaatctttgctcggataattcagataatcttgggaatatattgcaacaattggcatgctgaagtgatgccaattcctttttttttctctaggccgaggaatacaccggccaaacttttattaagcaagaggagatagtttacaacaggccaacacacactcaagccagggtgaagaagccccgttgcccactaatgccttagagcaggtacaatagcaggccctgctattagccagctataaatatattttaatgagataaaatatgagagagaagagcagcgggctacagatctgtacccagctgcagcacggactccaagacgcagtgtgtgtatgacaggtgggactatatattaatagtatagtaagcaactattgtatatatgaattggctattagattggttatagatgaattggagttagtagtgggctatactattaaacttgctcttaggggctgaactataggaacagaaaactcggtgaattactcacagcgcacttcgcaaccccgccgactttctagtctttcgttcctctttgatggttgtgcacacttgcatgacggatgctgccttccattcgaaaatacgggcgttgcgctcccacatcaaaagttttcctgtcatgctttgtcaccatcttgcgagccacacaccaccaggtagcgaagccagatgtcggagttgcgcatgcgagtccttaggtgcatccggactcaatcccacacttgttgtgagaagacgcaagcttagaagatgtgggtacatcgttggcagaaagatgacatcggggggctagggatcaggatcctctgcagtcgaagtcacgtgactttgtcactaacatatgagcctgatgatccctaggcccacatgtaagtgacaaaagtatcgtgcatttgactgtagaggatctcaatccgggggctaggtgccaacctcagcgctgcaaatcgttcgttgtgaggcaagcgccccgcatcacacaaaatattggagaacttgcatctcgccggaattttttttattttgtttcgatcaaattttcaacggtgcgatcttctcccgtgaatgtatgaatgcaggcatgtagtggcacccttagcccgttcaattccaaaatcttggttcacattttaggctgtgttttgttgggccggccctgtttataagtaaacaagtaaacaattgtggcccttgtctattttagcaaactgctatagtatcatttgttctttccttgtcttgtgcaaggctcctttttatctacaggctcaagcttaacactttgttaaggcattggattatagcctgatacttgttgttctattcaagaacaaaatagaaaagtagatgaacctaaaatggacaaatgaaatgaaaatgaaaaggccaaagaaaaaaatggcaccaagcaaacttaccaatcaagaagaagaatgcaaaacccagaatctagaaaaaatactaaatctagaaaaaaaaaactgtagtgaaatctaattttgatgcattatgtgtaagtgctatgtaactgaatgtaagtacattgtaactgagtgtaaatgctctgtaattgagtgcaactgtaagttggatatataggaacacgaattttaatgcaagatcctacggacgaaaaattaaaagataagagcccaaaaatctatcgtaagtgaaatagtaaaaccgaccaacagaaacagaaagaaaatggagggagcagtagagtttactcatagcttttcatatcacgtagctgcaaaaataattatggtggcaaattgactaacttttaaaaaaaatggtgacatatttatagaaaatccgttggttaaattaatttagagtaaattttacaaaactacatgttttatggttcaaattgtagaaaaccacacatattttgacacttagcatttaagtacatatattttggtagtttagttttacaaaaccacactatcgatgaatggattcacccgtgagataacatggttgttccatctaggatgaggacgtgacatcctattaatttcgtgcgatggctggtaataggatgccatatcctcgtcctagatgaaatagccacgtcatctcgcgggtgaatccattcatcgatagtgtggttttgtgaaactacacaaccaaaatatatgtacttaagtgccaagtgtcaaagtgtgtgtgattttctgcaacttggaccacaaaacgtgtagttttgtgaaatttactcattaatttaaccagcggatttgctataaatatgtcaccatttttttttgttaaaagttagtcaattttttttggccataggatatacattaagattcgtgctattttcatatcacgtagttgcaaaaacaattatggtggcaatttaaccatcggatcctatatgcctatacaagtcatcccctacaattgaaactaatttcctgtgatatgagtgagccacgtcacctatattaatcccagccatcatattacagatgagcgtttgttactctgcagaacatagatgtactctacaggtgaatgttctcctatctcaacgcatggcaccacaaatcaaagtgaacgacccactaattaatgtggtaacgcctaggagcccactaaagctcaaccgtttcatctccacgaaaaaaataaagaagctcaaccatttaatcccactaagcaacacacatctcaaagaaaaataaacggttgacgctattttaacttgattgatgagtgaagtaagcaggtactccctccattccataatataagacacaaccattttcttaatgctccataatataagacatgcatgcatgtagggaattaattatgaccccttctctattaaattattacttttttaaatcctccactcttatgttctcttattctattagatgcatgcattgtatttattaggatgatccaaattacaagataataataattatattcttggtctttggattaggggtggttatgccttatattttagaatggatggagtataatagcaggctataagtcggctataaacatattttaaggagataaaatagaagagagaagagcagcgggctatagatttgtagccagctatagcacggactccaagacgtaatgtgtgtatgacaaatgggaccaggtattaatagtgtagtatgtaactattgtatgagttggctgttaaattaactatagataatttaaagttagtagttggttatactattaaacttgctctaaacagtcttcatgcctttatatattcatctactaggaacgtcgagatattcatcctcctggtgttcatcgaaatatgcttatgaaggatgaaccgcatgtggcagctgaagctccgctttaatttaccttcatcgatgttgtaagtgatcagttccagagcttccgcggtaggtgcaggtgctttgcctcaaatcaactcatcgtcaatcggaacaatcgctgtgtcatcagtgaatcggcgccaacgctggacggcagagttactgtcacatctcacaataggtaacatatttctcctctttcaatttttattcagtagctgtcgctttcgattctccaactgggctggatgaaaatgaagattttcatggcgcgcttttcaaactgctaaacggtgtgtttcgtacgaaaactttctatataaaagttgttctaaaatattagattaatccatttttcaagtttgtaataattaaaactcaattaatcacatgttattactacctcgttttgcgtgaaatatttaaacttcatcttcaggtagccatgcaattggctcatcggaagtattcaccattttcagaactgctgacagcaagtccttcttcaatggattttcaggacactgtctgtttgccctgatttgaaagctggtgcactccatgttttgataatttttcaacacaaaatcatttcttttctttccaatgatatggtcgcatcctctgatttgatcaagctcagaagtgcaactgatcgccattcgcagccagggcacatgtgtttgtctatttgattattggcctcttcagatttttcttaaaaaatatataatttccatgctctcaaaattgacccaaccagtccattcaaaagcacctcaaaatggaccttctatctctgtaccggttattaatttggtactccctccgtttcataatgtaagtcattctagcattgtccatattcatatgaatgttaatgaatctagacacacacacatatatatatatatatatattcattaacatttatatgaatatgggcaatgctagaatgacttacgttatgaaacggaggaagtataatagttaatacaaatttcgttgaacatagtattggaggcaacttttacaggtagatgttttcatatgatatagtaaatagtagattgagttggaaaaagaagacaatgacaagttttgcaatttatcctctatttttctaccactaagatactgccagttgatcttctttccatattgtattatgacatctgtttattatattaagcttgactgttcaaccttttattaacctcatttcatcacaatggatatgttacaattatatcattattcgttcttgcaaaccatctcaccgagcaatatatagtatctaacttagatttcccgcaacaacgcgcggggtattatctagtttgctataaatgtgtcacctttttttttgttaaaaaattgtcaatttttttggccataggatatacattaagattcatgctagtgcctagttgcaggaaaaaaaataggcaatggcagggagcatgaaaaaatactcactgctcagtagtagagagagctcctaaccaacagagcacagtagagtcttctttccccttccccctttctacagtagccgctcccattccccatctcccggcccctcttcctcctcgattctggcgccgccagcgagggttggaggagtggtccggccacctcccccctactagtattgtgtgtttatgtcagttattaagtcgtcaggttcttcctgttgttaaggtttgtctctagttagtgcttttgccggcgagttcccatgggtgccggagtggtcggcggaggtgttggttggtggcggtggaagtgcaagatccgaagatcagtgggcaatttgatggatggagctggcttcttgtggtggcgtcggctgcgtcgccgtcttcagctgggaggccgccgccctgcttcttgcatcggctgcggcggcttcctgtgtcccttgctggctggttctgttgtcgcccggagctcgccgctcgtggtgcggacgacagcccgtcagcgttgtggcggcggtttctctggtgcctgaacatgtgcttccaatgccatggttctatcagtc

SEQ ID NO: 79306 - DNA, 1137 bp, Oryza sativa
aaaagcacttctccaccagtgtacacaacaattaaccaaatgctcctatcttttaacatgtaaagacatgttcagaaagcaatttgggagatgttcagaatgtattctggaagaaaacatatgcatattgttttgcatgtggatgtgtacagaaaactcatcacatagtacaactgaggtgaattgaattacaatttggatcatattatcatactgtcaaaaagtcacagtaattgattcacattcagtttcagcaaaacaatacacataaaaaggcaatattcagatattactgattcagtctcagcagaatgaacaaccagaaaatttgtacaggtaccaaaaatcgattcaatcacaagcaatactgaatagacaacataacaacaaagtttcatcgaatttggttgtgcatttcacaagcagtattgaataggcctgaacgacattgtttaatgaattttctcatgtaattcacaagaaatgttatattattctaaggtcaaaacacaatagcaacaatattaaatcatggttcgttctcggtgggttcattggagacgttgtcattgtagatcttcattgttttctcgatgggagataccagcgaggatcatacccttcgcccaccttccttttctcaccttgtcctttttctaccttcttggacttgtattcttccatggaactttcaacacgctggtagccatcacatatgaactgaaacatcatcatgatggcattcacgtggccatgtaataattccccttgtttgctgtttgccttgatgaaggttgcaccttcacatcatccttagagttcattgactccttagttgtggcttgatgtggtgaaaaatcctcatcatccacatcatccatggatgccatgccttactacaatacagaagaagtaggagatcaataggtgcaaactaaagtataataatttccaacacaaaagagatagattggagaacaataccaagatgacgagttgaagttccagcagtcctatgcagccgacaatcagtggtgagtattttttcttggttcatacttgttcacccactcatatataggctaaggaggataatgttacctttgttgctatcatgatatttatggaaagatatag

SEQ ID NO: 79307 - DNA, 3041 bp, Oryza sativa
caccgccggaatcgagctcgcgccgtcgctccctctctccgccgtcgccgtcgagctccggtccgccgccgtcgtcgccccggaccacctcccacctcggcgccgcctccttcggcttcgccgcatcctcgccgacctcgtccacccctccgtttcgctcgtcgaccgccggagcaccgtcgaccccgtccacccgagccgcgccgccgccttcctccgctccggtcgccgtttccgtcgtcgccgtcgacccggggtgagccgtggaccgccgtttcgtttcccccttttccctcccctctctcggccgccgctccgccgtgcctatggccgccgccggcgaccataggggcgcaggcgcgccgcctcccgccggccgcaccgacgtggccgcctccgggcgcgcctagcggctgccgcgtggggcccggccgtcagccgcccgcgcccttaggtgcggctgacgcgtggggcccacggcgccggccggtgcgagcccgggtacgcccggtccaccgtggaccgtgaggctgccgcgtgggccccactcccgtggacccggtccgcgcgcccctcctctcggctgacgcaataaacctttttttttttaaattaaaatttaaatgaagaaattcgcaaatattcatttaaagagcatataaacttcaaatgaccataacttggccatttgaacacggaattggaccgttcaagtctctaatttttccttaagaagtcaagaacccatttttgtgctttgtttctgcttgttatatggagtttattagagtaaaagccttttctttttcgttggtcgtgtagacgctgcagcttcggaagatccgctcttcgtggaagttgaagtcgacgtttgggaaagcgagcaaggcaagtcacatcatccttgaacacattgaatcccagtttataaaattatattgatttaaattattgcattatcgctttatttaaattcccgcgttatcactgttttgtttagccatgcctatttgcctttgtatgaccttattattgttattgttattatttccttgttcaccctaggttaaagaaaaccccaactagttgacactctactcatggtaccactagtatgaatttaggtagatgcttcgctggttaattaggtaacattaggtggttttacaactctagatttcgggaatattctcatcacctggacactatggaatggatggattattcggaattggattcacacctccccctctattcaaaaccctcaaaatggttttaggctggactcggggtgcatggttttgatagtagcacctcggccatataaggaccggtcttcgggcctctgttgcaaagcactaccgtacttccacatatctagtgggtaaggcttagtttgtggctcagtctggttataaacaaaagtacacggatggagatggacgaagtcgggggtcgatggacatctctagggcaaatgaaggctacacgagctgcggcccggtagtcaagatgtcatggcacagggccagtgtcctgctgctaggggctcagtcctgcctacctgtcccggaggttccggccgtaggaggggttgggtcggtactctcgtctatggctaggttgggttggaaactatgtcacgtcttccgtccgtataccgtggtggtatgtggcacgtggttacacgtaagaaatgtcacatcctgatttttgtttcaggatttataaattatttaataaattattattagaatttatattaaatgtttattaattttcaagtgaagttaaatgtgggaaataaaatttcctaaatataaagcatggatggatttaatttttattaaattctccatggttaattatactctctggaatattctcggatttttcggagctcaattcctaattttaatcttacaaagagcatttcagtaattacccacatattaaattaatcattaaatggtctaattataattttgttaagtactttgagtgtccaagtattttcatgatttttcttgaaattatttgagcattggaagtatttttaacaattcaaagatcatttaagtgattattttaattgggaaagtaataaaatcctcctcctcagcttgggccattttcggcccattccttcctttccttcctctctcttccgccggcccaacctgtgccgcctcctctcctctcagcccagccggaaaagtctactttccctccctgagctactgttcatcttccagctcaggcagagcccgagccagccgtgccgtgcacagtgccgccgcctcctccttccaaatctcgcctccccgttgctcctttttccaatttagttgaggggaaatattcctcttatcctcctctatcttctttacccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgcccctctcccgtggtctcccgtgccccgtagcctctccgccgccgccgccaagttcgccgccgccgccggccgagctccatccgcgtcgcgccgccgactccgtcgtcgccgccggtcgccgtcaccactgttaggtgcgcgggagggtggagaagcccgaccgcctgacccccgaagtcgccggtcaccggagccccgtcgccgccgtcaaccgaagccgcgccgccgctagacctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggtttcga

SEQ ID NO: 79308 - DNA, 619 bp, Oryza sativa
ccttcgggcctcttttttgtatacatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctgggagatccacatgtcgagactggccaggccgggaacgtggtgaccgagggttatgggtgacccgattgtgggtttttgccgattcccccccggagttcaccacgcctcggggcacggctcggttctgggccccgttttgcgattttagccgacccgagcccccgagggcaggattgagcacgagtgacctatttcaagtcaagattcttcaaaaggaaaaaaaaaaacagcacagatacagcctttaggaaattgaaacttcttttattgaaatactgaaaaaaaaaagaaataagaatgtgcatgtgtggcagcccccggccaaccctacacgcccgagggggtgcggggttggcccgagcccgaaacctgacacccgacccccccctcaggggtagaagcgacgaaggtgttcgatgttccacgg

SEQ ID NO: 79309 - DNA, 693 bp, Oryza sativa
  unsure (1)..(693): unsure at all n locations
ctggaactgaatcccccacatgacatgggtactctacgatattttgctctggatgatttaatggccgaaatttaaatttcttaactgaaatcgaacccctacgccaaaccagatcatcagtgacgagcctaaactgtcatctgtttaagaagagagttgagatgacggtattcgaaggccgcctcctagagtatgtcgtctcttctctccaaccagctgaagtgcttcagtacggctgtctcgtcaaactgaaatggatcgaccatcgctcaataaaaggaggagcaaacaagcaatgaaggaaagttaattcgttcagtaagaagctaggaaggaagaaagaaatgtagtccagtttccagagttgatagatgttggtcaagccaatccacggagacgagcacttgctacacatcagcgaatgtagtttgttggattttggcgatgagatggttgattaaccctgcatttgcttccacatttgctttgatctgcattcctaaccaccggaaacaagcatttttttttgaacgactcgcaccatacagcgcanagtttatattgataaagcatgaaaaaaatacaagattataaccctgggaggtcgtaacccaaataatgatatctcgtaatctagacatcatgtctaaagtaccagatactactctaatatcatcgtcataacatagagta

SEQ ID NO: 79310 - DNA, 12627 bp, Oryza sativa
acccctcggggagacagagggaggggtggccacgtctccctcgggcccgaccccccgagggggtcaggccacgtgggtgaccgcggctacccaagcctctagtcacaatacccccgaccccatgtcaccgacagttgcccccggcgttacgccagggcgatcgcctccctcgagggaagcgctcgggcgtgacgccactccttaggcccggtgacaggtggggccggtccctacaggcgggcagaaacccagcggtcgcaaatcgcgcgcatcggcaagggaaaatcgaccgacaataatgagcggcctcttcaagaccgctacattactcgagcagcgcgcgaatcgggacgagccggttcgtttcgcctggagagatgatgatggcgtttttctcggttggcgagcgtagttaatgcgcgcacgatctgccccatctcaaccgccgcggccgcgcatctgccgtgggcaccgcaaacgggcgagtggggttagtggaggcgtgggcgcgagaaacgagggggcaaggtagtgggcgcgggaagcgaggagccgggcatagcgttggcaagggtgtaaagacgccgaggaagggattcgtttccttcctctcgccactcttccccttgccttcgccacttgcgctctaactcttcgtttcctgtgtcctacccttgccgtactcgctcgctctcaagctcctcctctgccggcgtcatggcacggggctccgcaccgctcgatggtagcgtgctgccgccttcccacatcgtgagcgagaggcaggccgggctgccgcgccgattcatgccggaatctgccaccggccgggaggtggtcgcgctgggcgagggacgcccggcgccagactacccggggcggtccgtcttcttcctctctttcgcaatggcggggctggtcccgccattctctatttttttcatggatattctggagttttatgatctccagatggcgcacctcacccccaacgcgataatgacgctggccatcttcgcgcacctgtgcgagatgtttattggggtgcgcccatctctccggctgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacactcccctcgccgacgaagcgcgccttcgacttccgagccagcccctggcgcaggcctccagctggcgggcgacggtagatctgggagacggctacgacgccgttcttgaccgcctggcgggtctgtgatcccaggggctcacgggggccatggtgttcggcgactacctgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggccccccgaggccacgacggcgcgggcgggagccgcaggggggaacaatctaccccgggagggggtcgtgcttctgggccccgcgacgggggcccggggggcagccgccctgccgacgcccgggggaagaggaagcaggagggtacccctcccccatctcctccccgagggggcggggcggtgcgtgccagcagctggcgcccggagggtgccgtgccgacgccgcagcccgagggggagcgaaagaagaaacggctccgcaagatgggggggaccgagccatgccgggggaacctcatctcgcccccgaggtggtcgtttagccgacctccctgcaggtccgtccccgcgcccaccgcggccgcattcattctcccatctcccaacgcgagttttcactcacccgtttctttttgtcttctggtttttcttctgcctcagcgagatcccgtcgcgcccccccccccccgccattctaagtccggccggtctgaggtcgaggagacggcgaccgcggaggcccggaggcgggaagctgaccggcgagaagccgcggaccgcctccgggaagccgaggaggctgcccaggaggccgtcctaccatcgccgaggaggctgcccaggaggccgccctaccatcgccgagctgcagggcgcactggactcgtccgccggggaggtcgaggccctccgcttggcgagcgaggtagggcccggcatgcttcgggatgccgtctcccgtctagaccgtgccgggcggcaggcgggcctctggggcgggcggtacgggaagtacgccgccaaccaggggggcctcgcccagcgcctctcagagatggccgggaccctcaagcggctccccgagaagctcgaggagacgatcaagtcatcctcgagggacctcgcccggggggcggtggagctcgtactggcaagttaccaggccagggaccctgacttctccccgtgggcagcgctggaagagttccctcctggaaccgaggacggcgcgcgcgcgcaggtccgggacgccgccgaccacatcgtccacagcttcgagggtacggcccctcggctcgcgttcgccctcgactctgacgaggagggcggtgacgacggtgcggacgacagcgacgacgaggccggcgacccgggcgcgtcggagtgagcccccaggcccccgccaatcttaataacttttccttcttcttccgaggccttcgggcccccttcttgtatagactgatttaatctgtaatcaagtaaagaggaaatttctgcgtcagttctgtttgttgtgtgtatgagacgaggatggtctgtgccgcggtccttctgtgttttggcttgaacaagggctcgtgcccaggtcccagcctcaaacggcgcgggtcggggctagtgcctggggagatccacatgtcgagactggccaggccgggagcgcggtgaccgagggttatggatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaaggaaaatgatggcacatacacagtcctcaggaaatcgaaaatgcttttattgaaatacggaagagaaaaaaggtaagtatatgcatgtggtagcccccggccaaccctgcacgcccgggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcaggcccggacgtggcgctgatggtagcgccgcaggctctgctggtagcgcgcggctcggagggctgcgcgccgtcttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgtaggttttggttttgaggcccttgaggatttccgcgttggcgcgctccacttggccatttcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgacctgataagcctcgggctacttagtgaacttgtcgacagcgacataaagatactcgaacccgcccggggcccgcctgaacggatccaggatatcgagcccccagacagcaaacggccacgaaagaggtatggtctgcagggcctgggccgactgatgggtttgcctggcgtggaactggcacgccctgcaccgtcggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgtgccggacgcgttcactcccttcgcggtcctcgggtaaagtcttatctgcgaggtacgcctggatctcagtgatccaagcaatcaatctaggggagctgggagcgctcccctcgggccccgaggcctggactccgacgggcctcgggggccgttcaggcgcgtccgtctcccctagggggtcgggtcgcgccgacggatgggcaagcctttcttcaaaggcgcccggtggggtctgggctcgcgaggaagcgagccttgacagttcgtcggcggccgcgttatcccgtctgggcacgtgccgaagctctatcccgtcgaaatggcgctccatacgccgcacctggcgcacgtaagcgtccatctgcgggtcagagcaccggtactccttacagacctggttaacgagcaactgcgagtcgcctaacactaggaggcggcggatccccagtccagctgctactctgagtcctgcaaggagtccctcgtactctgccatattgttggtcgcccgaaagtcgaggcggaccaggtatctgaggacgtctccgctcggcgaggtcaacgtgacccccgcaccggcgccctgaagagacatggagccgtcgaactgcatcacccagtaggcggtgtgaggcagctgcgaggggcccgagctggcctcgggggcggagacgggctcgggagctggggtccactccgccacaaagtcggcgagagcctggctcttgatcgcgtggcgtggttcaaagcgcaaatcgaattcagagagttcgattgcccatttcaccacccgtccagtaccctctcggttatgtaagatttggccgagggggtaagacgtaaccaccgtgacccgatgcgcctggaaataatggcgcaacttcctcaaagccatcagaatagcgtaaagcatcttctgggcctgagggtatcgggtcttggcgtcctggagggcctcgctaacgaagtagacgggccgctgcacctttcggtggggccgttactcttcgccaggggtcgcatctctagggcgctcttcgtccgagaggccgcgcggggcgccctcggcttctgtgccgacaacctcggggtcagagggcgacaggcgcggccttcccgcagtggccccgaggccatcctgggggtcgggggcgcctggcaccgtcggacaagcaagcggagggccaactcctgccgtcgggggccttgggccgccgttcggctcgggggcctctcctccctgctctctctcgggtcgagtcgacacagggtgaggatgcgcggagtgagggttgtcctcgtcgcgctctgtcacaccctgaaaattcaaaatatataaattgttgtttaaatggaatttttagaaataattttaaaagtcttgaaaagaaaatctaagtttaattaataaattccaatataaaattgggccagataaaatttcattaaatactttgcttaattctataattcctagatttttctgggatttatttgagctaaggaagtattttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgcgccctcgcagccgctgacaggtgggtcccacctgtcaggcccgtcgtcttcctcgggccgaaaccctagtttcgcgccgccgagctgccgtcgccgccgctttccaatccggccgctcctttccgtttccggctgaattgatagaggggaaatgatcttcgggatctcctctaccttttctcctttggaaacttcggttaaatcggtttggaaatcgatggattcgagttcgaatcggatcggctttccctctctcctagccgcgagtttccttcgccgttgccgtcgccgtgggccttcgccgccgcctccgagcccctttaaaaggatccccgtgctcttctcttctcgccgccaccctcgccttcgcctctcgtcgccggagtagccctagcgccgtgtgccctagctttgccttcgccgccgccgctccagctgagcgccgccgtcgttccagccgtcgccgtcgctcgggaaggtcgccgtcgtcgtcgccaagtcgtcgccgtcctcgtccgctctttcgctgccgtcggagaccgccggagcatcgtcgccgtcgtcaagccgaagaccgccgccgtttcaacctcgtcgccgtcgccgtccgttggtcgtccgccgtcgctttggtcgtcggtgagttcgccgtgccgtccgctacccgttggtgtcctccgttcgtgccgtagcgccgccgttcgccggtgagcgtgcgccgctcgagtcgtctgcctcgccgagccgccgccgccgtcggtgacgtcattgctggcgtcatcaaggccgtccgccgtgaaccgccgtggacccgatcaatctcggccgtccgatttggattggatcaatctcggccgtccgttcgcgtgaaccgccgcccgtgcgccggtccaccaaaccctagcccgctgacgcaataaatccccttttccttttcaaaaataattcattattgcgtcataattcaattttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggctagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagctctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggttcacctctggccagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggcttaatattgtttaattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtagaggattaggtgtagccttggtcaagctgcctgtggagtggagccgtctgcgccgtttatttaatttccgctgctagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgagcgtgacacgctccacgaccaacgccgcgctgaccacctgcggggttgccgccaggtagagtaacaacggctcatctggctccggggcgaccaggactgggggagaactgaggtacgccttcaattgagtgaaggcccgctcagcctcctccgtccaggtaaacggcccagagcgtttaaggagcttaaataggggttgtgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccacgaacccgagaagcttgcccgcaggcacgccgaacacgcacttatcggggttcagctttatgcgggcagagcggagactttcgaaagtttccgctagatccgagagtaaggtctcttggttgcgcgtcttcacaaccaagtcaccaacataggcctcaacattgcgtcctatctggctacccaaagaaattcgagtagtacgttgaaaagtaggacctgcattctttaacccaaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggacgaccttacggatgaatccggccttcagaagtcgcgccaccttctcgcggatgaaggcttgacgttccggggcctgccgccgcactttctgccggaccggccttgcgcccagccgcacggcgagacggtgctcaatcacctccctggggacctcgggcatgtccgctggtctccaggcgaagacgtcgcgtttgcccgcaggaaggagacgagcgcgtcttcctatttgtcatccagaagaccaccgattcgtgtggtcttggacgggccgtcgcccagggcaacctccttgaccgggacctcgtcgcacgtgaccatccgctgccttggggcgtccgggacggaggtgctgagcctctcgtcgccacccgcgggcttggacaccgcggcgaggtggtccgcgcgctgctccatacaagcaagcgcgactttgaggtcgccatggacggtgatggggccaccggagcccggcatcttcatctgaagataggcgtagtggaccgccgccatgaacttcaccaacgagggcctccccaggaccgcgttgtagggcagactgaggtccgccacatcgaagtccacccgctccgtgcggaagttggcggaaccaccgaaggtgaccgggaggtcgatatgacccagcggcctggtgtgccccggcgtcacgccgatgatcggctgggacggccggagcaccatccccggggccttgatggcttcaaaggctgcgggggaaaggatgttgagggctgcacccccgtctatgaggacacgccccaacttcacattgcagacggtgggggaaaccaccatcgcgatctgtcctccccgggcaacgcacggcgtgtggtcggtctggtcgaaggtgagggcaacctccgaccaccgcgcccgccgcgtcgcctcatgggtaggggccgcggccagaagctcgcgcttcatggccttgaggctccggcgagaaacgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggccttgccctcacagcgctcctgcctcttctcctcctcccatttcctcgtccgctcagccaaacttttgaccgcacggcagtccgcgaggtcgtggagggaggtgttgtgcacggtacaccacttgccggtcgggcgctccctgctgggagcgccggcctccttctttttgtcgctcgcaggcctcacctttcggggggcccgcgaagcgccctcgacggcgaggacatggccctcgtcgtcggaacgggccgacttcttcttcctcctcctgtcccgccgctctgaccgagcagcggacccgggggcggccggagctgccacaccagaaccggaggagttccaagtccaggcctcctccttgcgagccacacggtccgcgagctcaaaaagctgcgcggtggtctggggctccttggaggcgatcttctcgagcatgcggttgtgccgcacgccccccctgaacgcgtagatcaccacgtgtgcggggatgcacggtatggtgttgcggacttgacagaaccgctgaatgtacgagcgaagaggctcatcgtccctccgctgtaccgcatgcaagtccgcttcttcgcctgggcgcggatatgtgccctggaagttcgtggtgaactgctggcacaaatcctcccaagagtggaccgacgcgggtggcaagttcattagccaaccccacgcctgaccctttagggccatggggaagaaattcgccatgaccctgtcgtcacccccggcggcctcgatcccggtcgtgtagatctggagaaactcggcggggttgacgcttccatcgtatttttcggtgatggtgggccggaaccttgggggccaacggacgttccaaaggctcaccacaaaggctcgacagccggcaccgccaaccggggacacggagggccggcccccgcgcccggaccgaagtggcgctccgagcgaggaagcgccctccgttgcgtgggcggcgcgacgatcgtcgcgccggcgctcgatatcgaggcaggcatccggccccccacgcacatcttcttgggtcggaggcgttgacgagggaacggcggacgaacggtgcgtaacggccgccgctcgccgcgccctccgcctcgacgacctggagccggtggcggcagcgccagaggcctcggtggcggaggaccgcccgccggcgcctaggcgctgctgcgccgtcatgaccaagtcggccacatcatccagccaacgttgggccggagtctctggatcggggacgacgggcgggtgacgcaggagcgcacccgcagcctggagcgcgccctggggcgtgccgccatcgccgtagacgagacggcgacgcgccccgtctcgccgtcctcccccgtcgcccgcaggcggcgaagtcgcggatcctccgacctccccgagtgcctccccccgcccaagattttggcgagagggggacggtggggtgcgagcccgacggcgcgggttcggctcccagtcgtcaccactagcgctcggagagaggctgtgcgcctctgcccgttcggccattgggctgagcgggagaagcttggcgcacacgaaagaggacgagggcttagaaagacacgcgcgccccctacctggcgcgccagatgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaat

SEQ ID NO: 79311 - DNA, 1316 bp, Oryza sativa
cttaatcacgcgtgcatgattttttttcacgatttttttttatttttttgtgaattttttaaatcatgtgcacctgaatgcgcctgattcaactcgaattttgagtcaaaagtttttaaaattttagttaaaagttttgaattttgagatgaaagttttcatatttgagttaaaagttttcaaaatccgatataaaagtttttaaatcttgactttgaaagttttcaaatctggattaaaaattttcaaaaaatcttgttaagttttcaaatctaagttgaaagttttaatttgaaactttttaaatctaagttgaaaattttccaaatcgttaaaagttttattgatgtactaggaggagaggccgagaggggctgtgccatctagcacgcacgtacccattaggaatctctatagcacacatttaactatgcgcgaagatgaccttttaactttattcttacatcatcacactccacataacatcattatatgatgattaacgatatgataataagtttgataaacaatataaacaaagttcaacagtactttagcatcgataagctgaggagaccaaagttcagcaaaatccacatgccacatcatagggttagcaacattttcttggtcacttccccttttttatgagctgcaagcgtaccaggctttcttcatttatgggcttccgatgggtttggccggctgagccactggggaactttcagatttttttttcagaattttgacgaaaactaccgtacaaatacagttaccgacaaaccggtcgggaaaacctccatcctatttccactaccattttcggaagatattatcgtttccatttccaccaccgtcggttaccgataccgactgaaacagtcgatgcaaactgaaaacggcagccgaaaatctcggaaatttccagatcgttttcacccctacgaggaggcgggttgtgtcgtggcgcaactgggcagaacgcattttcgggtggtggtttggtctttggtggatgtgaaggaggtgggaagcagtgcctaggcatgttaacacttaccccctctgtccgaaaaaaaaacaatcttaggtttgaacctggatacatgtgtgtctgtgtccaatttaggttcaaacccatgattgatttttttttggagggggcggaggggacggagggagtactggccatagtggcatcggtggcgcagctttgcgtcgtcgtggtttgcatgtacactcagccatccgcaagtggccgctacgcgtgcaagttctctagtgtctggctaggattgagcgagccaaaaatatcg

SEQ ID NO: 79312 - DNA, 2818 bp, Oryza sativa
acggccgggccccacgcggcagccactcggcgcgcccgagggcggccacgccggcgctgtcggcgggaggcggcgcgcccgcgccccgatggtcgccgccggcgaccaccggcgcggcggagcggcggccgagagaggggcgggaagggggaaaggaggcgacggtccacggctcaccccggggcgtcggcggcgacggaggaggcggccggagcggagggaggcggtggcgcggctcgggtcgacggggtcgacggcgttccggcggtcggcggactcggcgagggcgtggatggggtcgacggcgttgcggcgaagccggaggaggcgacgccggcggcggaccggagctcgggggcgacggcggagagagagagcgacggcgcgagctcgattccggcgaggaggaaggggatggcggaaacggacggaggaggagcggggagggtttaaatagagccggggcgagagagggcggccgggggaaggaaggaaaccggcgcgggaggtcggccgccatcaatggcgccggcgagatttgcgggggcaaatccgcccgtttgaacgagagagagagagggaaaaatgggggaaaagggagaggggatcacgcggaatatttccccccactttattgcacgcgagggcgacgggaggcggcgggattcgcggcggcggcggcgctagggcgcgggcgaggcggcgggagcagcgggtggtcggggatgacgggtgggccccacccgtcagcgagggtggcaggcgggcccgcccgtcagcggcgcgcgcacggggagaggccgagtgggccgcggggagaggagagagagaggggggaggagagatgggccgggccggcccaagggagggaagggggacttttacggtttttctttttataaaactttttcaactttgtttatttattagtaattattatttgtgctctaaaaattccactaaaatttatttacaccttttaggcttttaggaaatatacaaaaatcccctaagccttatttgacttttaactttgcacattttaattgttggaggctttcacacggattttaattattctaggcataatttaaaggatatattttagagtcgttttgggacgtgacagtcttgctgagtacggtggttgtactcagccttgctcaatttttcccaaacccagaagagaagttcctggaagatgaaggctttggtgtctagctcgtgcctgctgtcaagcgcctgtggtcgtcgccctagtcttccgctgtttcccgtttgtctttgtgtgtgctgggccttcgccgcccatgtaataaattaattatttacgcttccgcttgataaactctgatgctgctgatggtcttcctctgattgtgagtacaccagtatgtcgtcaataaagaccacaacaaacttatccaggtattccatgaacactttgttcattaagttcatgaagaaggcagaagcattggtcagaccgaacgacatcaccgtgaattcatatagtccgtatagcgtggtgaatgcggtcttcgggatatctttttcacggatgcgcaactggtgatatccggaacgaagatcaatcttggagaatacagtggcacctttaagttgatcgaacagatcatcgatccggggaagagggtacttgttttttatagtaacttcattgagagctctgtagtcaacgcacatcctctttgtcttgtctttcttctccacaaaaatcacgggagcaccccagggggaagtgctcggccgtatatatcccttttctttcaactcttccaactgtttcttgacttcggctagtttatttgctgccatacggtagggtcgcttgtataaaggagtggttcctggagcaagatctatccggaactcaatctctcgcttgggcggcataccgggtagctcttctggaaacacatctccgaactcattgacgatgggtatttctggcaatcctagctaatgaagtactgaactgccggcggaagttgggggtgcaaagaaaacaaccggttgatcagggccccgatacagagtgacagtgcgccttgcgcaatccactactccttggaattgagccaaccaattcatcccgaggatcacatcaagttcttggtgtctagaagtatcaaatccgaggggaaaggaattccttggatttctataggaacggcagggctataatactttgttgtcataacacctccaggggtggtgatgagcagagggttcataagcctttctacccccagctgatttctccccacgaatggcacagatattgtcacgtcctgataaattcatcccgaaataaacaaatcattttctaaaaggaataatagaattaattaaaattcgaaaagaaattggcaaacactaaaatacgtacaagaaaaattcaaatgtggcccggagaatttttgctaaattctccttggtctaaaaggagccctcaaattttcgtgcaattttcagagcacaaataataattattaagaaataaacaaagttaaaatgattttataaaaagaaaaaccctaaaaatccccctttcctctcttgggccgaattcggcccatctctcccccctctctctctcctctcccccgcggcacactcggcctctccccgcgcgcgcgccgctgacgggcgggcccgcccgccatccccttcctcccgccgctcctgccgctcccccgcgccctagcgctgccgccgccgcgaatcccgccgcctcccgccgtccccgcgtgcaataaagtggggggaatcattccccgtgattccctccccc

SEQ ID NO: 79313 - DNA, 2737 bp, Oryza sativa
aattggaccgcttcaagtctctaatttttccttaagaagtcaagaacccatttttgtgctttgttcctgcttgttatatggagtttattagagtaaaagctttttcttttccgttggtcgtgtagacgctgcagcttcggaagatccgctttcgtggaggttgaagccgacgtttgggaaagcgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattattgctattgttattattaccttgttcaccctaggataaacaaaaccccaactagtgggtaccctattcatggttccactagtatgaatttaggtagatgctttgctgattaaataggcaacattaggtggttttataacttggaatattcatatctcttggatactatggaatggttggcttatggtggaattggacatacccctctcttcctctttcaaagcccctaaaacctatttttcggtggggtttgggtgcatgccagtcgtgggaagtagcaccccggccaatataaggactaagctcgggcctctgttgcaaagcactaccgtccttccacatgtctagtgggtaaggcttagtttgtggctcagtctggttataaacaaaagtacacggatggagatggacgaagtcgggggtcgatggacatctctaggacaaatgaaggctacacgagctgtggcccggtagtcgagatgtcatggcacagggccggtgtcctgctgctgggggctcagtcctacctacctgtcccgggggttccggccgtaggtggggttgggtcggtactcttgtctatggctaggatgggttggaaactatgtcacgtcttccttccgtataccgtggtggtatgtggcacgtggttacacgtgaggaagatgtgtcttgtgggtaaagatgtacacctctgatcagagtataatctattcgaatagaagcgccctcggttatgggcaagccgagcaatgtatccaagttagtattttaattcttaaaatttgcttaacaactaaaatgtggaatggtttgcctgggttggcttgggacgtgctgggacccagggtcgggttgccagttcggtctgaatcatcgtaggccttgggttaaggcaggttcgtgtgggttcacggccttgattaataatactgtgtagctctaggatcgtctttataaaatagctttgggcaactaagtaacttttaaatgctgtttactgcaaaacttaaaccctatattattaccccttgtacccccttgcattaatcatgcatctgccggtgtggcttgctgagtactgtggttgtactcattcttgctcaatctttccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtgatgtaccccggcttttcctgggacggggactaatacactagcgttcgggaaaatgtatttttctcggtcgcgacaataaacgagtgggaagctctagagtcgaacaaaatggtagcagggatggaatgaatgaggaacgtaccaacgatgacgtctggagttgtcaacacatcctcggcagtcacgtggttcacacggccccgaatgacatccttaccaccgttgttggggcggggaggcgcttggccttgctggcgcctcggctttgggcatttatccgcaaagtgcccgggctcgaagcagttgaagcacagacgctgttgaccttgagcatccctgtggccttgtccaggttgcacggctggtgcaggagggcggggtgcacgggtcccttgctgattctgctgctgatgcggctgtgggacgcgcaccacgaattgaggtaagggcgcggagcgaggttgctgttgctgctgctgcgaggaggatccccttggataaggattggtgtagcggatcctttggttagcccccgttggttgcggaaattcgccaagcgacgcttgtgcgactccaattccttttgcttggcttccaggcggatgctcttgtccaccaggcgctggaaatcaggatagtccccggagaccagacgcacagacagctcagggttcatccctgccaggaatttctcctgcttctcctcatcttcacgaacatcctctggggcgtaccgggccaaattattgaactcgtgcaaatactccatcacggagcggttgccttgtttcaactcccgaaattccctcttcttaagggccatgactccggcgggcacatgggtcctccggaaggcggcagtgaaacgggcccaggtgataggctgtccctctggctgcgtagcctggaagtggtcccaccatagagatgcgggcccctgcagttggtgagcggcgaagatgactttctcctcatcattgcactgtacggtgtccaactttttccccacggcatgcaaccagtccaaagcatcaatggggttatgggagctagagaaggtaggcgggcggatgcggaggaactcg

SEQ ID NO: 79314 - DNA, 670 bp, Oryza sativa
tgataaaccttggcaaaagttccttgccccaataattttccaatctcataccttcgcagtagaatgtttccattcttctcaagttccatcattcaaaacaatgctagcggacaattctttattggaattttagaggaaaaccgtaaaagcaaaaacttcaaccatcatcagaaattgcatgatctagcatagcagtatttctgacattgatagcatcattattactttgtgattgcagaatgcaccaggtgagcaactgaaatcctcgctcatcaagaattagtgatgtcaaatcaatgggagaaatgcccttctcttcataggagatatctctggcgtgcaagcacatctttctgcattccctagaatggcctttcacggcaacttgcaatactgcaatacagacaataaagcatgattaactatttggcagaaacaaagtagcgtgattacaatgtttcaaaagtgaaagcaaatattgcagatacacaagtgatgggtggaaaaaaatgtctgtcttcgtaaactaattgagaaacaaaatgcacatgcagatgaaaggaaagacagatgttgtatccatgaaggtcgatgtggagtcaattaatggattacctgggtcagtttgtgtgtgtagatgtgcctatctgttccctataagcttggtcta

SEQ ID NO: 79315 - DNA, 700 bp, Oryza sativa
ttcaccataggttaaacaaaaccccaactagtggacactctactcatggtaccactagtatgaatttaggtagatgcttcgccggttaaattaggcaacactaggtggttttacaactctagactttgggaatattcatatcacctggacactatggaattgttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggctcggtagtcgagatatcatggcacagggccggtgtcctgctgctaggggctcagtcctgcctacctgtcccggaggttccggccgtaggtggggttgggtcagtactcttgtctatggctaggatgggttggaaactatgtcacgtcttccgtccgtataccgtggtggtatgtggcacgtggttacacgtgagaaagatgtgtcttgtgggtaaagatgtacacctctgatcagagtataatctattcgaat

SEQ ID NO: 79316 - DNA, 31270 bp, Oryza sativa
aaataaagcaaagcataacaacaaatgatcatttacaggatagtctaaacaaaacattccatatgtaatcacttgtaaccaacaacatgcacgtttctattgttctccccaaaagaaggtgtgttgctgctaacagcaaggttttgacatgccaacgcaatgataatactttgaagtctgtattaatctcattgatttattcaagaaattcaaagcagattatcaaagaaaaaagacaaactgttggccgtaaatttcaccagttaacagctggtaactggccttgaaactggaaacatctatgtggatgtttttgctaccattagaactcctcaggttcacccctctaataacacttttttcaaatttaagttctatacaaaaatactccaatttgcttccactgatacagtgtaaatcccaaagcccaactctaaaactgaaaaggcaaaaaccagacgcagccagatctggtttctgatgcccttgtgagtgatatcatttaaacacatctagatgaggatggaagaaacgatgagctgatttcttgtatatagatagatcatgcttactcaattcaaataaaccaattgattttccaaaactcagtcctgctacatatgcactagccagtttgccaagccatgctataagcctataactagcgtagtgccgtagttccataatactactctattggcatattaaagaaatcggctagatagatattatatttttaccagccgaccagcatcaaatgatgattacctgtaagcaagcgaccacacacaagagttatgtcccactagcggtgaaacacaacgaccagaagatatatcccacatcatgattgttccatcttcatctccagaggccatgtatcgcccatcaggagacattgccaatgataaaaccatactcctatggccaataaacatccttatacattcacctgtttgaacatcccatagtcttactgttttgtcactagagccagtggcaatgtagttgcagttgacatgccattgcacacactgtcaggcaaaagtattttttttaaaaaaatgcagacatcaatataggaaattagagaataagcatgtatggaaatattccaacattaagtgatcccatataagaaaatgaccaaaaccatgagtacacttacatcaacatcagataaatgcccagccattattctcaaaggctggattttatccatggaccagattctagcagtcctgtcatgcgaagcactagcaaagtaatgtccaactggactaaactgccaaaagaaaacagaacagtgtcaacaactatcatagcacaaggactacaataacagaatcagataacttgcatccaaaagaatttgacagtgagcttttcacaggacatataagtacctagtactccatcatggagagtactaacgatgaaatactagttaggaatagttcataaggagcacacagaaacccatgcttccttttttctttttggcattgaaaacagctttgtatccacactaataatatactaaaagaactggtaatcacatacttggacatcccaaacagggtagttgtgtcctttgtagcaaacaagattagcattcaacttggtgttccataagcgaactgtagcaagtcaaaaaaatatagataaattgtgaattctaattaataaagtaacaaggaagagaatgatacaaaacaagcacaatgagaaggctttacttgttgagtctgcagatgatgacaagaggaagtccccaattgggctaaacatggcagaataaactggtccagaatgaccttggaataatgtacaggatttacgcgcttcatctgatgtcgatacccgctcaatctgggagggtccattctcgccttgtgaacaagctgaaaattatagtttcttcaatcagtaaataccatcattgcataattgactttgatgctaggaggattaatgttctaagactatcataaggttctgaacaggttccagagtcaaatactgtaatgacacaagtgcatcagtacatccagcaagtatgactgaaaaacatcatacttcttaggacttgtaactggaacttcgaatgatacaaatgaatgtaccattatagtatttttaagaaggcaatagccaattagtcacataaaccagacgcaaatttatataagtgtttcagcataacacaaagcagaacaaataatcaaaaataaggagtgaagaacaactaacatgctttggaaggctggccaatctttgacatatcccaaacctagtgaacaccaaggagattttacactttttactattacgaattaatacagaaatcacataataagaagatgccacctaaaaggactagccttcactgatgaatcagcgaatccaccaacgaccaatgaaccatcatgcgaaatcgatgagcaatttaacctgagttccacatataatgattaaactgaaggaggaaaaattgaaaataaaaattgtcaggcattgatccatagttaagtttacccattatgtgtattaaggaatgtatagaagctaacagatggcaatgacaagctattcaattgtgcacggtttcgcaagtcctcaagaattgactgctcaacttcaacagacctgaaaaaaaataatcagtaaacgtctatcagattcttacagataaaggtaaggctgatgagtcaacaaagatgtccaacaaataaaagtaaacatgtgtacaaagaaattattacaacttaatataagaaaaaaacatcactatagaaaatcttatcagtgggcttaggctctgtttgcaagagctggttcccaacaccctactctcgttttccacacgcacgcttttcaaactgttaaacggtggtttttttagaaaaagtttctatacgaaagttgcttaaaaaaatcatattgatccatttttgaaaaaaaaatagcaaatacttaattaatcacgtgctaatggaccgctccgttttctgtgcgtactgtttgggttgggaacctgtttttgcgaacagagccttaatggccatgtcgtgatgatagtttggaaggcaaaggaaatataatctttggttttgttaatgtcttacaaaagtgcttttgaacagctcaaatattctacggttaaacaacatctaagcaataacatattggcaggtggacatgggataaccaaatcatttgaacagtgtggatgaggaagcaatatgttggtgcatagaatatgcaggcccctttgaattggagaaaaaacaaaggaattgaaatcctatagggaagatcattgttcatgcctttgatttgtaggaatgaggaaaggaaaatcacaggagattttcctgttcctacaaatctagaggaaaacataggaaatttaacatccattccaagctcatgtttttgttatctcgcgttggatcaaggcaaatctagtagctcatggccacttgtctattcaattagtgagggtaagatgtgtataagtagataagaaacccaatttactcttataatccaagcccattgctatgtttttcctacggtccaatcaacctacaaaattcctttgttttccatattcctaagttttttaatcctgcgtttcaaaaggggcagtctgcaggaaaaatgaaacaatggccacatgaatttaaaaaacatgtggttgccttcttcccaaccacggaccaggaaatggatgcagaggaagttataattttatcataacctaaaatcctgaatcatttcaggagaactttttaaccttaggtcacaaaccagacaatattcaaaattagatgaccaaattggacttctcaaaagaaaatttgaagtgattaaagatgtattgtacgacgtacgtcattggaagcgttagctctggtttaactcgtggtgctatagaaaccatgctagtttcagatttcatgtttttccctgtggttcctacaaacttgtcctttttgatctttttatgtgagccaccctgctttccaccttctgaggatcttttctgtagcaaaaataagaaaagagtgaaatgagaaggctaagaaacatcaatggtgagtgaggaacatagttccccctatgcagctgcctagccttcccaggtgctaggttctaaccagtctgcctgctagcatttacgggagcactgaacaaaggagaatgcagaattacatagtggaacaaatcaatgaaacattgatatcatatacagctgacagccagtgcacatcagaaagtactgtttttataataaagcaaccataaaaatcacaagttgctaacagaatcgcacgcactaaaaaaaaggaaagcttgtgtttcaatgaccgagggcataggaagcaaaatgaaaaaaaagactggcatactacaaaacagtttcttgccttgttgtcttctgtgtctgcatccttgctttctatttcagttttatcagaatctgaaattgccttctccatacgttcttcaagtgaatcttcaagtatctgcattacagaatttaaatcacaaaaataaaatgtctgagcatagtgaacaaataataaaaacggctagaatcccattaaatattaactgatcgatctatataatttcaattcgtttaggctgtatccttaactattgataaaataaatgatgagaattgggaaaccaccagactggtacagaacataccccccaatgcacctccttctgatttatctgttttgtcaagtccttgctagttccaatcagaacaacagcatccgagtcatcaatgattaatggagactgcccaggggatactatcaatattgtaaaggaaagttggaacagaagattcagataactcacaaggagcaaatgcaggatgaacatttaggtcactaatcatgagtcataacagattggggaaacttaccttgaaaatctatgcgttcattgattattccaagcaccacaagagcttgtgttttgtggagatactggagaagcaattcatatgaatactgcaataaaaaaagacagaaactttaattgggacagctgattatatttccagaaaagcaattttgcagcaatcaagaaattacagtggctatcatgaaatgctgccccaaaaaatagtacatggtacagggttgaaatgaaaggggatttggaaatggtatacaacctcacatagcttaattctgaatttattctgccttaaagatcgagccacttccatttgctgaaattacaatatttagaaggataagccataatttgtaaactttgaggagatagaatcaaataaacaaaaaataagtcttcattcaaaatagggtagtgcaatgtggaaaagctgagtcactaacttccaaatgtaaaggagaaaggatgctttccagcttcttgagatccctcgagtgttcatggtcttcacgaaatgtgtggaaaaatgagcaagctgcagtgctcaaagttagtgtatcaaagaaagaactgccccgaataaactgatagaaagcaaaaaaaaaaaaaaactgacagaagattcattatcatatccacctactagcattaccttcctgtgtatgtccctctgccactaaatccatgaagcagtggaaaaatagtggataaagaatgcggagtaattcatgctacaatagaaataaaaatttagaaagagattatatagcttaatttaggaacattaaaatacatataaaaaaattatacaaaataaaggtgcaatggtaattatgtacattacaaatcgcaggaagcaaaacatactttctgcctgtgtaggaagtacagatgtttataggaatactattttgctctccagaaggtgggcagcactggatggatggaagagaatacacgaaagaagactcttcaagtaaatgctccatctgaagcaacaaactgtgactctagaagcttgctatacaaaacagacttgaacatttttaacaagagaaacaagtgatcagctctatgtgaataacacagaaaacactcttaaaagatggtataggctgtaacacagtaacaaatgaacagattggatataacagttccatgcctcaaagcagctaaaacacatatggttgtaaaatacaaaaaaaaggggcaggttatgaaagtgaattacaatctgcgcatgtaacacaccttgtagtgatcaagataactgtatgcccatgttcttagtttactatagccatcatagtacctcgctggatcgttttctgacctgtcattgcaggcaatgacacaatcaaaatgatgtagagggtaaagataataagaacaacacaatgagctaggaattagatgcggaactacccctgctgcagtgagaagaagtgctacagtagaatccatgcggtaattaagaatatgtggttgaacacaatatatgaaaatcatgacagaattcctcgtagaaatgtggttccgcactcatcctcgccgtagaaattgtcggttgagagttaagcgctcaaattgatcctaccaaattgcttcctccacaaaaccatccccaaacacccaagcaaagctagtaatactactacaaaaatggaacaaattactcctgcgtgggggaaaccacacgaccaaattgaggtcccttagtactagttgagtgtgaaaacaacatctcgaacaaaaaaaaatcaatttataacaataataattgcactacgacactacaaattccaccactaggtttccgaaactccggcggctgagccgagcgcgagaggccgcaagagcagaatccgggaggggagggggaggtcgttacctggagagcgcggcgtcggagagggagtgggaggaggaggaggcggtggtggtggtggtggtggtggcggagaggcgggtgcggtcctcgagcagcgcgagccccgccacgcggaagcccttccgctgcaggtactggtgcaccttcttctccatctcctcgtcctccattgccgccggggcggagaaggttcggggagctagggttttgagaagagctcggatccgtggcggggcggggaaacgtcagaggaagaagaagaagaagaagaagaaagcaaagcaacagcagcacgaggaggagcagaggcaaagggaggaagaacgcagcacagcgtcatgtgtgcttcaggcagaggcccagcccaatccgttatatggccttggcccaggagtacgcaattgctcctagaaaggaataagttcacttcacgtccctcatcctacggtcgagttacaatcacatccctcatccgcaaaaccgtatacaacacattccttatcttataaaaccggcgtaaacaacgtcttaaggcagtattcagcccggttttagttaacgtggtgcttacgtggcactctaataaaaataaaataaaaatcatgttcatgccaattatttttctctcttctctacccttctcctacatttactggtctctggttcatcgatgccgatgggaaggtggaaacgttgtggtgtggagaaaggagacagcgatagtagagaagcagcagcaggaaagcttagcggagaaagggggtggagtcgccgccaaggagtcatcgggtcgagcgacgccatcgccgccacttcctgtcatctaggcaagtccatgacgcgcgtgcaaaggaaggcggcctcatcggtgacgcagaagggtttcagctaggggtggaaacggtacggaaatggacggaaaccatatttgtcgttttcgttttcatagttttttcggaatcggaaaccccggatacgaaaacggaatcgaatattatcgaaaccgaaaacggagcgaaaacgaaccggcgcgaatacggtaacgaaaacttatcggaataaaaaacccctcaaactgataaatccaattgaataaattatctatatttaaaagagtaatgttgttgataaatcccaatgtaggacaaaaaaatattcttatgtaattttagatttgcataacaaatattttttaaaaaaataacagccaaacaccatgatattcactatttagtgcttaaaaagagaatccaggatatttcagtcacaaaatttctggtaatttcgagaaaatttccggaaagtttccgaccgattccgagttccgacggaaactgcccttatcatttccgattccatttctgagaaaatatttctgaattcgtttccgtttccgaaaaattccgaaaaaattccgaccgacagattccgttttcgaaaataggtctggaatccgaaaagttttcgtaccgttttcacccctagttccagctggtcgcggaggcgacagcagcttgacgcccacaacagcttttggttggagaggagtcgtcaatggagagatgaagaaaaagaggagagagaggaggagagaagatgacatgggttccacataaaaatgccacatagccaaaaagaccatgtcaaattgccacgtaggtgccacatcagttaaaactgctttaaatactaccgagggatttgatttacatcgggttttaaagacgagggatacattgtatttggtattgtatttggttttgtgattttttgtggttgaggaatgaaatccaaactcaactcttagatgagggatgtaaggtaaattattcctcctaggaaagacataggccgaacttacaagattgtgggctcgtttggggattttctgctacctacaacttctctagaataaaaaaaaaactcccaaacagtttaactttccgcccatattataagaagttatagttgtggaatctgaaaataaactagaagccagaagatagtttttcaagttctatagtagctggttggtacccagattataagataatctctgcttttcgcccatattataagaagttatagttgtagaatccagaaaataaactagaagccagaagacagttttccaggttctatagtagctggttggtagccagattctaagataatctctgctttccgcccatattataagaagttatagttgtagaatccagaaaataaactagaagccagaagacagttttccagattctatgataaactctgctttatagtttattttctagattctatggttacatataatcagaatctacagagtttgaatagctgaatatcatggaagaaactacagctagaagctttcctaaatagggccgtaaaccctcccaacacaatacgtttaaccctagttaatagcttagcctatcatcatttgctctactaggttatcacccgtagaaaaaaaaacgaaaccaccaaaaataatttctaaatataactttttatatatttttgtgttcctagcaatttaaaaaccaatgctacaaaataaactaagatgaaaaaaaaactttaaaatcaattataaaattaagcttcaaaattcaaattttagctacaactgataagcctagtgaaactcgaaatgaacatagtaaaacaggaaaatacggctcagagggtctgtgcgacaatgaaaactttcttacctactcagctccaagtgaagctatatagagttttaaattgattacaaaacatacaccatatgtcagttgtcataccaaaaggtatctatggagaactgacggtgggtatcttcacataataagcatacacataacacattacacaacaaggattttagcataatacatggtacataatcgtccactgcgttttattgaattcactttcatacatcaagaaaattagaaacaggcctacgaagtagacgcttcatgggatggtcctctggtacagggggagtgctcccaatgcttcgcgctctgcgctctcctttttcacctgaaaagcatgatgtgtcaaacagtagccagcaaaagatggttttttatcaaaatttaacatgagttttgtttcttaaggcccacacatcagagtagtcaaggattgatttctttggaagaaacatctgctcatatacgatgatattctactaccaacagaagaggaaacaagtgtaataaaaggagtactacccaaatcatttataccgataacagcagactgtttctctggacaatcaccaacagccaatgacacactattagtggatagcaattaaccgtcagtaaatcatttgaatggggccttgagcagaaataacctttgcaattatgcacacaattttttagatactaaatcagcatgaggaaccaacattcaggaattcatagtactgaaagccaatcttaagacagcaaacctagtattttcatacagtagtaatagttgtacatgtactttggctaattattggtcaaaatatacaaagtttgatctttgaaatcaaaatacttggaaagtatcaggtaccacaaacatgtataatgaaaacaattgttcaagtaaagtggctcctaaaagaacattgtgatgagcgaagttcattttattccagtatgtatagtgccaattgccagctcccaagttgtaatccatggttcaagtaacaagaaaggtaaggtgataaaaaaggacacttaccagtgctagcatatcagataaatagcctctgaacggtgtctgcttcgcctgccaaaaaatgaaaattaatggtgtcgcaaatcacaatatatgagatatgcagataggtcctcttaaataactgatcagacggtaattgacaggagaatgtcaaaacagaatgtgatgaatgtggagaaggaattaaaggtcttatagcttcaaagggaagctcactatattctgaacacaggataggaagcaagaactcagtacaccccgaaaacaacaaagtataagaggtcaattgaagcaaattcaccaaacgatctcaacaaaatagacctaacaaggagacacaagcaaatgtatcagagagagaggacaaaactaacagtgccatagcatcatttagtaacagttccattccctatcacaagcatcaaatcggtgtccaccgcccattcctattcaccaattgtctaccagttgccatccttctaattcctacgtcaccaagccacggagcgtcgcggtctcgcggagcaaaagctcgaggaacgaactagccacatcgacaagccacgtctccgtaagtccccggccacaattgaccgtatccacattgacaacgcaaatggaagaaacaattctactaattccacaggtcgcgcacacattcatacatacatacaaacagaatgtgggactgaaccaaaactaccgaggatgattgcgaaatcttgttcaacctgggcatcggcggggaggtactggtgcttcatggagaggtccatggcgcgcttgaggcgctggttgcgggcgtccaccacctcccgcggcagccgcgccagggcctccttgatgtcgaggtcgtggtaggggtcgtacaggtcgtcgtaccggagccctgcgcacaccagaacccccgatcagagatccctcgccgcggcaaaaccctaaccctaaccctagcggcggaattcgaagggggggagggggcagctcaccgtatttgcggaggcgggaggcgacggcgttcatgtggaggcgggccagcgggttccgccgcgggttcaccagccacgccgacagggaggacagcatcttcgagaaccttccagaagcttccacgctctctctctctctctctcttctccgatgtggcgggtgctttgcttgggtttggtttgacgagagaggagaccgtacggttgcttggctttgggtggttggggttgggccgcgaagcttgtggaacattcgacggtgatgggccgatgggccggcccatcttcatttaaaaaaatatcagagtaaatttcattttcgactacctttttattgccgatgtttcagtttgggccacccttcaaccaatgttttcactttggactaggtaattttaccattttgtcactttaaagtgcactcaatttttttatccatctactttgttctatgtcaaagcaatggtctacatacaactaaagaggtttattgatgaataggagctgacatattcgaggtcgttcatacacttgagaaaagagttagggtggttcaaaataaaacaaaggtaagattatccagtccaaattaaaaaaacattagttaatctatggtctaaagtgaaatattggtaataaaaagtaacccaaagtgaaatttactatgaactatgaaactgatgaatttttgagtctttgtaggaattgaattaattcctgtggaacttatgtcttgaaggagccttggagagaacttgtattttgttttcgtgcctctagtcctttttgaaccgtgggtatatttttttcgaatttcatgaaaatatcatgtgctcctctattgtatatttgaggtgttttctatttttcctaaatcaattttttaaaaaagtttggagaagttgatggaaaaatgtatacaacaccaaattagtttttattaaattcacaattaatacatttttataggatattttgtctgttttgtgttgaatgtgttgctacttttttcaacaaatttggtcacaattaaagaatttggacttaaaagacaaaataaaacatcttatatgatatgtgaaattcttatgtttcaaacgtaccttaggtgtatcttttagtagcttcttttttcttgcgaggtgtcttttttttttcgcccacctgctttacatgaaccatactcacaccaaaaacatactaactcgtacttagttagaatataatatgtgcacttacttgtgtgtaatcacaaaaaggaaatgtacagttatgcattgcggttgagaagcactacgtggcaaagcaccagcatcatattcatgtatactagtgctctgtgttgctttagctggttaattagatgtcatctgtttgtttcggagccggcacgaatatctgcccaatcgcctccaatgcagagacatcccagctctcagcatgtctagtgacctgaacatattgtaacagccaaaatattcttagctcttgaattaaaatgaaagagaaaaaaaattagaaggttgcttccttttcttttcacctccttaccttgtattcttcatccaaatcatatgttgtattccctctgatggcgatgaggggtctccatggaagccttaaatatgtcctgtaagaaaagcatattagttgaacacaagaaaaaacaaagtagtgtgcagtatttaatacaagtttctgctaaatccttctgggttcatagagattttagttcagttactctgaacttgcaaaagatgactagttttaccccacctaataattaacgaaacaagatttaatattacagtatcaccttagtgtccatgttgccatgatgaactttgtttcaaccctcaacccctgcttgatttgcaaagagcatcaggaagttgcaaaatgggtatagcttagacaaaactttgacaaatcacactgtgccagtataactaaactagaagctaatcagtaaaggcacatctgcaataaaaatagcttgcatgtttactagcacaatataatggcattccttacagttcagaacagaagggcaatctggagatggaaattgacatttggtaagttggtagctacatcaattttagcaaaatggaatggaaaagaaagaaaagacaacaacacatgcattgcagatgcatcactggtcacttgacaatttcagcaaacagtgttaccttttcaatgttttcaagctcaagtgaagggctgtcgaagaacggtacaagcagatctaggttctgggaatatctagaccttcctaccaaataacaacagtgcatttagcataacaaaaattcatagtatttctttgaaattggagcgaatcaaattaaacattgcttgacggggcttgcattgcgcatttgtgaggtcaaatagcaaagaaaattatcgcaaacctcggaactttattgtcgggtcctcaaacaagcaatcttcggtatatatgtccggagtaaagttccctgataagaaaacatccgatgtttcagtgcattataacttcagattctgaaactatttggcatgtgtactatatatatggcagtcgattaacctaaattttaagttctatgtaaccatcatcagtactaaaaagtgaaattaaatgtgcaatttccaactcttcaatttatcttatgttctctatgacatggcagcatcaacagacagagaaaactcatactacataccagtgaggaaatatgctcgctggtaatcggcttcaagaacagcaatcacatcatccacgctgcgcggcgaatccaactctgctcctcctcctccttcatctcccttctgaagatcatcatcaacaactctgcaccctcaaattgaatcccagatgcttgcatcatcagcaaattagagaagaattctcaaaaaccaaatggtgaacagcaacatcagatgaactcgagcactttgcatgcctggggttcttgggagtcaggaccctgagtagctcggtgacggcgctgaccgccgccctgacgagcggcggggcgccgccgccgccgctgtccggcgagccggagctgcaccggacgccgccggggaggcggcgatggctctgcagaatcctccatttctctgatccacaccatagctgaagaactgcgtttctgccgcgagaggagagggaagcaggccgtttggcggttaatcttggcgccatttttctttttcttttttgtttttgcagttggctcatacacactacatgctgctactactactacatggaaattggaaagcattattctcaatgttgcagaggcagatccagaggcaatggccaaatggcaatccaaccacaagaagctcacacttggacactgctggggatcggcagattgtgaggtgctcaaggtgacacgccacgccagccaatggcagttgctgttttgccagagagcccaaagaaaaacacaagtcgctttgattttttttcccaattaagctttagaagtatgataaaatttatggaaaattatagtagtgttttcaatataaaacaaatatattataaaaatatattcaacgttagattcaacgaaactaatttggtgttttagatttattactattttttttctataaatttgattaaaactaaaaaagtttaatttgtagaaaaattaaagtgacttgtaatatgaaacggtgctgcctccatgatggtgctggcgtgctgcaatccatattctgaccaaaccaaaaatttcagtgctttaggtatgcttagtgttatcctagatgtaaaagatgatgatcatttcattttcaataggacatggaaacttcagacttcaggcatggcaaggggaaaaaagagtcaaatttccaccatccagtatcgacgaatttcagtcacaacaattcaatactacctcctttgaatattttttttctatattccatattttagttgcgcacacttagcacactatctcacaagacatctcacaaggtaattttactgtccttgataaattttactgtccttgacaaggtaccgacttggtaccaaaattttaagataccaacagcttactagtgtaaaatttaagtaactcgtacttttaagtatctaaaatttctcatctcacaatgttcaaaatatactccttataaaaactctaaagctgccttataaagtacagcagtactcaccaaatttaagcaccatctctcacaagattttaagtgatgtgtgcactatataaacatcatcatcatcatcaatgggttcaatgatcggttaagctgaacaaaacacacgctgcctgatgtaatcccgtatgccacctttggttcccaatcacaaattcacaataacgaagaacacaccattgacgggcgaacgaacgatcgtgtcaaggcaaaaagggcagcagcagattggacctaaatgctcaatcaagtaggatttacatgagagtcgctgcggaaatcgcctactacacccaggaagctgtttttgttttgggcatagcaatccactcactccagcatgtgtcatttgaggaagctcagcttgtctgaagggcctcgaccttacccctggccttctcgctgtcgtcgacaatgagcttctttcggagggcgagcagctcctctcctgcaccacagatgtaggccgcggttctcctgcctgagagagttgccccttccatgctgtcaatgtagtcctgcaaacaagatagcagattatgagttcatgggatcgtcgatcatgcttttacaggagcagttatatatgtttcatccaatattacgaatatctaccaaacgaaccttcctgcttaaaatctaaatttacagaatcaaaacaattgtatttgatgagcgctgattgattactggtgacagtgactaagtcaatggtttagatacctgttttgtgtaagagccagacaggaagaagtttttaactggtgtcttttgatcaggtctaaatggatcatttcctggtgactcgcggtacaatgattgaccgattttcaccacactcgaccatgtaagttccaagccttgtgatgacgggaacaattctaagacctgcatgaatcataaatggatttgcactgaagtgagttttgaaagaatgaaataattaacaaaagcagaagaaattatcctgatttaaaattaacacgcttcattatttgcaatggatctctaacaaccagttctagaattttggtaatggaatacaagaataatttgatcaacagagtggtatttacaaacccacctgcttttgaaccttgctaattatctcctcattcggcaatggcatgtaaggatcgccaggggttagcacagctctacaaatgaagtagtagcacacggtgattttaattgcaacagttatcaatttgatgcatgaaattcaacagttctactacactagtcaccaagtaagctgcttgtgtaaaaataaaccataattacaaactaacagctacaatagtgaatgatatcaaatgtcaagaacactgaatggtcaaacttaattccagaccacaaaagcaaagaacatggaagagaaagtagccttactggatcaaggaaccttgtccttcaatgtagtagtcagcaggagatgaaagtgcaaggtctgaaaaacatgaaaaatctgcatctggagtgtagagaagattatccaagccaactgcctttttcagttgtctacatcaaagataaacagaggtatcattcagcatcatgcaaaaaagcagactgcatttgtacggccattgttcagtacaaacaaatgcactctttatgaaaaaatataatgtgtgcatcacgggcattgataaaaatattgggctaactggggaggggagactggagttaccttgatttctccaaatcttgaagttctgtaacccatccattataacgaagctgtactgtgactacaggaacaccatctaacttgtagatgttgtcaaatgtatcccattgcctccattcagaaggtaaaagtcttttgatccccgggacatcacaagctacaatcaacaattccaatttaatcttgcatggtaggacgtggtagtcaaagacaaaatggaagagaaagaacctgcgacatatgcatctgctttgattatctctctacttgtagcctaaaaatgtccaggcatggcaaaagtgtcaattaaagtatcaagaaaagggttaagctaagcctacagcaatgcacattattatcaaccataatctagctgtacagtcatgcaaaggataaccacacttcatagataatggtgctaaccttggataggagaaggcctttaacataggtttccccatcaggtgacttatcatagagaacctccctacatccccacctcaggtgaaacctgaaggatttgttaaatgatgtaagctttcaacggtgcagtacatactaatgcaaaacaaatttcggtctttgccatcatacctaccacccctgtctgttatgtacttctttattggaccactcagataaacatcaggtgaaccctttagcatgcgtaataaagatgcctctgtttttgtggcaaacagagtgaaaatggtaagcatgcaacgtgcactgatattatcacagtcaatgaaaccaagagcataggcaacaggatcccacatccttgtgatgctctctcgagtaccacctttcgacaagaaccaatcgctgaaacttacctgaaaaaagtacacttgcaaattaacctttagatagaagctatctacctctgatttttcattaataacagttctacgatatttatagtgcatatgtttatataactaattgtgatgagaatgaaacagaaggaagtgcactagtaacctatgttccagattcgagatataatgatgcattgcctagacagtagatatacactcctaatgacacttaaataagaggagagagatacatacatcatccaaatcccgtacttgctgcaatgcaccatctggatcaacaagagctcgaacaactgggcttagagcaagagcaacggcatttcttgctttatcataaacctgaaacatgattcaaatattttaattagtccatatattgaatccatctaacaaatatgtactgtataaaatagatgggcaaagttgaaggtttatgaatccttatagaatccttaacaaatatgcttatcacccttatagaatctttcaattatgaattataacaagatttagaagaatccatatcacattctatctggtgacatggcaatcaagaactagctatgcaatttgcatatatagacaggtaggaagacattacaatgctttgattcatgacaatacaaatatcacagaaagccacatctttagtagattatcacagtctgcaaggaatattaaacagaccaatcacttttaggagctttcaaggaatatttacactcaactcagctgattacattgtgccccaaagcgccaagcactatattcaaaaagtaatggcgtgtgactaaaaggtatgaatacagagtataaaaatgaggatactgttagaagcgtgggcatgactttgacagagttcaaagcaagaatattacaataagttggaaagtcaaaatattgtgattaaacatggtcaataaagatagtcaaagtttgatatcctagttaccggacatgaatttagagtaattaccttgagttggttagttcgtaggaatgcttggataccatgtaacggagctcccacaggaaaccgaaaatcaagttctgtatagcaattagcaaagcaaatagtatgaaagtttagaaaataagtggaatataaatacatagcaaaatacacttgagttagtttagcacacttagtagaaatatggcaagttgtcttatcagtattggcctaatgcaagatcaagaaaataacacgccagagcactttttttttgccgcccacaaaagaacaattagtgttctagcaaatcgtctcatagtaatttacactttgtaaactttaaatattagcaacggtttaactttctatgaaaggtagctcaaaagtaatgaagaatgatttcagcacgacaagtaaaaaaacaccacaactcctacaactgttaggcacatgggtataggataactgaacataccaccaatcgtgcctcctttatttacaaatgtatgggtatgctccttcactagcagattattatcagctccaacctgaaacaaaataaggttgaactcgattaacagttagtgtcaaacctggctaatacagaaaaagtacaaattatccgactcatgaaataaagtaattgactacatgcttcatatagacaaaaataaagatagcatgttctcctcacaatatactccgggagtacagatttaccatactctagtaagtgcaaacagatggcattcctaacttttcatgatggaagaagcatctaactcagctccattatctacttagtgcagtctagattaacaaaatacttgaaaagtagacattctccaaccatctgaaagaacatagaaaattaccttcttcataaggcggaaaagattgctgtaacacccgaagaacacgtgcagccccatctcgatatggttccctttcctatccacaaaagaaccgactttgccgccgataaacggccgggactcgtacagatcaacctgcaaaagaggaacatcaccccaattttggtaaaccaaaaatcactgtcttttccctggaagagcagaacacggacatcattgcaggcaatgaattgaagaaacctcatggccctggtccaagagctccaccgcggtggacatgccggcgaggccggcccctatgatggccaccttcagcttcggccccctgtagtgctccggctccggcgggaacaatcctttcggagctgccacacacggaaaaaagatccccaattcaattgctttcagcctttcacagtcagcagcatattcaggtaatcctgtagaaagctactgaatgaacctagaaaagaagaatctagctactacacatggtcagactcatcacaagcaacaactaactaactaactaatccacaaattcagttcagttcagagccaccaaaatccagggttcaagaatttgtgtctccttggttctatccatataccaaaaccgttcaagaatctctagggggagagcggagtggcaccgcagaagaaagaatcgaccggagaaaacgaaacccaagaaaccctcaccgttgacggccatgtcggagacgttgctgtcgagcgagcaccgcacccccacccccacccgcaccctgggattcgggcaccggcgccgcctcctgctgccgccggcggcggagaacgacgccggggccagcgtggacggcgcgcgggacgtggcagccatggccatatgcctcagctcaccaaccaacgctgctgctaggagtagaggaggaggaggaggaggagagtataaatggcgtgagcgcgagaggtggaagaggatgcgggtgggggaggaggcgaagatgccgtcgagcagcggatttgtcggcctccgtggcgccaccacgcgcgcaccactgaagtgaacgccccttttttttggatggatgggtgaaggctcattcagttcagacgattttcaccaggattatcgtagaatttagggacaatgattttttttaaaataaatcgtttgttttgcatgaatggattctactactaaattccttaggattttagtcttacaagctaagctaatttcataggattcttagcataagatgatactacctctttgttcttaaggaaatttcgtaaggaaaagtgtacgtgtgacatcctaattctttattttctctattctttgatctggaaattatataaacaaaaataaagggagaaagcgacaaaaaaaaagaaaacaaaacaaaaaccttgtgactgggggtgctccccctttgtgctaggcgcacacacaatcacacacacatgaagcgtgattttagatttctttggggaggttcgtagcttctcgaatctccgcctctcagaagtaaattttacataactacgtaagttttcaccaaaatatcgtaaaactataagatttagcgttaactttatcacaaaatttcatatttaatattgaagttatcgcaaaactacaaatcgtattgttttaatccaacactattgttgtgcgcgagctatagacatgtagtttactgattaaattgccactaaatttgtagttttgggataaatttgctacttaaaatgtctgtagttttcctataactctatcttaaatctatagttacatgataatttgttgctagatctgtagttttgtgatataaacaccttaaatcttaaatatatagttatacgataattcggttaaataatttactcttttaaaaataagaatatacagttgtacgatctagaaaattatgtgcttggtaaaaacttaaaaatggattaatataatttgcgaagtgagcgcaactcaactggttagatttccttgtggtggaaccaactcaccccggttcaagccctagacttgatacaagtgttcgcatttatggctaattattctctcaatggtatacgatatatccgtcgatagtgaggcgtccgtggtgatttcttcaatctcaagatatgccggcccaatctttcagatgtactcataggggtagggtgtgcatgtgttcacacgttatgagcatctgcgtttgtactgtgtttctaaagaaaagattaatatgtttttaagcccatctttccctatggaatttctttttttttcgcataaagcacaccttttactcgttcagaaaacacacatgtgaaaagtgagaggagaagttggaaaagtgtattatataatacactcttacggaacttctggtataccagtaatcgtgcacgtgcaatgcacgtctccgcaaatacatatttcaaacacaagctatgggtaatgtaacacaaaaagtggcggtacattcatgtgacatacaacaaaaacaaagaaaaaccctaaaggtacatttcaaaaccagatgccgtgcaaaaaaaatatatatttttgagaaagcgcaccactctcggttaccctgtctggtgctaagagggagatatcccaaagatacatttcaaccaagtgtcatccaataaaaatactatgagaaagaacatcccagtggagagttacggttgccctggctataccgtggggacatcagagtggaaattgaagatgcttcaatttattgtgaatggattatacttctgtgaggattgtgtcctccaattattcatgttagcttctagacaaaggtgtcaaacaatctgagttttctgttgtaatcacccacacctattttgaacttcctctgtttatctgcattctaaacctgaaagaacatgacagacaaattaacatatcaaaattctctaaatctgaaagacatgcaaacaaattaacatacatgtctcaccgtcttctttgagttatacatgtacattgactgccactctaaatacacccttccacatatttccaggtcaagcagtacatgctatttttctacaacaatttaccagtggtaaaacttctaaacgctgaatactgcataattggatctcctaagatggctagcacttggtatgagtccaaaatttaggcacctttgcttgattgtagatctgtcacaagcaatcttcctatttccacaaaaaaaatctattttttgcaagcatgtctgtcaaactacaatccaggtttctactctgaagtatataaaaccgtggcattatattaccttgatccctttcagtgaataactgaagtaccttggatattatacaacatgctttgagtggctttttatgattcttaacggaaattcaagctttggtttcataacaagctcaatactgtagctgcagaagtggagagaatctatagctcaatgagcacacatttttcttagacaatcccatatccaagaggtagttgattcactaaacatttgaatactgtcagacctgaggtgaaatccttctttaaaacattattagaaagctaaaaagactttaaaaatgcagaaaaaagcaactataatcaaccaagttggcactgtaattcatcagaaaaaacaattcttgaaatcatcatctgcaaacacaaatatttagtcctctcttaaattcattaaaattgacattttatgaatatgaatttagagaacagaaaataagaaatttgaagtgataaagaagcgtgttcataagcaggtatctcaggtttcgctagtcggtgggcacagcggtcaggatcaagctataaaattcacttatagaaggaatatctgtaattcgttaagcctcaaaattcttcctgtttctcctcagccttaacagtaatgacaagaaaaggtattcttttttctttctcgaacacgaaaattgagtattctttaagtaatggcaaaggaaaaatatagcattacagaacatgacgaaagaagttgtgaggcatcaaatagttcgatacctaagcattgcatgaaaaaaattagttgctaagctatatggttcagattttgcaagacttgtgtgcatgctagttttttttggacgcctagtaggaaactgtcaagtgccaacttacacttctcaaagtgtcaagcacctgtgtctaactacatatccatgaaaatcaagcaagtcttctcaaataatcttgcattctcaaaacgacataattgtaaacttggttgctcaaggataacaaaagtgaagtgtttgctaaaaaatgattaatttgaatgagatacacgccttatgattaacaaaacccctcagctgttaacatgcaaaatatctgtgcatcaagtgaactgcagaaggctttacaccatatggtgaagatggcagcggactacatggtgatggatgtattgtcgtgctaaatcctcccatctcaacttccaaccacagaagttcttctcccatctcaaattttctgttcaaactccatcttgattgaattcatcaatagcttgtgctgattttagcattttcctgcaaggtttgcaaattagatatgcttatgagaaggacagaatggatgcagcacataattttagattaacataaacatattttatatgggaattaaataagtaggggtcttcagcccattgcagcaaatatctagcagtcagagcatctctaagtaaaaagattgatcacaacttgaccatgttacatgtcatgttcttactactgcttagtacaacttaatgaggtcaaactcatgtacttatgacaaaaaaattaggcttcactttttttttcgtcataatgcacagtcgagtagtagaccaattagaacacactgctagatcaatatcaatataagttagtcaaccacctaaaaatcactgctaattgacatggcatacacatactttggatagagcaacaattcacaagaattgacagagagcaaatgcatagttacctgactcttagaggaactccttgaggtcgagacttaagttgatagatatttgtgacctgataccgtgtacgaataaaatatttgccaatcactttcacaactccctgagtgtgtcaagtgattaatcaggtgtgcagttaattctatagaaattactcatcattgggtatggtgctcatcctatatcagggcatccaatgttttatagagaaattaagaaaatggaggagtgggagctgttgttaccattttatttacctgccctctgtccttgccattgttgatctcatgatctgtagttctacacacaggaaacattaaaggttaaacttgctaatacttacccaatatagttccaagcttacaggcaatcacccaataggccaataactgatggaacatagagatcgtttgatgaataattgtgtgaaacatgaagaatgaaaataattcaattgtttcgaaacatatcattccctcgatctagggagcaatactgaaatttttttccctaactatgatatcaattgcaaaccaagaactgacacgacttgcaagtgcatgcctcgtaccatctgattatgctaaaaatagatccatcaagaaagatgcattgagaattgacatgaaaacttatgccattgaaaagatcactttataataaaatactcacaagggaatcagtgtaagaaaaatgaaattcttggcaagaaataggagaggttaccttgcttcgtcatggagatggctgggatgaggtgcagcggcactgttcttggcaagggagagcgaggggtcggcggtgcgactgatcttgccgatggcgagtgagtggctggcagcggcgccaatctgagagagttggggtgaggtgggaaggaggaagcgtcgtcgaggccgtgctccgcgggagcagagactggttttcgctcctggtggatctccgtcgcgccacctcaaactccgtcgtcaggcggatctccggcgaggctgcgtacagcggtggtgaaggagatggccagcaagatcaagcggaggaggaggctgagcgattttgtggatggtgaaatcgtgtgtaggctaatcgattttgtggagagcgatatcaaggggaagaggaagctatcggcagcgtgatttcaggggaaacgattttttgctgcgccagggtatcagtgcgcgaagggatttacagcggcggggatggggattcggtgcgttcacacgtgggcccagttttctctgatttggcacgtatgattggagggcaaactactcatttttatattagtatagatgtagctttttctacaatctccgaatgtgaaaagctctcctaaacaatttaaattgtagtaatagaaagttgtagaatctagaaaaaaggaattagaaagcagaaattagaaaactcaaacttttccagattctcgcaagccagcttcttaaaatcttaagcttccttgtttgaaagtaatgaagataaagattaagtactacatgtacgtaaaatgggaaagtttttagcacatgattaattgagtttaattattttaaacttggaaaagaaatttatctaatattttaaagcaatttttatatatagttttttttgcatgaaatatattgttcaacagtttgaaatgtgtactgattaagataaagtctgtaccataattaagaaaaaacatggccggctagagaatgtccgtgtccttgggaggtgctagtagcatgtactaagccactgtttggagaactagtcaaaagttattttaaaaactgttttttagcacaaggaaatagccctaagttgtcaagagttattttaagagttattttttagcacaaagaaatagtcctaagttgtttggatccaagggtattttgagagctatttggcctttaatgcactttcccatggagagagacaaaaaaacactttttcagtggaccccacctgaaatagcctcaattagcactccttgagagggatagttttttttggtgggttgtttccgaataactttaaaatagcttatctgtttagaacttttgagctatttaggactatttaaaggagggctaaaagataacccatggatccaaccagggcataagacgactttctttattagatgggtcttgacaaagacttccctatgtgaaaaaactgtatacaactccatgcaagtatatgaaaaattagaaatgaatccactactcattggtaaaggagaaaatctcttgtatacctctaaaattttagctaatcacttctatacccttaaattttgcttacttctttttatacccaaaaatttgattttatcccttcatgctcctcatattagttgaccgcctaatttctataaaaatgaccatttttactctttggataaacataaaaaattatgaattgtattattgagaatgtaaatgtttgttacatgagactattatagttatgagtttgttgtgcgatacattatttttgacaaaatttgtttttagataataaaataaaatatatatatttatttttttagaaaaaagacgtaaaaatgaggagcattcgtataaagatagtactacagatgctcacgatatttttttagtgctcccgataaaaaaatctattgttatattaaatttcaaataaaattttaatttattacatttgttttatttttaaaatctatgtcaaaatctatctgcagagaatgattgatttatcctccctatctgctgcaaaaatctacagtataactgtaagaagaatctatattattgtaaacttaaaaaatagattaatatgatattttagaacaactttcatatagaaagttttcgcacgaaacacaccgtttagcagtttgaaaagcgtgccacaaaaatcttaatcttaatccaactctaattggagaaaagaacggggccattgttgcacacggaccatataatttttttttgaaattgtactgttgaagttattttttcttagaaatatacgagattccaacaaatttatatgaatagaccgtcgtggcggtttggcagtggaaaatcgcgacgaaatggcaagactaacacgcgatattgataatgacatgatgacgcaagcggtgttgcaaggggacagtacgagactgctttgtctcgctggttagcctagcgagaagggggtcccgcttgttcccctagcgacacagccggaatgacgtaattaataatcctaattagagattaattaattactagatatgctaattaaataataattaattgttaatgatgctaattcatgagttaatcgcgcgagttagagcagcctgcgcgtaccacgatcactaattctcgcgcgcgtgtcggcggcgcgcgttttaggcccagaaggcccagcgccactgcgccggcgcacgcctcctccacgctttttttttggtttttttacctttttttttcgttttttccccactttttgctgattatttttaatctttagcatgttttgagtttgaaagttttaaaattttgagttgaaaattttcaaatctgaacttgaaagtttttaaatctcgacttgaaagttttcaaaattttcaaatatggatttgaaagttttcgaatctcaagttgaaagttttcaaaattttcaaatctggacttgaaagttttcgaatctcgattctcgagttgaaagtttttgaatctgagttgaaagttttcaaatctaagttaaaaatttttaaaatttgactttaaaatttaaaacttgaatcaaaagatttcaaatctaacttaaaattttttcaatccgttagtaaaaaaagtccccaaaaaatatccagaatctttcctaattactatcattagtgttaagtatattaactaatataggtagttaagactaaaaggggaagtgcacgctagcggcacgcacgcgctagctaggagcccccgcgcgtacatgccacgcgacgtcgcgcacccactgcgctggtatatttctaccctttaaacgtgtatattcatgtaaaatcgatgaaaaaatatatattttttaaaaaattcactgaccatagatgaacacattcttagtggcaatatctgatgaatgccatgtgatcatgcatatagtttgattaaggacatatcgcacataaaaagtcaagaaaattggcgtggcataattgttggtgaatatttagataattgttaccgtggaatattttggacaaccgtttggaaggttctctaaatatatgatttatgaggaaaatcacatgtaaaaaccagaaaattatattattatagatttggatatatatatagctcttgtctagctccaaaaagtaaatttcatgctggacatttttatgtatgaattactatcaagtatggatttgaaacattgtataatcatgcgcatccatctttttcttatgcttatgatttaaattttaaattttaaaacttaatttttagagttgactttgtgggtttccatcgtttataacattcaaactaagaatgtgtatataaaaaatattaaccataagttaatgtgtttttttatttgctactaatataagtcatacttcctgcgtaaaaaaaaaaactcaatcctaagttgggtattttttacggaaggattagagataagtatatgcacaagctaaatggtggagcttcgctcattaaatgtttgatagtaggacccacatatgttagtagatgttaggggggaaagtaagcgtgtggacatagacaacaagaggcatgcattgcattttgtttgggcggcagtaagtgcgccttatcgagtctacctcccatggtcgtgggtgaagcaccatggtcggcgaccaatatcctctttttcgtttacttggacacccaacgtacacctcagcctctttccttccactccaaaataagaccagtgaataaatgaatcattaactctccattaggtttaggaaatcttgcaaaccactttaattgtgtgtattaaaaattattggtgaaaccgtttgtgtgcctgttaattaatcgaggcaaaaatactatgtaaatgattttcgtatgttccaactcccaaacattgctttttcacatgcgtctcaaaatgtccagccacctttgcctcaatgtcaatggacaacctgtggaaatatagaaaaccatatgcagtaatggtttcaaacttttaaaattcatggaaaaaatcactttaagtttgattgaggtgaataaaatagctctgtgatctttacaacaattaattcacaaaatattttattcaccatagccggactaaaaatgttttttttcataaattctaaatggtccaacatcatatactctctgtttccgaatataagtatttttatgatgtagattgtgtactccctctatcataaataaagtacttttgaaacattgataagtcaaactttttgactttgattgtcaatagcaaaagaaaatcatagagattacgtatgcaagaataattttactagatttatggtgaaacagactatcataatgtttaactctatctatttagaataaagttatctttgtagcatatccaaacatgcttatatttatatttatagacgaatggagtatataatataagcatttccaaggcactgattccaattaattcacgggaatccaatcatttcggttaatcatgtgcttaggtgggaaatccaagcaatttaaaattcaaattttgatcaataaggagactagaacatagggcctgttcactttgatgccattttcaaccttaccaaattttggtaaagttacaacaaaaagtggctatatttagtttgctgctaaattttggtaactatataagaaatcctgccaaaatttggtaagttctttttagcatcaaagtgaacagacccataatcttttcccttgggcttaatctctactaattaaacaacctaaaaatgcttatatctgaaactgatggagtatttaaaatagacgtaaattcatcctgaaatttttacaatttggtcctttttgaaaacttattttacaaatagacccctgggaaaacttaaaccggaaatagtcctttttggggcgccagagtggctg

SEQ ID NO: 79317 - DNA, 2324 bp, Oryza sativa
  unsure (1)..(2324): unsure at all n locations
gggcgatgtaagtccttggcaaatatataagttcaataagtgaaatgttgcataatttgtattttttgagctattaataatgtttggtcggtgatactggtaggatgggtacttcaagatcataaggggcacaaacgaatgtggcatcgaagaagatgttgttgctggtatgccctcgacgaagaacatggtgaggaactatgatagcgccttcggagtcggaacggccatagtttgactttaatcaatgttaatggcctcaaatacggttgggatcatgtaaatttgtcctgggtgatttctggattttgcacacacgggcaggcttctcgagactgatcggagtttaggctacttgtccagaaacacattggaataatatctgaataatagatgtattctctctctctctctctctctctctctctctctctctctacgtccggttaactacgggatgtgacgtagaggtgttagggaggagcgcacgttaatctcgctgtaatccaagttgagacttgaagaattaatgtgtatgctgtaagtcaaatgatatgcgatctgtgcgctgcttactagtatcccaaaagtatggattttgttcaatcagtctacagcttgacacaattgcagcagcaagcactcgcttggacgcatctagctccaaattcctgcaaaacactggatatcttggttcaatgggaaccgagaagtcggacaatgacagcaggcatcgatttcaggattccccattcaaggtaccagaatgcagatacagtaaataaaaacgatgatacattcatatggacagaatcacagaatacaaacagcgcagagcaatcggtacaatcgacaacagatcgaatggcacactgcctttttcctatcagtaagagttagctcagcgactccgagacgcagccgccatggccgtctccatggcattcttgaggagcaacatttccttggcattcttgaggagcaacataaacgatgatacattcataatcggtacaatcggcaacagatcgaatggcacactgcctttttcctattagtaagagcttagctcagcgactccgagacgcagccgccatcgccgtctccatggcattcttgaggagcaacatcatttccttggcattcttgatggctttcctgaggaggagcaacagcaacatcccgcggcggccagtgctccaccagcctctccacgggcactttgacgacatcgcggcgaacaccgatatctgagacatatcgccccacgcagtacatgccgctcgtcacaaccaccagcccaccagcgctggtcgtcaggaaccggagcggcgacgaggccaccgcgctgaaggcagccgtgagggaggccagctgcccgctgcgccccacgctgaaagcggtctccaccagcagccccgtcttgcagtatatcgcaaagtcctcgcaattgttcttgaacaggctatacgtcccgaacccgctgttcaggaggtgctgggcacggtggatcacgatgtcngcggggtccgaggctgccagggtgcacgttcctcctcgcgctntcacgaggaagaaagcgggggacaccgcgtagtcgaacaggtacggattgcccccatccaagaagcaatcgaggcacgacattatgaccccctgctgcttaatcaggtgaccacatttctcgcagggaggaccctcctccgttgctggagatgagctgaaaaggaacatgtccaagaatgttcctgtcccaatttcatgtccagttgctcttgtaaaatgaataaccatggcatcaccaatatatatccctgaaaatgaagttcaatttcgggaacaggtcagagacatggtcttagcgagtatccttgctccttagcaaataagtcaacaggaaaacatgaactgactgtataatgtggggttaacggacatggagcacataaatgttgcgtggcatgccaatcaagtaatgagtgttatgttttccataatagatggcaaatgacatcgccgacggtatattgtgcatatgtcggttaccagcatgtaggagaggctttattttcgggaatgcgcaaaatgattgcacgtcaatatattagaataggagaggctttatttggaaaggggatggccattgtgatggtggattggtgggcattgtttagttaattgtctaaggtttgtacaccaaaaaaaagggcaggttgggcataaaatacctacctgtgttcgggagagctctaaatttgagatggatttatcttaaatggaaagataagcagaatccttcgattgagatgcaggttccatgcgac

SEQ ID NO: 79318 - DNA, 676 bp, Oryza sativa
tactatctaaatagtattatgtattaattaattaattatttgcaacattattgattaaaaattatttttaaaaaaattggcgggaaattttaaattttggcgtgcatattttaccaggcagccccgccttctttatcacaggcggccccttccctctttcccaggaggcgtgccgtgctcccgttcacctgcgaaaatcggcgataagaaggcctttgcctacaaaaatgtttttggtccgcctgagaagagaccgttttcagtcctatgcaaaaaatgttttttctagttgtagtggctggtgataatcaaaattcaaaagggaagattagatggatcccaagtgcatgcatgcagtacgcttctgggaaagaagaggatgcatgttcatgtgcaaaagcttgctgaatatgtacgtggaccaagaaacaaaggaagaagattacggctcaatgttgtgctacatgggctgagcctgttggactctgtcatgcgtgaaaactcgagttgggcctcgtcagtcagattgctctcttgccgtttggatggcagccggccctaagggaaagtttgtttgtgtcgctagcgtaagcttagattgattcatctatttttttttaagaaaccactaggatataggccctttcgcagagattcatctattattatttttgct

SEQ ID NO: 79319 - DNA, 587 bp, Oryza sativa
ctcgtatagatttatataagaaacaaacaaaaattgtgttacattctttggtgttgagaatttctgtaaaaaaaagaattcaagcagaatgctataagttcagaaggaatgttacctgcaactggataaacccatctgcatcattaaggacctgaagagcaagggttccttgcacatcaaagttattaacacctccatctcttttaactgtaacattgagtttttcttcaattgtcactgtgacaggatcacttggtggaagaggcgatgcccttgactgaactgagctgggttgtacatcctccagaatgacttctccttcagctttcaaagactctaggaactgattcgtcttctgtgttttgcctaatttcataccaagacctttaccaggagcagtagcagctgcagatggacggcctgtgcaaatattgctagcaaacataagtaacattgtatagctgactgaactttgtcaagcagttttatgtaaagcaggagtactggcatggggaaactatattacgaatttaagtcttgagatatttgaatatcaagtaccacaagaagaaagtcctaggttaaca

SEQ ID NO: 79320 - DNA, 977 bp, Oryza sativa
cagtgaacatatgggaaaaaaggatacaagcttagagagcagcctcaaggtgtccagatcttcaagaatattgctctgcttgtttgtgataagtagcaagtacaggccttctattggctgataaacatagcgaacattttcagtctcaacataagtgtgctgcttcccagttccaaccagtttggggaaagctgcaagtaatccttcaatccttatgcgagacatgtcaacaaactgtcttgaaacaagtgctgcaattgaaaagcacagaaaagaaacagcatttagtctaatcacattaacttcctggaatgaagcatcaacaaattggtaaccaggaggtgctcactacataggattttagggttataggagttaagaatctactgaggtaacacgataacagctagtttagtatttgggttccacaaatttgcatatgagctaacactcttattagcataggtgaatgataaaaacttatacaaatactttttttttctttttctatgaacaaaaggatttgttttgattacaatataacaatataaattaaaaaaacttcttttcggcactgagaataatacaatacaatatataaacaacagaatatttcaagccagctgacctttcccggactttgaaatgatggaagcagcaagaaccacctgcggtacacaaaaaccaataataagctctcctaaacaaatcaaccacttgcttataccagcaaaatgtcagaatgttccttcttaatattacaaagagtaataaaccattaggcataccattttgagggcttttttggtactcagaattactgcacttaaaatggattcaggaattatgcgcctgccagaagtggaaaaaacaagagattattcaatcagtacgacataatcagaagatctcctgcgagcttagatccaggccccaactttttttttttgcttccagatcttactacttagtactaa

SEQ ID NO: 79321 - DNA, 680 bp, Oryza sativa
ctatgatcttcccacgggattaaacaaatacgatacccttagaatactctcgggtgaaatgctacaatggtatatccgtgcgcttgcgaatgaactctgtaaccataatataccaagagtatttatgcgccattgctgggaattatatttctagtaatgtcgttaagaaataccaacagctaggccaacaatggagctacaaccgggatcacctaaaacactatcctaacaaccgacactaaccgcactctatccacatctttgggattcaaggagagagggtgagaaagaatgatggaatcgctctccctcctaggccctccgacgtggtcaacttgcataagctagagcttcgacacaagaggactggaatctacagcgagcttgcaccgtttgtcagggaggtttcgtcaagaggtgtgcctagacaatgtctccagggagaggagcggcgaaagcaccgccgtcgtcgtccgtcgaggtctcagggagaccaggactaggttttcactcgacaggccccctagaggagatgggacagcatggcaaggccctcaagagggaaaggacgctcgagaacgccctcgttgccagctcggccaagtctgggctgggttttcacccgctgccgaccacctgtctatccacaactgatgcaccatgctccaccgctgtcaatc

SEQ ID NO: 79322 - DNA, 858 bp, Oryza sativa
attaatattcattacaaagtaattacatcctagttccgttgtacctacataccaattacacgctgtacttacatctcagttgcattatacttgcgtatcaattacattgtagttatttggtatttatattgcaatttttactatatgtgtggagtgttatgtagtgttaattatatggtttgagaaataaagtatgtactagtttataattaatcgtgaaagtctgtacgtggaggccctctattcttgtcgttatgggtaaggattagagattgagaaaaatctgactgtgcttggctccgttttgtgtcgaatactttttagataacccaccaatcacaattatgtgaataacaacaacagcagacttaacttgcgaatttctatcctacaacagtgtctccacaaggggtacaatgcaaattgccaatcataatttgtcaatttgtgactgaaagttaaaacgtccctaacccgatcactatttcagcttatacgtcaacagctcggttcatatatagaacagccgtgaagaagctcaggctgccatcggtttgccaactgctgataatacatcaaacgatcgtattagcactaaaaaaaataatttccctcttatataggctaatcgcctgcttattagacttgctattaggaaccctctttccccgttacactctaaacgaagtggatgtttaatgtatgattaattaagtattagcttaaaaaagctttaaaaatgaattaatatgattttttaaaacaaattttctatataactttttataaaaaatatacaatttagcagtttgggaaacatatgtgaagaaaatgattaaggagaagttagagcatgac

SEQ ID NO: 79323 - DNA, 4770 bp, Oryza sativa
tggcgccgtgcccgtgccaccgtggcactagggctgtcgtggaggtgctgactgggcagaaagggggcgccagccacactggcgccgcccctcgtaccacggcgccagcatagctggcgcgcccctcctctgtgccttaaaccccgtgggccccaccacctttctcctccccactcccattttcgccattcccagcccgagcagcgagctgctgttcttctccctctctctccccctcacctctccacctcaaatccactcaatttgaagccgtatttcgcgggatttgttgtggaaatcgaagagaaaggtagactccttcattcccccttcttttttttcatttttattggttgaatttgtagatcggtgggtaaccctagaaccccttttttacccaaatttgtgatttttagcatttgttcttaggattggcttgttgtagtgctacatgtttgcaatgtactcattggtgtcatgatttttttaaccatatatgtggtaatgttaatttttggatggtttggttggatggatggatgaaaaattatggttgaggcatgacggaggtttgggttgtatgatagagtatttgtaatattatgatgagttgttggataaagataagtggtctcgtgcatacgatagaaatggccgccggtggggttacatgacaaccaacatggccgaacagttcaatagcgtgctagttggtgttcgtaagcttccagtgacggccatcatatcatttacgttcatgaagtgcaatgactactttgtgaacagacatgatgaagctttgaagcgagtccagttagggcagcgttggtccaccaaggttgacagtaagatgaaggtgcaagaaagtaaggcgaacaaacacactgcaaggtgtttcgataagcagaaaaagacatacgaggtcacagagaggggtggtataacgcgtggtggtgttagattcggcgcaagagccttcaaagttgaaggtgaggggaactcatgttcttgccaaaggccattgctctaccatatgccttgctcatatcttatacacgtttatctgattcatgcaattgataaggaatctcccaaccgaatgccgtatcagttctcttcaagagccgttgtgaaaacatgggcaagtcgctttgagccatacctcgaccccacacagtggccatcgtacaatggtgaagaatttgttgctgacccaaatttgaagattaaaacaagagggaagaggagatcgaaacgattcaagaacgaaatggactcgggtctgggtggttctggaaggaaaccaccttcatgcgttcaacttgatgctgcgccggtgcaaaatagatgctcgttgtgtcaccaggagggtcacaagaaaactaagtgtcctaagcgtccaaaaaagaagaagtccaaaaaaaatttaagtgttagggaggtaaatattttgttttcctactcatgttctcgcattcattttcttttaatatatgtcacattggtaactaacggtgaatttattactttttcatgtaggatggccgaggagggacaaccgccgacttactacgaggcccgtcatcgcggggctgcgatcgaggcggggagggtatgaatcggcattgattcacttgtgcataagtatcggtagcgtgtatttgacattatattaactaattgatttacaattgctaatgcaggtacttcaaccgctccgagtcagagctcatgcccccccagtgttcgacgataggtacatcccgtacctaagggctgccgggttgctcggggtggccttggtcgtgagcagaggaatgccagtgttcaacgctcctacgttgacagcacttgtggacagatggaggcctgagacacacagcttccacctccccagtggtgagatgaccatcactctacaggatgtggctatgatcttggccctcccattacgggggcatgccgtgacgggcaggacagagactcctggatggcatgcacaagtgcagcagctgtttggcattccactgaacattgagcaggggcaaggggggaagaagaagtagaatggaatacccctgtcttggctgagtcagaacttctcacatcttgacgacgatgctgagccatggcgtgttgagtgttatgcccgtgcatacatcttgcacttgttgggaggggttctgtttcctgatgctgggggtgacattgcttcggcgatatggattcctttggtcgccaaccttggtgatctgggccgtttcagttgggggtcagcagtgttagcgtggacatatagacagctctatgaggcctgttgtcgtcaggcaccatcatccaacatgagtggttgtgtgctattgattcagatgtggatgtggttaagactaccggttggaaggcctaagtggaggcatagcttcactccttggccctacaatgagccagacatggagaagacagtggcctacctttttgagagtactgccactgcacatgctcgggatgtggcatacaagcattatgtcaatgagatggactgcttgcagcctcaacatgtaagtacttccaatatcacttctagttagacatttacttctttaattgagatactaaccaacgacatctcttcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgtgacagttcgggaagaaacaagattggccggttgaggacatctcaactggagttgaattacacaagtaaatatttcttatctttgtttgctttcattgtcaatgttcaattttgtaccatttaacccttgtcgatgctcactactgtttcatcaccttctacttgtctaggtatgacagggtgagaacaaagaaggtgaaagactggaggctagagcataatagatacattgatgaatggagaacagccggaaggaccgataggtacatcgagactatacaccaaaatcatcttttctcagagtaccttcgttggctgcataggacatataaactgttcctccgccctacttggacggaagccgacatagaggatgaccgcgactccgatgaggggcggaatccctatgatgtccggactagagttggatatcaaatggagcacgccccacttagagacagagtcgtaagttttcttgcatttgtcaaagttacttccatttgcaccctagaccctaacatatatcttttcacgctttcagtcgagagagctcctcaggagtgtgaatgaaatggggcatgccctctaagctccgaggggtggtgaggacacggagaacacgctccgcaatgttttagaggtaaaatttatttagcactttgcatttacttgagttatgcctaacaaacttcttttttttttgaaatgcagaaagttcgtcaaaggtgccgaaaacttgcagcaagattaggttgcaggtcggttggattggacgacgtgtaccaaccggggagactaccaccaccactacctcaatccgcgcgtccaagtactgctcgacactccatcaggatagaagagcgtgaaggagttggtggctcgtcgtcgtcacgcattaagcaagggaggggaaaggggaaggcgccggctccacctagcgacgacgatgacgatgaggacgaggaggatgaggactatgtcgcaccagacgccgaggagatagacatgtcacagcttcccgacgcgcctcaggggacgcaacccacgcaatacaacttgcgatccactcggacagcgaaaaagaggtaaaatgagcttaccattctcaaatgttatttgatttcccttattttgtttttaaaatgttttaaacattggattttcaaatgtaggtacactccgggctcgcaagcaattcggcgccaacggaagaagtaatttgtatgaagttaatctattggttggtagtatgacatatgtggtgcactatgtgatataaaatgtgatggactatgtgaggactatgtgatggacttttgacattgtttcatgtgtggaatataggatggactttttgcattgtttgatgtgtgggatatgtgatggacttttggcattgtttgatgtgtggaatatgtgatggactatgtgaggactatgtgatggacttttggcattgtgatttgtgcaattggaacctgttttagtctgtacgaatttgtgaattgtgatttgaattgcaaactgtgaattggtacatttgtgcaatatggatcttcaatttgcagagaggcagagggcggcgccaaccaccctggcgccgaggttgggaagggcggcgccagccagtgccgcgaggcagaagggtttcgggctgggggagggcggcgccagctaccctggcgccgtggtccatgagggcggcgccagccgaggcccggaggcagaagggcttcgatggggggaggaggggggcgccagccaccctggcgccgcggtcgggggggggcgccagccgttgcctggaggcagaacagacttggcgaaaattttggggggggggagaaagttggtggggcccgcataggaagggcgcgccagccatgctgacgccgtgatatgaggggcggcgccactttggctggcgcccccttcggcctagtcagcacctccacgatagccctattgccaccgtggcacggg

SEQ ID NO: 79324 - DNA, 13246 bp, Oryza sativa
aaaatttcagtaaattcatctcctacaggcacttttttttttctgtggttgtattaattctctattacttagatgcagtcggatgctcgtaagcatggacgtttacaaacaaaacctatatcagtcaatagtttccggatttgctaactcgcgcgtactcgctgcgggcgagcactccggcccaccccggcccacgtgtacacgcggtccatgtcgctcacagaggagtagtgcgattagcgcgagggaaacctgattagcatcaggattagcatgctgatttttttacgagtagttaggccgagtagttagaccgtaattattatttcggttaaagtttgaaaactttctactcaaatttaaaaacgtttaacttatatttaaaactttcaatttaaattttaaaactttgaaattaaaatttaaaatttttaagtcattttaaaaagtttcaacccagatttgaaaactttcagcttaaaatttgaaaactttcaactcaaatttgaaaactttcagcacaaaatttaaaaactttcaactcaaaatttgaattttttgaagtcaaatttttaaaactttctacctagatttgaaaactttcaactcaaaatttgaaaacttcaactcaaatttgaaaactttcaacacaaaatttgaaaactttcaagtcaaaatttaaaactttcaactctatatttgtaaagaggtgtgtgaaagattgaaaaaaaatcggaaagaaacaaaaaaaaagaaaaaagaaaaacgcgttggaggagaaaaaaaatacgaaaaaagaaaaaaaaagcgcaaggacagcccagctgacatgctgctggcgcgtacgcgcgcgctaggaagccccaatagtttcacatgagtaaggaaaatgatcatgagaggcctataaaaggaccatcatatacccatatatacatctcatcttaggaataagtccacttgccgtccctcatctttccgctgagtttaattgttatccttgaattgcaatactagaaatcttcgcccattatcttcgcaaaaccatacaaattaaatcagatcccatagtagtatgcacggtcgttttaactgacgtggcatcatagttagtaaaaaaagagcccccaattgtaagtggcctctaaatcccctattttctctttcctgtttccccttgttgaagcggaggtgccgcggcaccaggggccgaccaaaggaggttgcacttcttgccagtggcggcgccatcatgaagcatcaaggggcgggccatcgccagcacgaggagccggtggagatccattgcattcatgcagtggtcatgaagcttgaaaaagagcgcgttggtggaggagccgtccttcggggtggcggcgacggcggcggccgcgagtaactagcgtatgcatttggatggagaggtcggcaaagcgggggcaacggaggtggcggtagatgtggaaggcccttctagtgcaccaggttcaccgttgtggagaccaccttggcctcagtctcgtgctcatgctcggcgctgatggttggggccacttttttgctgcggagtggagagggaagtactagagtgggctaacaaggggtgaggaggagaggcagagctcgccgggggccatcgactagagggtagacgaagctcgctggtgggaatctacactgccgccatgccgtctccccccacggatgcgccgcccagtgacctcatctcgaagctcgatgcagcggtggccagtgaacacacttgtgtaccgctgcccgcggcacatccttcacccacccccgccgaccgatgacgagtgtgctccgattagttcccttttgacgctgaggtgctgatggtggaaatggtgaggaccagtgcggtggccaatggcatggaggtcgagctccctcgtcctcttgctccgtagcagcctcgcaagctcctgccacggcctcagatgaggtgaagaccggaagagaagatgagagagggggagtagaggaagaagatgagtgcctacttacatgtgggccccacatgtttatttttatttttcgctaacttggctgctacttcagctaaaacaccaatccatactgctttgggatctattttgaacggttttgcaaagataaggggtgaagatttgtggtattgcggtttagagatatcaattaaactcggcgcaaacatgaggtacgataaatgaacttattcctctcagattacatggtctgagagtactccaatttgggccggtcctggaagtttcttgtgggccggaaggctccatgtcaggagagaatatcactttgcaattggagcatagagagcataattagcatgattctgccactataaccactatataagcatatgtactgttggtttatattcttccttctacctattgaggggttacactttttctaggcctatggcaccaataggcatataatgtaacgctctaatccgacatgatgatatctcctgagtattcaatgaccacttgattacctttcttctctgactatccaaagtttttgtggaaccttctatttttctccaagagtaggcgttgggcattgtttctataatttagctggtacgaattatctaacttctgttgtttaattaaaccacctactaaaattaagtaggataagtttagacatataaactatacatatggactacttatatggaaaatttgggaaccatctgaaattctcatggaagccactttagcaattatgaagatccatggagaccaatttcaataaagccttatcaaccaaatgtgttcttgtacaaatatttaattgcaaaagttatacagtgaataaacatatacattctagccatgtgtacatcctaagccataggagaatacacactgcacactaccagagaaaacgttctgcagatggccaaaacacatttttaagacgggcaaacactccgcttgtaactaaaggcctgaaaaaaacaatttttacaggggagcattcatccacctgtaaaaattaatttttttaaagataggtaaagctgaccacctacagagacaattttcggcaaaaaaaaaatacatttaaaaatatcaccacgcagctgccttgtccggatcaggcacgggggtgactgcacgagcgtgcagtcagcacacatccaccgtccgagccatcccacggaagcccacgctcacaagcgatagactgatagcggacacacctctggactccgataacatatgcgttcattgtcgctatcgccgtcgccgttcacggcagggactgacccaaagctcttcaccgggatgcgccgccaccatagccaccgggagctgtagcttcctcgttgtccccttgagcgtcgtgcacgtactccactggttcatcttcctgctaggactggatatgcagcaattggaagcaattcaacatgcatgctgcctgtgaaaaaacttggaaaatatggatgcaccaagaccaagtagtagcataacacgattacagttacaatgagcagcaagcaaagcttgcgttctgattcgatcgactatgcagcaagcaacgtattacgttatgtacgcattcaatcagctggttttctacagaaacacaacgagaacaccttgtcacgcttgcctccagctgctgctgcgccgctgccgctacagacttgtcctgaacggaagatgggtcggcggagattgaacacgacgtactctctccatcccaaaatgtaagcatttttagcgcgtgtctagatccatagctaaaaattactatattttgggacggaagtagtacatccgaggagacagcagtgaagcccgggtctcgtagcggtcaatggtggcgtatgccggtggaaaagcttcaggtcactcggctgacggcagcgcataccggcgtttgagctccgggccactccccggcgcaggcgggcacttcatcgctgctacttgctgggttttcgtgggcttcacgatggctggttctgtcagctatggcgtgctgcctcctgaggcatcggatggtttggacggtggatgagtgctgaaggcacgcgcgtgcagtcaccccgtgaaggcagacaatcttgatccgccttgtcccatttacacagaagaagcacaatgcaaatcaaatcaatgtcatcacacaaatgagaatagcaagatttacatattccacagaaaaaagaggaaataagggaggaattatagatctgaatgtgatgtgagaatggaaaaaaatatacagacgttttctgcacatatccaaaaatatttttttctcaatcctagaaggtacgtgaatagttagataagcaatgactcacttaactcacattaatgatttgatatctatatacctaataattaaaaaatacgcaaggtttccggtagtaaatttcgtccgtcccccggtttatccacgcgagcgatccatttttgaccgtgcgtttaacgagtccgatctgttatggcggatgttgcctcactaagaatatttattattattaaattttagcaacaccctatgacacaagcatcataattcctagttggttacccaacgaagcttctaaatggtaggtttggagttcgactcccaccaccccttagttttctgctgcttaccctctcctatttttcctttttctctcctaagctgattatatatttttaaaaagtacatccatatatctgaaattcatattaaaccaacaatatatgcaattttttattgtgcttttctacactttatcgcctcctcttattaatttttttttgaaaagtatgtcctatttttttctctcttctaagcttgattatatattttttttaaaagtacatccatatgtttaaaattaatattaaaccagcaatatttttaatttcccattgtgtttttttatcacctcctcttattaattcattttgaaaagtacgtccatgtgattgcaattaatattaaaccagtaatatatgtaatttcctactgtgtttttttacattttatcaccaactttgtatttttttttaattgataacataaggaatatctttcaaatgtcatggtgaaattcatgttaaaccggcatatatataattttctactatatttttctatacattatcatcttttttattaaaaaaaacctagcattttatcatcgatcttttaaatgtcatggtgtaaatcttgaatacccataattaaaatcttgtgtcggccattgggttggttgtgtggcctcgtgcgcacatgtcttccaggatcgttatcgatcaagtttatattatctattttctccgaactagaatttccataaacattgcaaatatgttgtgctactgtgggacccacaccatcaaggttcccaacaccccttggatcggaactaccacatgcgaactcaagtgtgtggttagacggactcgagccgtcgagcgcatgagtagctgcctgctaatgatgagacgcaattaatcctatttaatactacatctatcttaaaatgcaagtatttttacctatgtccagattcatagttaaaaatgcttatattttaggttagaggtagtaattcttacttccaattaaacaataatctccaaactagaatatattttaaagtatttatcaaatttctaatcatgtaaaatatcaacaaggtgaaatccatagtcattatcttttttagctatctatgtgtaaattggtaaagctgaattaaattaggctaaatttccatttgattatattgttcctttgtagaggtcgaccaagttgaaggaatctattcttccaatttgatgaaaattctaatgcatttttttaaaggtatacatataatagcatacattactttttaaatatgtatgatcaaattagatttatgattggctacaatgcaatcctgatcgaattggaatacagatctggtggcttgtatttctcaatgcctaggtgggtccttggttatcttcatattagtgctatcattaacaaatttgaattgttatcatgtttctcctcacgtgataaatcatattcagcttcagtaacacaccgtttattagttcgaagagatatttgcaattaagtgaagcaagcgctaggagatagattgccatgtgggtcaacatcatgatccatgatataaaaatactacgcatgtaagacgtcatgaaactaaacaattagttttttttcgatgcaacacacgggcattttttctagtatattttaaaaatagaatgacctacgtgacaccaacaagttaaatgatccttgttgcattttagtcaaatataaaatgtgcgggtgtgcagcacatccaaacgtgtctatatcttcgtataaaactatggctctcaacaaacatatctgcaacatatctctttcatttcgaacggtcaacaaacatctcttctttttttatattaacaaacaaacatctctttgaattaacatggagatggcacacgtcaaacaaaaaaacaaaaaaaaactgggaaacggaatcaaattccagcaacagcataaataaataaataataaataaataaacagcataaataaataaataaataaataaataggtctgctacaaaacgggatcctgttgtaacgggatagacatattaactatttcttgcacgagtatcacaggtattaggtcctaggtatcgcaggtaccgggtaacaggtatcacaggtatcgggtaacatgcagctggtaccacaacagatatcagatatcagtactgtctcttcttataaggataccgttgtctaggttttctgataaataaacccccaaacaagcggaaggagccaaccaatcaccaatcaccgaaaacaccgtgcagcagcgaaacagcagaaacccgcgagcgcagaacggaaaaccgaagtctcctcgatggactcctccgcggcgtcggcggcggctgcggcggcggcgccggtggtgctggtgacgaacgacgacggcatcgacgcgccgggactccgcttcctcgtcggccagctcgtcgccgcccgccgctaccgcgtcctcgtctgcgcgcccgacacgtgagtgttgctccgcttccccatctctccacccccttccccctcgtgatcgatagagcgagtgagcaaaccctcgcgtctgcctctgagattgatttccgtagtagggggggggggggagcgcggcggtgctgtttgtgaatggtgatcgattggttgggaattgggagttggagttgaattggtaggattaggaactaggaaggagcatgtgggagagaaggcgaggatttcggatgaggaatgctcgttttgcttccctctttggctttctcagctacaaagaaaaatatgaatgaggagagtttttttttaataaaaaaattttacccctctgtaaatttcttgctacctacagaagtacagattatatagtttacttcgtttatgttctccgtgttgatcgctggtcttcgaaatggagaaactaattcagaatcaggaggattttgataatgaaaagtagtagtggtgattagatttttgttattcggggatgtttttctgtggttttggtatgctgtagtttgctaaaagaagcagattttagggaacatggaacctataacagtgtaactgaacttctcttttcacatgatggatcatcacaaaagcaaggaaacaaagcatagatttaatcatagtatacgggtatcaagttttgcaagatgctgtgttcagaacatggaatctgttccgttgaagaatattcttacctgatttttagctccaattacatcattcggttgccaagttgtggtaaattaaaatgcctttgtgggggcaagtgttttccgaatctatgatattggtgtactaaatcaagtaaaggatggttcattcactgagttatttcctttgcaaaatagtggtattcttgagaagaaaactaacacactatgggagcttttaatgcctcgacatgaaaaaaaaaacagagggcttccagtagcatttattcgcggcatgtgatcgtgttcctctaatggcattattcttgtgcttcaaatatgcagagacaggtcaggtgttagccactccatcacatggcgccctgcactccgctgtaaacgagttgatatagatggtgctacagcatttgcagcctcaggtcttgtatttttgactgatatcatctacatatgaacttccttatagactattcaatgtcaaggacagtgcatgtcaaatgcctaacactacacttaaataacaatagggactcctgctgactgtgcttctttaggcatatctgggaagctctttgatggtttggttcctgatctggcaagttttggaatttcttcatagataaattgatgtccttttatggttttatgtcatcttcaactacgaaaaggtttaccagtaacgcttggttttcattttactttatttcatccataatgcaggtagtcagtggaatcaatgttggcaacaattgtggatgccatgtgtaagtgtatcaatccatgcatattcattatctcaaacatattgtcatattgcttctcccgcatccgcttatttgaatacctgttggtactttacatgtgcaattattgttataatttccatgtggaattgcattctgatattttcaataacaattactgccatgatatagttttgctgttttttaccagcggtatagtgttaaaattaactgtctggattgtacagatcataaaaataaaaataaaaatcaacaaatattttctgacttctgactgaagccattgtttgaggtgtcctctaaactatcaaggaattagtactgtaattgcactggatcatgagaactttatgcttttattatgcagtatctattctggaacagttggcggtgctagggaggcattcttgtacgggattccttcattagccatgtcatatgattggtatgcaaagatttttttttctttgctattattcgctgtatttgctcctctgttgttcaaataacacatttacatattcagcatctactagttatctgactagaactaggttttactgtcatatgagttgtctgtttcatgtagaatgtatatatagattggcttctacagtttatctgttggtcaagctttcagaactatggacttgtttttatagttagttatatccattcttcagtacatcctgcgtactgtcattgcataactaattccaagagaaaataccattgaaagtggactgcaatgtggaagatgatggattggagtactgttatctacagagtagctgatagtttataatattctttgaggtttttctttccaacggatgtttagcaaacggtatgatttaatagatactagtctaatatgggttcaagttctttggcctccaccccaagtatacgaatttgccaatgactctcattcatgaagcaagatttatttcttgtaacattccctgttcgcacattggaaaattttaagtaactgcactaattagtagaacctttaatctgtattctacatgttgggctctccccctgaaggtcagtgagatcccattagcccgttgggttctttacaaatctaccaactttcagctgttaaacattaagttaatttgatgtatgtatgatttaatgtttgcaagttcacctttttattttgacttttcatgtgctcaagtctatgaacgctactagttagtgaaaactgaaaactagagtatccagtttgacatcccaattgcaactctcagggtcgcaagtcagagcagtgttaacgacctcaaagtagctgcagaggttgttatgcctctgataaataatgtgatggctgagataaagaatgggacatatcctcaaggatcattcttgaatatagatataccaactgatgctgcacaccacaaggtaaatctctagctgtaattttttagtaaattactccattctcaaacagatgttgttagtaaattacttttatgctgcctatctgtagggatacaaaattacaaagcaaggaaggtatatggccagaattggttgggagcaaacagtttataagaagcctgcggtagaaagttaccagacagcaaacatggatgttgacagtgaaaaggacagtgaagtagatacttcatcagagaatgacctattgtttaaaagagtggtaacttcacattgctccaagaaacattttattcttattctttcaagcacatttgaactgcatctgataggtagccttctagcaaaataaaatttactgtaagatctgtagcataaactgtttataaaagaattttggaattgactctcattcttctaaagtcgtaattattcttcatttcttccatataatatcaatggtaatagcaaaccgtttataaaaagagcttaaatgagaagtcctgtaggtacaaggtaattcacattccacactcataaatggggagcactcttacatgaatgataaccgttacccatggtatatttatgctagctagctattgattattgttggaaaacattagagtaaatataagtttgttcttttttgtgagaaattttgttaactagctctgattaaattctgaacagcttgtgaggcgaagttatgatgaagaggaaggggatgatatcgaccacaagtgccttgtagatggatatgtaagaatgacctaaatattctcttcataaaaaagaactgactactatacactttccattttctgatagaattcatcctcagataagtatatattgtttgttccagattactgttacccctttgggagctctatcccgcgcagaagctgatgtcataccatactacaaagcttgcttgtcacgtctgtatgatctttcttcttcctccttatagtggctatttattgcacttctttatttgaggttattttcaattgtggttatttattgcacttctttatgaggtcattttcaaatgtcaattctattttttcttgccattggttacttttgatctttcatcttctagattaaagaggtttgagtccgagggttcacctcggacctacatccttttcaagaaaatgccacagatttgtgctactctttttttttccgttttttacaccaaaaaaaacacactacacccagagacataggtcttttcaaacattacgatatactccctccgccccaaatataaggggttctaggttttcttactataatgtccctcattatgtggtgaatgggaatgttattgggtgtaaggttggaagaaaaattgaactatggatgattaattggactagcattactccacatcgtccgagggttcacctcggacctatatccttttcaagtaaatgccacagatttgtgctagtttttttttcattttttacaccaaaaaaacacactacacgcagaggcataggtcttttcaaacattaggatatattcccttcgccccaaatataaggggttctagtttttcttactataatgtccctcattgtgtggtgaatgggaatgttattgggtgtaaggtgtagttttgtgatttttcctctagaagcttcactccatttcctttctcatctactatacatatacattggtggaatgggccctattgggctgaaatacacacgcctacactcaacactccccctcaagatgggcgataaatatctatcatgcccatcttgctacacgaagaagtgcactctctagcacctaatgccttcgttaaactatcagctacttgttcaccagagtttacaaagcctaagtttaaggttccctcatccattctctctttaataaagaagcgatctatttccacatgcttcgttcgatcatgctggactggattgttagcaatatttatggctgatttgttgtcacaccacaacttcatggaagtgcttgtcgacagcttcaattcagccaaaagatttttcaaccataacaattcactcaagctcattgacattgacctgtattccgcctcagcagtcgagcgagacacaactgattgtttcttgctcctccaagataccagattgccaccaataaatacacagtagcctgatgttgacctcctatcatcaagacaactgccccaatctgcatcacaatatccctccacatctaggtgtccattcttcttgaaccatatgcctttacctgggcttgccttcaaatatctcaaaattctatacacaacatccatgtgaccacttctaggatcatgcatgtatcggctcaccacactcacagcataagttatatcaggtcttgtgtgacaaatatatcaaccttcccacaagtctttgatatctctctttattaactggatctccagattcagcacataacttatgattttgttcaattggtgtagaagctggccgacatccaagcatacctgtatcactgagcagatccaatacatactttcgctgtgaaagaactattcctctaggagatcttgcaatttcaatacccaaaaaatattttaattggcccagatccttgacctcaaactccttgcttagattttgtttcaacctagatatctccaagcaatcatctccagtgataatcatgtcatcaacatacacaacaagaatagttttaagacctctattatggcgatagaaaactgtgtggtctccattgcactgtttataacccataccacacattgcacgtctaaagcgatcaaaccatgctcttggtgattgtttaaggccatataaagattttttcagtctcaacactttaccttcagtttgtgaggtagcaaatccaggtggaatttccatatacacctccttttgaagatctccatgtaagaatgcattcttgacatctaactgatgcaatggccaatcaaaattagctgcacaagagataagagttcttaccgtgctcatctttgctactggtgcaaaagtttcatcataatcaattccatatgtttgactatatcccttagccacaagccttgccttgtatctttccacatttccatcaggattttgctttactgtataaacccatttacagttaaccactttcttccctttagggaatggtacaaggtcccatgttttgttcttttcaagagcctctagctcctctagcatagcttgatgccaccttgggtcttgctttgcttcc

SEQ ID NO: 79325 - DNA, 16594 bp, Oryza sativa
atatgactgtgacaggagttccacaacaagtgcaggttgggcaaaacatggtaaatgctctttctgctaagccctaccatcctgtgttttctgtctcacatggtacaagtgccagttcatcttcacaacacccatatatggcgagacagttgctagagcaccctgaatacaatccaaggatgcatcgcacccatccttcattgcaaccaacaatcgaagctgcatccacctcaatgacatcccatgttaaagagccctgttaccaagaaaatgttggggatagcaacccaggtatgtccctgcttcgcagcacagctgtttcctccagggatgtagagaacaaatctcccaacctgggtgatagggtgcatgctgatgtttcggaaatatactccactttggatcaccaaacttcagctaacagcatgcagattcagtatgctcctcaggttgtaaggcaaccatcacaacagtccctgcattctgatgttacagaaacatattcagcttttggtcatcagtctgcagccagcaatatacagaggcagtttgctcctcgggttacaagacaagcatcacacaggtccctatatgaaagcagcaatagcagtctatggactggacctcatgatgattcccagatggaactgttcaggccatcctcgtctcgcagaattagtactaatgtcatctctggtgaattgccaaggatcaacttgcagagtgagacaatgatgggaaatgctgatttcaaccagcaaaatcttcggagacaaatttctctccgtgaaaacactgaatctcactcttttggcacatataacgagttgccaagaacatcttcctttttgcgccgtcaaagctctgaatcctcacaactgaatagtgcttctgtcaaatgttcaccaggttctggtagctcatcaaccacgatgggtcctcctcgccctttcaatacagtatcaggaggtgccagttctctgctaggaagtcctctttcttccatgtctggaggttcaagttctggtggtaatcctgatcatcagggcactgttttatcttcaatataccaaccagatggatacaatattaattccaccttgcctctaagaatgagaacacatgcaagggaggcctatgccacatctgttctacctcaagccacaaggcgaagccaccaagtgaactttgattctgcagaacggagaccccaatatgttcaacaaaggggtctggatgacactataaattcaaacatgttgagtgctcggcagcagtttcagaggcaggttgaaaggcagcttcagaggcaacttgaaaggcaacttcagaggcaacttgaaaggcaacttcagaggcaggttcaaaggcagcttcagaggcatcatgagagagcagctgcatctgaagcacatccattttatggcaatgatgagacttctgtcaggatgaacccaactgaggaatttcttgatatagtaaaggatcatgaagcattcttcctttcattttatcatccttctcgtattccagcccgtgtcatgaatacagtagatcaatgctatggtgttgatatggaaagggagatgccacatcaagagagtcatccaacacctggctgtggtactgagctttctcataagaatgacacttcaggttttgaaagatctgatgtggatgtcgcacacatacatgattccaaaaggctaaataatgaggaactcaatgcccttctattacataggaagttcagcagcttaaacaaagggaattaccggctttttcacatagaaggccatgtgcttcaatgcaggtctgtgaactttgtatcaactctgaagttgcagatgataggctgctaaagaaccattcacatgtatgcaagacataaaactatgttttctgatggccacattgctgttcttgttttctcttttgcagcattgatcagtgtgggagccgctttatacagcagaagcttccaacagcgacacctgatgagaaactcatggtctttaaagaaatcatgcctcattttcttgaaatggtgactgatgtatttggaaattatgtgctgcaaaaggttttactccaaatgatttcaactttctacatttgaatatgtaagcagacactagaaaattcacacacttatatttatttccttttccaccagatgatcgagcatggagccccatttcaaagaagggaaattacagcttgcctttttggaagtgtttcgagcttaagctgtcaactatacgggtgtcgagtagtccagagggtaatgtgcatttcatgtctaatatcacttcatactgttgcatatctgattttcttcatataaagatctaaatctcagtctggtattctcttgaacgggggtatgattaggggaaggggattagtcgaatttcacacctttgaatttttcttgctgatttgtgctcttgagcggcgttgtccacttctatcagctgtgtcagtttcacatcaaggactcctatctcttgattgttccactttgatacactccccttcacctgctgcatccccaccaacactgatgggtcagtgctcaagtttaccaggtaagagttggcctttaccagagctccctaccccagaaggtagggagtagggtgggtggtgataagtagcagatctggcggcaacttgagatggaaagatcaaagatggcagtcatagcggtggaggggtggcgcaggagaaagtatgaggtggtggaatcaaatttctcacttgcacaagaggtggcagccacaaagggcctcgccggcaccaggagcagccctggtgccggcgagggagatggaggcagcgtaggagcggttgatcgaggcggcggctagggggattagggttggagtgttgggtcacataggtgggattatatagggaagataggagaatctgggcggttggatctccatcaacggtcaaaagaaattcgaccaattttgagcagagaaacagacacataatgtatataggacaagggaaataaataaagtttagatgtcgacaaatgaggttggtgagtaaaggaggacatcattgataataggggaaaactgaaggtactgacatttatcaaagaaaagattaccccaatctaccgtttttgggaataattaccatattttgaagtggcgtgtacttttgcccatgtgcgcctatgctactgttagaaacaaagcaccttcattgttttagtttgtctatcatctatgtattaatagaacacataattaagttctttattttccttgaagtgttatgtttggttagctaatgcccacaactccttttcttgccccttgctttcttatgcaggctgtagagcttagtgatctagatcagaagatacagattgccaaggagctcaatagtaatatcatgaaatgtatacatgacccaaatgcaaaccatgttgtccagaaatgtatagagcatgtgccaccacgattcatacagttctttgtggagagcatgtatgggcgtgttgtggagttatcagtccatccatacggatgccgtgtcatccaggtaatttaattcattactttttcgctaatttgcaatgcatttgtagcacggagtcaactaatccatatgtcatcctccccatttattttcagagaattctggagtactttgattcatcgatccaggagatctttctagaagagattatagaggaggtttactatatggcgaaagatcaatacgctaactatgttgtgcaggtcagtcagtttgtattgccttcttgatgttattcattattcattactactatacatatattgttctaagaagctgcaggatctgcaaattttcttacctaccatacatggatgggggttgctatgaattttttgtaccggatgtgcattcccatttaccttgttgtttgatttatttcttttgcagaacatattgcagcacgggaaagcccttgtgcgatctgcaattataaagaaatttattgggagagttgtggccatgagcaagcaaaaattcgcctctaatgtcattgaaaagtgcttaatatttggtagctatgatgaaaaacagaagatcattaatgaggtcatcggcacaacggacctcgtcagaagtggtgaaaccgaggctcttgtggtatatatcaaccttcttctgaatatctgatgcttaggtggctagatgtattcatagaaatgatagaacttaaaatgaacataaaaataatttgaaatgaatcttccagcacatggaagttacatcaaagttattagcatgaagtgtagcttcttgtccactctacaatggttcctgaaaagcatccatacttttttgaaagaaaaaaaacagtttacactggtacttaaatgctcttgaaaatgatacaaccattgtgaatctggtcttatatatttctgtggataatgcaggttatggtgaacgaccaatatgctaactacgttgtacagaaggtgattgaaacctgcgacgagtggcagcggaagctaatactcaggcgcttgagggcgcaccacagcctgcttcacgactgcacctatgcaaagcacgtcgtggcacgactggataggctcatcgatatcgggggtacgcaatctgtctccctgatcacttgaacagtcatgagatataccagaaatgcaccaaaaatacactcttttttgcagtaaaaaaagaggttccacatgactttgttctaaacccattttgctattgccttttctccagagcgcaaaatggcgaatcccaggcgccccaggcgacatgggaaagatcctgtgccaccactgacctagaaatgagctcgagtaaatcagctgaaggggacgacggtgacctctgtccactgctgcttctgtctgcagcttactgaatcctactactgcggtaaattcgacgatcaatcgagactgctgagatgatgaactggtcatgaactctctgtaatgttagtgaataatggatgtgaagatcgaatgaacatttggatatctgtaatgtcacttgaactctggtaactgcgaggtctattctacctgtgtttgtaaggggacgagactttactatgcctgtcagagacatgtatcaacggccccatgtttaatctgtttagagggggccaaatgggccgggccaaaggggcggcccggggcacggccgaacctgtagcaagcacggcccggcacggcctgctacagtaacgggccgtgccggcacggcacgagtagcgtgccgtgcttgggccgctggcccgagcccgcgggccggcacggcacgacacggctactgtagcgggccggcacggcacggcccgcggcacggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggatgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaattttttttccttatacatttcctttgcttttttttttaaaaaaaacactgtgcactgcaggctggcgggctggcggcctgccttcacgggccgccgtgccccgaacggcccgtgggccgcgggcgtgccgtgccggcacgggcacggcccggccatccatgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctataaatctgttgtactactaccaggtttgtgtaatggtgtttatggattcagctgagtgcatgtttgtttgataataatcgggttttaaatctctgactatatagctaccgttatctccggccatagctgttcaagaagggttcgctctcatatacaatttagccgctatatctccatttaacccactataactattagagaagatcaaccgctaaatatctttgcctgctatttaaaacactaataataatgcagctttgctttcatatggattttggttagaatgactgggtcaaattattcaaagcatacttcatattcttcatctattaacaaaatgtttttttttaaaaaaagaaaattatttctggatgctgctgttatgcctaactaaaatggattaaagatttgtgatatgcttttctgactttctttttgaaacaaacatacccccttgtcttcatcaaatcatcagtacgacatctgtgcttttcattgacgggatagaaattttggtaggtggaagaccaaccaaccaaccatcagtactggtattgacttatcattagcagaattttgtacaaaatcattatacaatgccacccattgaggttaacaaattcagctcaaatacacaacttcaaattcacagactaactacagctaagcggcgaagaatctgttcaaatcgagaggtttcgctcaatttgtccctgcctcaaaattttgtcatttgtctctaattttacaaaatttaaacaaaacagatgctccacacttcactggtatcccgatcctaacacgattctatactccgtatctccatactagcacgataaaacctaaaatgatcataaaatcgatatgtgcggttctatccaccacagtatcctacaatatgtatcccaacgctaacgaccttggtggcaagaacagagtatcacaatgggttctctggtcccacttgaaccaaggttgcgggcagtgggtcccacctatcgttatactgacaggcgggcccaggctgtggagtcatacgctgacgtgggatgacctcatcgacagcggcgagtaggggaacgtggccaccgacgtctgcgtcacgccgtccgccgccgccgccgccctctcgtacgacgacgtcgggtacgagtgcacgaagtcgtagtagccgacctcgccggagctcaccggcgggggaggcggcggcggcggcggctccggcacctccgccgcgccgccggcgtcgaggtacctcgccacctccctcatcgtcggccgcaccgccggcgccgggtgcgagcaccagagcgcgaccttcaccgccgcctccgcctcgccggcgtcgaactccccgcgcagcctcgcgtccaccaccgcccccacctcgccggcggcgtacctctcccacgcccactccgccagcacgagctcctccggcggcgcccgcggctcgatcggccgccgccccgccaccacctcgagcgccagcgccccgaacgcgaacacgtccgccgccgccgtcgccttccccgtcctcgtcagctccggcgccaggtaacccagcgtccccaccaccctcgtcgtgctcgggttcgcgccgtgctcgtgcagcttcgcgagcccgaagtcgccgagccgcccggacatgtcgccgtcgaggagcacgttgctcgccttcacgtcgcggtggagcacaacgcgctcccacccctcgtggaggtagagcagcgccgccgccacgtcgcggaggaccttcacgcgggcgccccacgtcagccgcgcggccgcgaggccgtcgccgaacaggtgcttgtcgagggagccgttgggcatgtagtcgtagacgaggaggaggtcgccgcggcggcggcaccacccctggagctggacgaggttgcggtggcggagcctcccgatggacgcgatctcggcgacgaactcgcggaggccctgccgggactcgtgggagacgcgcttcacggcgaccaccgtgcgcggcggcttccccgggagcacaccgcggtacaccttgccgaacccgccggcgccgaggagctcgcggtcgcggaacccgcgcgtggcgcgccgcagctcggcgtagctgtagcggtgtggcccgtagtcgagctcccatggctcgaccacgtcgcggttcttgtaccggtgggcggcgtaggcggcggcgccggcgagggcgacgagcgcgacgaacgccgagaacgccgcggcgaggatcgccgacgtgcggttcttgccgccggcggcggggcggggcagcgacgggagggaggggacgtcgagcggcggcgcggcgccgccgccgagcttgaagctccagcccatgaggtagtgggagctcgcgaggaggcccgtggacgccgagaagccgacgaacatctggtcgaggaagatcggggacaggtcgacgtggaacgagatgagcggcgacgccggcttcgacgccgacgcggcggcgatggagacgttcagtagcttcgcgccgccgtcgtagtcgacccaggcgacgatggtgtcgccggacttgaggttgaccggcgcggcggaggcggaggcgttggaaacaaggctgttgaggtcgacgccgacgtggttgtcattgatgtcgccgaactcgaagtcctgcacggtgtcgaactccaccgcgaggacgtggttggtggcgttgccgacgtcggcggcgctgagcagccccaggtactggctcggcagcgcgccggggaggcgcgggtcgggcgcgacgacgaacgcgaggccatggccgcccagcttcggatactccggcaccaccgcgaacgcgaactccgtcgagaacgacaccgccgcgccgccggcgaggaggcggaggggggacgggtagaacgcgtggccgatgagccgcgacgtctcgttggtgagccgcaggatgccgtccggccggagctccgtcacgccgttcagcgtcaggttcgggctgttcccggcgccgccgccgccgccgccgttgcggaagccggagtaggtgaattcctgggaggcggcgagggcggcgaggaggaggaggaggaggaggacgacggcgaggtgtcgcatcgcatcggagacggagaagacgacggcggtggacaggtgatcgtccgtggattctttggaggaggaatggaattcggaatggtaatctcgggggtttttttttgtagtgatgataaagaagagaagaaggggagaggagtgacgtggcaccactatgagtgttaactaaatgactctttctcatgtcactaatatttgatgtcgtgtagaggataatgcaataacattatgaaaggacatgcagttcggtggttgcagtgacctaagtagcacattaagatcgtaagttcaaatctttataagagcgaatttcagattgagttatttgagagctaagtttctaatttaaaaaaagtcctgagttcaaatctccataaataagttccctgtttaataggctaagtttctaatttaaaaaaaatcataagttcctaatttaaaaaagtaatgagtttaaatcttcataggcaagtttcctgtttgataggctaagtttctaatttaaaaatattgcatatatccggttgaatgtagagaccaggttaaaaataccattctctacaaaacaaaaataatattgtgcagtgttgaatattggtgcaaggtgtaaaataatttctttttttgcttgatttattatttttaaccacttaatcaatgcttgggatggaagtgacaatgacactcaagtggctatcatttttattttgtatggttctagatagccagatgcgcgctctctctatagccataaaaaaaatgtcatcttctttaagaaaaaaaaagagtcaaaattttaaaactttgaagacagatgtctttaataatattgagattgaaaatcgtatggctttggatagcctactacatctttaggaaaaaaaccaaccatggaactttccacccaaactatcaagttttgccgttgagttgaactatttgttttaatttgtaatgtttcaaatagaacattataatttcgaatactattttatgtcgaagtggccatacgaggaccatgaaccaatgcattataaggctgcgttcttttcccctctttttcaactcacctccctcattttccgtgcgcacgtttttcaaacggctagacaatgcattttttaaaagttttttttatatgaaagttgctttaaaaaatcatattaatctatttttaagttttttttgctattaattaattaatctctcaacaatcgcgtgtcaaaaccaagtcttaaagtttactaccaaccaagtgtaatggaacggttagcacccaaatttgtcaaccctatcaaaagagagactttgggttcgaatctgagccatggtatggtgaagcaaaggataaaaacacaggcttcaagagtcaaccctatcaagacaactcttacacaatgtccagagaggttggcactaatcaattgactttgaccccaggtatcaaggaagaaaaatggagtactcctgctaggtgattattatttccggatgcagcctcatttggagggcagaatttcagagacttcataagagatactcctacgggaaagaatccttaaaacataaacttaaaaagtaaaaaaaaaacaaacaaacaagtcgtccaagcaacaagtctaagcgacataatataaaaaaatttctttaagaaaatgtgttttttttgaagcgtggagtaaataataatacatttcaataatccggtgaataatgtgataagaacatggcctatgttttaagttgttttctaaagtattttatttgtctttaaaagtagataatcagtcacaatagtccactaataataaatcaaatagggccacgctgaaaaaaaaaatccctaaacagggtggggtggtgttcttgaattcgtgcattcattggtcataactacaatgctcaatgccttaaatgctccattcgtcttaaaaaaaggattttagatgaatggaacatttctctatatagattcgtactatgatacatcacacccatctaaaattacttatattttatactttaaaacgaagagaaaactactatcaatctatctgtagcagtctctcactcccagtggataacaggagaaggggccaatccacatccatgtagagtacttctacagcagtatgaaggtctctgtaggcctgtaattggctgggtcagctgttctgcatggagtcaagcgtaacagatcatgaaagcaactgtggagaaccagagagtgaaattactctgaatttgtgaaaaaggtcttatactgtgaaacagggaacaaaatggtggatataatttgtgttttaaatcgaactatgctcctttggaacacatgattattggaagaattcaatcctatggaaaaaattatcctatcagatcatttggatcaaagaaatatctatccaaaaattctatgaaattcttttggcttgactcaaaactagaaaactggagggattctagcatgtgcttcaacctcgtgtgaaaaaaaaaatcctttgtgcctttctcttctaatccctttatttttatcgttatgttttttcaatccataggattcgaagttgatagaacacttcaatcctatattgtttctgtttatatgttttgagaatcttgcgttctaaaggagccagaaatatttcaaacatgcggagcgtctttgttttgttttggcatatcttatgcttcagtttcttgtaacggcagagttacaatatcatgtttttttcttaaaaaaaagaggtgtgattcataaaaagaaaataaagaaaaaacagtaacactctatcgtttatcagactattgccgaccataaacgtgaggcattggaggacatttgaaattccaaatatacgcagttgggctcagatcctcggacatactcatgacggatgcttacataatactccctccgtcctataatataagggattttaattttttttcttgcaacgtttgatcactcgtcttattcaaaattttttgaaattattatttattttatttgtgacttactttattatctatagtactttaagcacaactttttattttttatatttataaaaaaaattagaataagacgagtggtcaaacgtgataagaaaaactcaaaatcccttatattatgggacggaaggagaagtagtttaaattgaccatcgcaaagctagccgaaagccaaagttctggtgaaaccgcattttgcaaagcaaataattgttaattcgctgacacttgcttccagacctctaattaatacagatttagtcgaaaggattagaaattttagttggattccctggtctgcttgctcgatgcgtatgtgaatgtgatgatgtattgacagttaattctggttcacgaccgaagtcgtaaagctggaaattttcaaaagaggttaagttaaaccaccgtttcagttcgtaaaccatttcagctatggaaatcatggtgatttaattagatattctgcacattaatcagttgaattcatacccctttttttttttgcttgatgaaccagaacatgtctggccgaaaagttttatgtgattttctaatgtttccacacgaggcagcgaaaattcttccttttacgcttttcttttctacgaaaacatcatatcgccaccaactttgctggagaaatcaaactgaccatcaatctattcttcaaatgactcatgtctaacttgggcttcacaccgatcaagtacaaaagtaagaaaaatagagaagacccgccgtattccctctcacaataaggcctcgtttatttggggaaaaattttagatttagttgccacatcggatatacagacacacatttgaagtattaaacgtagtctaataacaaaacaaattatagatttcgccacgaaactgttagacgaatttattaagcctaattaatccgtcattagtaaatgtttactgtagcaccacattgtcaaattatgacgcatttaggtttaaaagattcatctcggaatttacatgcaatctgtgtaattgtttttttctacttttaatactccatacatgtatgatgtgacagcgagaaaatttttgttatatgaactaaacagggcctaaacctactatccgtgagaaaaatgttcaagaattcggagaccaaagtttatccctgaacacatatagtgggatgtgtggtgagccatccactaaaatctccatggttggatccactgttgtagtggtggctgatcatggtgtacaatcaatttgtggcttttagcattgcatacttgcaacttgctaagaaggagatcaatggagtgtgtgagcttagcttagtcaatgaaagtggctagaactggtcaacaaattcgcctccagatccaagccggttcagccattggacaattagtagcactatagtgcagcatgcttgcttgctcttgtgaattgtgatccatatccaattattagtaaatattcctaagcttggtgtatggtctgactcattgaaaacacctttttgttccctctcttgttgttttgctaggatggagccatgagcacttgatgtgatgttgatcggtgttaattagtgcattatcctaatattagtcttagggagttggaataagatatactagaatctggttggtgtgtcccaattgaatattgtgttgcatattccttgcaactattttcaggttgccatttttttgaacgaattgcacgttgccacttggcaattcttttttttttgggggggggg

SEQ ID NO: 79326 - DNA, 6232 bp, Oryza sativa
  unsure (1)..(6232): unsure at all n locations
tgcgcctccaaagaccttgttttcctcctagtataaacttgtagattttcttcttcacgtggccttctccaatttttctcatgaatgggttcactaacaggatatgggattgagccaaccacaaatttcatgcttcttgattgtgtgtcttcttcagtacctgatgagccattctccccctcttgtccatcctcatcaataattggattgtcaagattaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggtctatgatctctgacaaaacaagtacacccaaacacttttggaggaacaatgaattcatttttcccaaacaccatttcatatggagtcttcatcccaagtattcgtgatggcatgcgattgatgagatatgttgctgtcatgactgcctcactccatagaaactttggtacattcatcgtatacatgagtgaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacacaagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcatcaggaaataccttagacatagtatcaaaggacatatgtcccaattgacaatgttttagaatcaatttagcctcctcttcacttgtgctagctaacaaagcactacatagtgctttgtccgtccctcttctatccagataccacaacccattatgcctaacgccggttccaagctttcttccagttcttctctcctcaattagacaattctctcggtcaatagtaattcgacaatccatatgatcaaccaacgagcttacggatactaggttaacaggaaaagagggagcatataaaattgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggggtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaacggacaacaatagccaatagcaccaaatccttctctgttgatcctacagccaatagctgcgcgtctctcagccgctgtgctccctacagcttgtgctgcaccaaatccttgcgcagctcaaccagcgagcgtgcgccctgctcctccttcacgctgctcgcgtcgagaacctctgcagcagccgtcgccgcctccgccgtcgacactgccgctccacctccgctgtccgacgtcgccgctccgcctcagccgtcgacgtcgccgcagaacccctctggtcacagcgccgccgccgactagggttcgcgtcggcgaggtcgccggtgacccagctctgataccatgtagttttgtgatttttcctctagaagcttcacttcattttctttctcatctactatacatatacattggtggaatgggccctattgggctgaaatacacacgcctacactcaacataaggtgggaagaaaaattgaactatggatgattaattggacaagcattactccaaatccgttatattcggggataaaatttgaatgattctatcccttatatttggggatggagggagtagcattgttccccacaggcaaagtgatttttcccacttccacgctatatcatttttgtaattggcctggcatattctcatacattgacctatatatattgtccgttaattcttgccatgttaattgttagttctcatacattcctgtttgtgtaatcatcacgatggaaaaaaaaagcattttaccttgtttcctagcatcgcaactttgcttttcttgttcgtcacaattaccatgttttgtagctggtggtgtggtaaagttcatatataaattcggaaacaaaagatgacatgttacttcagtatgcaactgacttttctttcatgtgatatttttcaggtgatcaggatacttttgtggcccactaaactgaaaaagttggtgtcatggttgcaagttgcaaataaagttgcatgaatttcagttattctagatgattgttactgatgtattgccatattatgtacttccgtgattattcagagcatatgtatcacatagctcttactatttataactacagttccacaataattctttggtattatatttttctgagacttgttgcatatagagctatatcaattacgttttcaaacttctcccaacttattgaatcttgttgaaatccacttgaaagacatcaatggaacttatacaatatgatgaaatcttcaggaaaccggtctggaaaacaccaagaacagataatctgaaaaaatcatgtactcttttaccgtttcagaactgaagcaaaatccatagaatgtcaaaattggaatttgaagcatcattgaaaaatttgaaactagtctcaaaacgtctatgaaatgtgccagaaacctactcaaacgtatgaagtatctagaccacaaatcccatctcattgcaataaatattctgctcaacaaaataccaaatctttgctcaccaactccacataaaaaaaaccaatataccgaatacttgtcttcttggtgatcacaacacctcatgctattgtcggcatgccatatttcactgaagatattttgataatttctttttacaaatacagttcgtattgtcatgtactccacagccatttctagaatctttccaagatcaagaaatttaatttggatcccatcattccatgctcactaaatcgttaattaatatacctaaaacacacatcatcacagtggtcctgtactcatatacaatttcatgaggatgaccacttggcaggcacgcttgcaggagaaaacgagagcaagggacacatcaagcaacaagaaattgacaggctattaaattattatataaccaaaagcagagacagatacactctaccaacctatctccaataccacaatcaagggtaaggcatttgagcaagtattcaagtatgtatgtatgtacaaatgagctcagcctcacactctttatcaacctcaacacatgacactcacaggtaacaacatttcacccacactgggtgtttttctttctttttttttcgacgatggaagcgaaactcctagcctccgcaccaactaaggatgcacacgaccgaatttcacattcactaatacaggatgcgaatcggacaccgagaaagaagataaacaaacctcgatatttttttctctcatttcttttttggagtgcatgaatgcaaggacaatggccaatgaggatcatcatcatcaaagccaaaaaccacaccctagaatgacttctcaggaaaacccttcccttagtctctacacaaagtagttctgaagttttgctgctcatgccatggcctcaaacttcagagcttcagcttcatgagagccggatgacggtgcgagtcgatgaggatcgaccacaggacatgaacatcctcatcctggcaggactgaacatccttgtacaagatatacattcccctacctatcaagaaatgcacatatatgttcatagagaaaacaggcagcatctccacaataacatgttcgaaatgaagaaagaaaccgtcatgaagaagaatgtcgcatagtttgaaatgcatagaaaaaccatcatgaagaagaatgttgcatagatttgcaggttcatgggcagagaaacttacggttcctgcgctccgaatgcgcgcaaacccagagcctcctgagaggggagaagagggagtggagccaccccattgaggaatggtgaggaagagatagtgtgcaaatggaaggaaatagagggggttggggggtagtagggttagagaggaggtaaccatcagctctgttgcttttggtgatgaggtgaagtctattgcactttaccatattgttgtgcttccttgcaacccaatcaggggtgtcatgagcaatttattctggtatattgtccctttccactccttggtcttccttctacctcattttttctcccattggaacggctatttctcacactttaacctaacctccaagagaataacaatgcaaggtagtacaaaaccggaatgattagtttgcaaaaatgattttatttatgtgcatcttctgcaggctacaaatatcataattcaacaccaaatttgtggggttctttggtccatccttcaatttgtctccattcttatgtttggtgctatatcttggtaaaaaaaattaaaaaaaagagataagaagtgactaaacaattatttttgaatttggaacctattggatttggatcaaatattttaaatactagctaggtgtaggcttggtttttagtttgtactagtaccacagataaataaaccaatcatgtatttcaagtaaccaaataagctttcgaatttatattctactcgactgttagcatatacattttttctaatcatgtctactcttctgccggtgtgctgctcttatcaatgcgtgtatatattttgcccttgacaaagacagaatgaccttctttgagatgcaaaagaagaaagcacatgatagtgctataaacgttcactagtgaattgaaatacaacaaattgattttcttaaattgatcatattttttttagaaaaacggcatgcatgttaatacgactaaaaggaccattattcatgttaccatggatttcatgtacttagaagaagatactagcagaaaataaaactgaagagagtataaagtgctatattcgtcctaaaatataagaagttctaagcttatacacaggtattaaaaacgttagaaattatattttagaatagaatttcaatgttaaaagttgttatattttaggaccgagaagtagcaaatccctcaacagcaacccccccccccccacccnnntnnnncccaaaaaaaacagacacaaaaagggnnnctgnnngncgacgtatgtttgttcttctaaaaatggtcatgtgttatgaatcttcgagaacttattctagtatatgcaccaacgttaaattgtaaatgcaaccgtaatcgcatatgttttacttacggattttgccttctagaacacagttaacgtattggtcaagtgcgtgctgttcatactaaaatcctgaaagttattaactggttagtggtctgctagctcagcaagcgtcctaaccttccaggctggtggggtgtttgttttatatttttctaattactagcaataatgcccgtgcgtttcaactggtgatgggtaattttaa

SEQ ID NO: 79327 - DNA, 4417 bp, Oryza sativa
  unsure (1)..(4417): unsure at all n locations
tccgccctaaaatataagtttttaatacctcgatataattttaagatgctactttgactaacaataactataaaagtaagatgatctaaataaaaagagttaaatattataatagtttgtttaatgataaatctagtaacatcaattttacatgattaatcttttttattttcttgctattaatagttaaaagaaaaaaggttttacttagcactattttaaaaatgcttatattttgagacggagggtttacggagcattaaagtctcactgtaaatcaactggaagccaattaaagatgacgcagggtctactgaaaactaactacagtacttcaaagctaattaaggctgtgtttagttcctgaaaaaagttgaaagtttagggaaagttggtagtttgaaaaaaaagttagaagtttatatgtatagaaaagtttttgatgtgatgtgaaggaaagttaaaagttgagaatagttggaggtgaactgaacacggcctaaatatggtgtatcaattgaatttggcatgaaagttgacaggactacttcaaagagaaccccacacgttgacctatcagtcgtatgtgatgtgatttttatatgcatagtacagtatatgtcctatactatttgctggagcaattgccgatcatgaatagttttgattatccttctttatcttgtctcaataagaaataaatcaaattttcagtctctcattcaaagttggcagtatataataatattactagtgaacagagaacgaaaatgacagctacattatgccacatttgcaagcatgcagctgctcctgctcctctggttgactgcatatgaaaggaatttgattgaatttgcagattattttgtccaacgaggccatttaaaatataactccaaaaactactgatcacacatccagtgaaggtctagctggtgactattaattgcactcttcagtaccgtctggtcagttgctttcaaattaattaatcctcttaactagacgagtggttgacacaggtggcacgcacaatgcaacacacagattctcgtccacttgtccttacctctgactttgactccagtagagtactcgacaaaactacaagtcgatagatagactgatacctttgacaacaaagtcgttgcaaatcaggcatgaaagggagcgacatatatatagtattaaggctatgtttagttcacgccaaaaaaatcaggcataaaagggagcgacatatatagtatgaaggctgtgtttagttcacgctaaaattagaagttcggttaaaattaaaacgatacgacaggaaagttagaagtttatgtgtgtagaaaagttttgatgtgataggaaaagttggaagtttgaagaaatatttcggaaaacacggcgtaagttgagtattgaagaaagtaagagccatgctctctccatcctaaaaaaaacccaacctggttggggatgggacattaaccaaacgtacgtaatgggccaaaatgacatgttaatcaactttggtgtgtcaaatttatcatggcccattaaacatgacagcctcgatcaaattatcagcccattagaagtaacgggccattcaacgtgtgactgagctaacttaactgatttcagcccagtttaacgtcgtcaggtgtaaacattgaggacacatcatatggcaagcaaatgggaaataaacgattctcaaactacaaaatctcaatcagtactcgcttcagcatcgaccatctcaatctgacttctacacatttcatcaggaaactgccttgagggaggaactcgctaagtaaaatgtcgatccatcctagtcagcatagtcaggttttgtacatcagtcgttctttctactacgagtaggcacgggaaagaggattgattaccaaaaggggagcaggagcgtcattctttggatgaagactggccatggctttgagggggctaagaagcacgaccttccaaaatcagctccttttgaatcaaccatagagggaaacagcatggtggtcatagttacaacaaatccagcttacagttgtctggttgggtgcaggttgggtgttctttggaacaggatcgcgtcataccaccctgcacaattcacaactgatctggtcagaaattaacacagttcagagtattaattaaaaagttaatttgctacatgagttctgaagcaaactgggaaggtccctaagggcagtcccaacccataacactagacatggtttccataaactccacatcatcaagaaactagtactagacactactcttccaatgcaaaaaccactattctacttcaatttaatgctacttatctcacatgatgtcttggatgttgtgtagaaaccatgtctcatacaagacatggtttccttctctttcctcatttattcacttgccacatcattttttatcctaggtggcaacttatttaatgctatggacaccatcatagtcattgggttgggaatgccctaacaagtcaatcaacaaaaagtttctatcctactactagactattcaaagtacactgatatcgttgcatgacagattttatgcatcattatcactttgcattttgttgacataggtgcgagattgttcaataggggaaatcatgcatgtcctccattgtgatcatgaaaactattaaacacttttcaacagttgggaacttgagtggtcatccatctatcattaggtttgctgtgagcagcattgagcttttccttttaaccaccggtgcaggaaaacttcccaaaaaacattgaccaagtttctatatcagctctaaccaagaaaccatgcaaccaatagttcagctgtcagagagtgggaatccactttaaggaggtaggacagcataaatatctcataaaaaatatgtataattcatttgtaacacttagacattatgatgcttaactaactagcagtataaaaagatccacagttccacactttttagctataaagggtgaagcagccaaaacagaaaggtgggggtatatctataccggtatacccagcacaggacaatgataacttctgattcttgacagatttcttcattaagttttgagtagttgtaccgcaggtgggatgcaatggatacggaccatatgaggtaacaagagcagtagtttagtttgcctagtcccaacaggcataccaaaaccctcttcactgtgtgtgcatagctatatatgtattctagtttatcatcaaacaagacacatctgttaagcaaaatgtaatacagtgttcattgatctaaacacaaccaatgttatgataattcattatcttgaccaaatagcttgtttcaaatcagctaggtactaaagtttaacacatgtaacacaacaaattccaaatttcagcaaatcacatattcactattaacatttcactacaagtccaaatacgtgcatccttgtccagttgtcctcaatatttatcagtgtaaaacaagtatgtgccacatgttctagttgtcatttcactgtttcatgtctacgtagaaatttaacaacatgattattacaaagcactgtaggcctattccattctatctaatgtattacttgctgaaattctaaagctaacagtttactagccataagcccctaattagttatacaagcgggaacactccaacataccttgagataacgcgcattgaagatccagaaaaagaaaacatgtacaatgttgatagctctgcttatcccaagatcaacattatgcagcattaaagctgcggaagctcctgtgggttctccattgatgcccttagtatcatgcccgccctccgcttccgctcatcctttacttcctccttcaagaaagacggatcctccctcagatccaggggttttgaattcaacacagctgataacggcttcttatcaattccaatcttgaggtgcaccggtgccctctctttgggaacaatgctcttctgattctgattgttgtcccaacctggcccagtatcaatgtccatnnnnnnnnnnnnnnnnnnnnctggtgcaaatgcgtcgaggacagagattttcctcctctgtggttgcatagcaacatcagacacctccttctccccaggtggcaatgcaggctcaaggaatggatttctcttgctcccagccacctgtatctccttccccttttccgcagtattctctgtaaccgctggcctaaatccatcagcacctgcaagtgccaaccgccgctgcaagctgagcagtgacttctcagccttcctccgctgccgcacctgctcaaccttgtccaccctggccttggcctcctcttcgctccaaacctctgtccttatgtacgtgtgtggatccgggaacaccgggagccattccggcacatgctt

SEQ ID NO: 79328 - DNA, 9885 bp, Oryza sativa
ggggtttagggtttcgggggggaagcggagaggggaggaggaggagaccgttgggtggattggattagggcttggaggagggtttggattcggatccgagcacgcgaagcgaagtggggggaaggtcgaggtggagacgaaggggagagagagagaggatggctttatagaggaggagtcggtgggtggtgcgcggagctggaagacgaagacaagtggcgctcggtgattggattagcctggtggcacggttttatgggccaacttgtagcacggcccaattaggcccaaatcgtcgaatgaaaagaatacacaatgcactactaataaccagatctccctgatacaggtttgagaacttgcaatggatggcagagtatatgaggaacaaaatttgacagaatataggtagtagtagaacattgcatgctccatccccatcacggcatgatcacaaccacatctggtgaacttctggggaacccaactttgcaacctctgacggtatccagcatcgcggtgggaagcaatctcgggcagcatggcgaaatggcgagtcgcagtcagacttcgctttagtggagcagaagagcaagggagtttgtggcctctactgatcatctcagctcgctgtgcagccatgggagagatcctctcagcgtgcacgctggtgaatctccacgctgccagcggaagcctggttcgcggctcggttgctcccgaagttcttgcggtttgattctctcgctattcttgaaccaaactgcgtgaagcataggatgggagtagtggtgtcaagtcacaaactacagcttctatgttttctttaaatattaattctatggaattaactggttggtatatgcacctggattgcccgctttggttgaagtgcagcctcttttaagcccagtaggtttgcaaccttcaacatcatcacagatatgtatgtattaacgtcacccacagatattgagttacaaaaagaagatttatgcatcgtgatgtatcatgtacttcctccgtttgacgttctagcatttcccacattcatatagatgttaataaatctagatatacatatgtgtctagatacattaacatttatatgaaggtgggcaatgctagaaagtctcacattatgaaacggagggagtacatgttactacttaacaaaaatcaatgcattgaaacacaagaatgcaaatcatgctccaccagaactatttttttttctagaaaaggaattctatgtgttgcttttactcaatgagttatatgtgaatttcaaatgcgaacttcaatttaatgtaacagcccccatatggactaagctcagaacaagcacaaacctctctcaagatcttcttgtcgccctttccaacaggttcatcaagtttagcaatatcccacaatggaatttccaacaaagttttgatcacattctcatcaagaaatggaaaacgtgcctgtagcatggacagtagtacacatcagattgctaaacaaaaattgctgaacatttctaattcagaaagcatgaccgaaattacctccttgccatggtcagaaatgcacctatcgtctcttcccatatttcttttccagattctctgtacatctagtctcatctcctcatcaagtaaaacccagctaaatagaggcaaaaaaaaattcaacattcttgcagttgcagtgtaagaacatctcatggggtatgcattgcacaacctgatatgcaagtatagaacaaacaaattgatgcttacgcacataccctccaagtctatatttagtcctatgtcttccataaccagcgcactgctcatcagccccagaaccgactaaaagaactctagaagttgacttgtacttgtagcgacaaccatcttgcatgttgcatatacttccatccacccaaccatccccaccagcagccaaccagagagctataccaatatttaaatcctgtacaaaaaaaagcagaattataactttataaagctactgtaaaacatttgaagtaatatatcaaagctataaccaaggtacaaaccatataagtatttgaagggtatataagtgacatcacatgttcactttctcctttcaagtttgtcaaaactgtgtcaatctcaacaagacgccatctgcgagtaagaaaacaaacagctcgatttagcactacacaaacataatgattgcagcatggtaaacaataaaaaggggtagagaagtatttagtaacgagagtatggaaataaggaagtccaatcaaaaggcttccacttgattatagaagaaaacaaatggaaggtaaacatggatgagctatcaataagaaggcacaaaagtgtaattaaacataatatattcaatttgcatcggtggcttgatcaaattcactggccagctagaagactatagaaggaaacaaaacaggcaaataattcatcaggctgtaagagtgtcaatttttttttttacaaaaacactgcagggggagcccccacatgagagtgtcaaaaagggagtacataattcaattaaacagaaatcttgtgcaattgaagtgtgcaaaacagttaagacttgaccaaaggtagctcatggctaaggatgtgagatgttcagaagtcaaatcacctacggataggggaaattctctgaagttccttcagtcctgccagtgcagaaatcctatctggagcaagttgcccatcaaaactgacattcaacaaatcaattgtccctgttcaaaatttcaataactgttcctcatatatattgaagtatagtgtgtagcataagcagctaatcttcttgcactaatgtactataaaaatttaaaattcttagagtactgaacacaataaaagcaacggttggctaatatattgaactgctaacagtattgaacaagaaacagtaaaagcaatagttgaacttacatttggaatcaaggcactggtctaataatgctgcaagtatcatggagtccaagccaccagagaaaaggattgctattggggctagctcatcatcctttagtttatttagatcatcctgtccacaagaatggactatcaatagagtatataacaagaaacacaacaaggtccagacaatatagaactattttcaagtagcctgctggagttggggaaaaaagagtcatatagcagttttaagtcagtgccttggtggtcactcacctgaaagagtctgttcaaattggttcgcagcattacagattcccgcaacgcaatcaacaccttatacgctgaatggaaatataattgtaaagaagtatctgtattagcaactttccttaacagtattttgtttcaaaaaacttcaggagtaattatctgtagaactttactgctttatgtgaactgctggaaacatagaagaaaagatctctatttcccagtcaattaggcccttaccagcatttttgtcagcttcggttgagtttctgaagctctgagacaaacaatagtcccctacagaattctgatgtgaagttaagtcatccacagtaggaactatcgatttcttcttccattggattaattcatccaatgaagagttgatccagtcatgcctcctaacttcggagacacatgcttccttcatacacatgccacttttttcaaggcttttcaattggatgctgtatatcccacaaggaagctcttcccagtaactcatgttggtggactcaggaaaatcattatcttcccctgactccataactttgacagttggcgctgtaggagtgaagaagagtatataaatgagatgattatcaatcaagtagagagtaataatcactctccaaagcatgaatagaatttgaagtattaggtgaaattttcaaatttttttgtaaaagaacagaatatatgcaaacatttgatatggtaggcacatcaagattaaaaatatcttaccagagttattacttgcaaatgaagggggtgatactgatgataatataaagcgtggatcatcaggtgatggccaatgtaccaagaggcttcttctcccgaatgcatcccggccaaaccacattgtttttgagtccttctgagagttcaagcaggctcaggtgttagaaagttcaatctacaacaaattgcaaacaggacaaacatcacgattacctgcctgccagtatatcaaagcccaggggcctttgattgtggaaaggatctgtggaactgatttcccaacacttccacaacagagacatgcttcatctctaacaagagcatggcactcacaggaacaacaagattccagtgatgacagaagtgattgagtatcattttggtcatcagcaacatggactcctccatagatctcaccttaattgaaaaaatagtttcagtatcaagttcaagtaagctaatcactcaactactaacatggaagcaacactaatacgctactaaaaagtcaatcgatgcacgagttcgaatcatcaatcaggaaaagtcccagagtatggaaatcggtacatgtaaaggctatatcttacaccacaatagcatacgttccacacaatgaaatacgaaaaggaatcaattggtaatagtaacagggaaaattttagatgagcagaattaccgttatatactaaaacatttcctgattgacccaccatcggctgcaaaatcggctcagctcccctgagctgcagcgttgctccgatgaagcacaactcagtgtcacccacatcacccccattcccaactccacaatcacacccatcactccctgaaacgcaggacaatcaaatcacgaaacgcccgaagcaattaatcaaccaaaactcccaactcccaagcacagggggttacaaagcaacctaaggtcgtgccatccgcgcggacgcggagcctctcgcagccgaggctatccgggccacgccgccgcagggctgccttgagctcatccaccgtcacgcccttcccctgcaagcacgcaccaggctaactaactcgattccagggtttagggtttgggaaaccacggcggatgccaatccgaaagggagggggtttccatacttttccattcgaggatggtaggaacagtacctcgtcgcttggttggattccgacggcagcaacggcggcggcggcggcggcggagggagcgacgactacgcggccgccgccggagaggacgagggctatgccgcacatcgctggctcctggaccccacttgtcagttgctcgagccaagccgtagccgcgtgaagtcaagtgcaaatatgcttgccaatttgcagaaaagacccggagaagaagtatatttgcatttgacgagttcaggctgtgactattagctttacaaaagaattttttttggaactagctatatttattatatttgtggcgccatatttttcacaaaatatagtcggcgtgtgtttacattgtaagtcactaaattacatatgtaattttagtgtatttacaatataagacccaaaattacatatgtaagtcttaaaattacatatgtaaatcctaaaattacatatgtaaatagtgtgttagtgaggtgtaactacaatgtaaatttatataaatatataatttacaacaacaacaaagtttaaaaagcatatcagtatgcatctatgtcgtgtcagaaccaatcacagcaaagcgtgtgtgctgatgccccgtgagcacgaatcttcatgccaatcctaaggctgaaaattcgactgcgtttgtgggaaaaatctgtcgccataattatagccgatccggaaaactaagttttgaatttcttttaagtccatgctttaaaataagagtaaattgcatccgcggtacacgaacttgtcgagtgggtgtaatctagtgtatgatcttataaaatgcttgttttgttacataaacttatcttgcgcgtgcgaactaaggttaaaaggacattacacgactagttttgttgatttaggtactgattaggatactacgtaaacatacaaatgagaatgatatatatagtgatggtagagaaagatataaaataccgagcaatgatacatgggttagaaatatacaaaattcaagataaagtagagaaaaaaatttataaatatagcatgttttatacatactcatacgtatgcacgtcacatcctaatcaacatcagctaggtaaattaaccttgccaagccatttagatacaattatcagataatactaggttttatacaatttttgcaggtacaccaatgctctcgtacaaaatcaaggcgtagggtaggggcacagtaattgatatacacactaaatactctgcttaattacacactaattgcaaattaagtggtaattaatcactcaaagctaaggcagtgagcatgtaatcgcttcagctggacgagctctggagcttggacacgaagctggaggcggcgaaggcggtggagccaccgacgacgcaagcgagcgcgaccacggcctggacggcgacctcccatgggtactcctccgggacgaggtagacgacggcggggccggcggcgagcagcagcagcgcgacgccgagcagcgcgccgggggtgcccgggtcggtcgccgccgacagcacctccagctcctccgccttggacaacaggcccagccgctccaccgccgacagcgacagcccggcgcgctccgccgccgacaggagccccgccttctccgccttcgtcagcagccgcagcttctccacgttcgtcagcagcttcaccggcggcgccgccgccttcccgctcgtcgtctggctcggccccggctcccccaccgggaagtacaccgtcgtcccctgcaccgccgccgctcgccgccgttagcccgatcgatcgatcgatcgatctacaagctcacacgccatggggaagaggaagaagacttaagacttacccttcttgtgccggaggtgggcttctgggtggccatggcggcgaccttgtgaaggcggcggctgctcggcctcgccgcgacggtggccggcgacagcgacggcatcgccaccgctctagctgcgtccatcaccatggatggattccctctcctaccaccacacgtacacctctcgttcttctcgacttctcgtgcagcctagctcaccactagcttcgagatgatgatgtggtggcctatctgatccgcccagggacacgtgcccctcccctacaggctggaaatcccacgtcagacacgcatggattaatcctaattgaaagattaaggaataataaagtaattataattagagaaggtgaatgacaagatgattccatggcccaatggataaggcgctggtctacggaaccagagattctgggttcgatccccagtggaatcgcacagtttttctatttttgggtctttttagctatttggcccatttaaggcccatcgaatgggccttttattcggcctataataggttattgtgtttgggccaaatgtagcgtaaatgggccgacgatgaagcccaatagacccataaagtgggcccacgctccactgctgggttaatacccagccgccgcaaggcccagggcgaagcaaccaaacccttcgcgagatcagaagcgaaaccctagcggcgaatccccacacgacgcgccggagcggggagaggggccatggcggcggcggcggcggcggtggagaaggtcaaggcgctctgggactcgcaggtcaacgacgaggaggcttgggcgttcaactacgtacgtcaatccaatccaatccatccatcctctctcgcgtatctacagctttcttttctgttttttttttaattaatctaggcgtgatgctgctaattgcaaggatgaatttatctaggaggcatcagcggtggcttgtttaggtggatttagggacggatggatgtggattggtgttgtttagtctgctgctgcgttgttgagcaaacatgagggcatatgttgttttttccctttttgcagtgcgtgtttctatggacgaaagggttggactgttagagttgggttgggatggttgcgtttcttgagcaaacatgaaggcatataaatttttcctcttttttatttctgaaatgtatgttaccatgggcggtttaggggttagaactgggttgggatggttgggtactactgttgcttcattttttttattttgttatttacttcggttagtggtcgcactaacttgctagaatatgtagggttgaagtgaactgctgtgcttgactagtccttgtgtaaattgattctgctgtttgatgcttgggtgttatgagcttaatcatgttatggagaatgccaatgagtttaacaaacatgacatgctccttgctcttcttactgaatctttgttgtttgagtcaatcggtcttaactcataaatgctgttctagttattcgtaaggcggtttttgtgtgcattgtccactggctgaaaatgcatgatgtgagttaaagatgatcggcctaatcttttcacttatgtttatgcttatcatccaaaatttgaattttcaaccataaatttgaaactgattttgggggttttttcatcgaagttttatttttcagccttcgcttttagattgctaagaacacggatataaaagttttattcacaaattacttttcgtttactaatatgctgcgaataagccaaatgacggggccggatgttttcctgtgttgacttgtaataactcgtaatagcttctctaatttatgggtaagggtggcaactagagtgtttaacatatcacatagatggatggttagggctagtatactaggtacaaacagttgtatagcagaacagagcagagcagttgggttcactgtatttctgtgataggattggcatcctggcatgttccctgcattctgctactgcttgatgtgttaattgcttgagattaataaatcaaggaaatattgatggattgctggttgaggtgatcacttggctggctctgtccagtgcttcatactttggctagctgttatcatcatcttcctttgttctgtattcgtgtgtctgaattaggcatcctctagttgaaaaaaactcttctgtactcaccaggtagtgtgtgtctgcatatgtggtgctctttctgcagctcatggtgtatatattcactatatttaccactattttcttccaatgatgaattgcattaatttactatcagaaaagaattgatgtataggctatgtatggcgttgagccaattatccttgggatctcacttttgggttatgcctggcactgaatttctttttgctagttatcctaactgtgagttatatttagtgtagtatcttcactcattgatgctaacttcaacatttttgttgggcagttgaatctttaagtttttgttgtgtactttttctctccccattttttcagttgtccagaaagcatttgaagaagtagttattccttcttttcttcaaccacatattttgggcttagaaaattttgtacgcgagtcttttgactatgtggaacttttgattccgttgaagttattttttataataactatctggttgggcacagttaacctgactctttcttgtcgttagaaattctattgatgctaattaaactactgtcttgttttttcttgttctggtttacagaagctgatgaaggctggtggtctgtttgttgcatccatcttcgtgatgcgcaactttggtgacctgatggccatctaaagaggagctgatgcgacagtaacgtggatccaccagagctgtgtgtcttgttagctgttagttttcacttttatgtcagcaacgcaaccagacttgttcttaggatcatgaatt

SEQ ID NO: 79329 - DNA, 25778 bp, Oryza sativa
aaataaaaaaagttcaacgatctaaagtgaacatattccatacggaggtgtgtgcagttcatgaggcggcccaatagtgtgggcggcctgggaacagaatcggggacaacttaagggatctaaagtgaacttatttcgtgtgggcggcctgggaatggtgtttggcccgacgcgagagaagttgtagctgtacgatctgatggacggtcctgattgatcccgatctatataaaagttcaacagcccaaccctaaccctaaaaacatttcctttcccccctttctctctctcaacggtggcggcggcgcctctccccctccgccactcctcttccaaccccaccgcgcagcgcctctcccctctgccgctcctcctctcccaaccccaccgacggtgctgctctatctcgccctcttcccttccggcgggagatgaaggcagcaggtaggggcggcgccctctcctccgccggatctagcaggaggggaggcggcggcatcccggcgtccctgcgaggcctctcaccttccgcgcgcggcggcgcctgtaggatcgagatgtcgactagaggggggtgaatagccgatttaaaattaaatgacacctaatcaaaactaacctaagttgctaggcttggtgagggacaagactaactaagcaactaagttatgttttgcaatcctagggtgaaagtggctcaagtatatcactaggaaagtaaatcacatttcctaagtctagtttaggaatcctatggtgaaatgatctctagtatgtctctagaaatgtaaatgcaccaagtaaatgagacaaggagacaagagatttttcaccgaggttcagaaactcgccggtttcctacttcccgttgaggcgagcccaactccaacgctcaaccacgaagccaccacacgcccccttcgttaaggggtgggcaaggcgggagccggcccatggagaggactagggtagttcttccttcactccgaaggtggtgaactccaaaccattcacaaccggcgccgggcctcctccacaatcttctcggagaggtcaccaggcaacttctccacaagccgtctaggaggcggcaacctccaagagtaacaagcaatgacccggcgtggagatgatcaatcaagtgccacactagctctacaaatggaagcaatgcacttgactcttggctaattaaccctctaacacactagatggatgaacacaaagctcaagtgggtgtgagagaggtgcaaggggtgtatgcaattgaattgggtgccaagagagtccccttgctgctggaggtggagtatttatactcccaccaaccaaaactagccgttgggggcgaaatcccccaactcagtgctctgccggtttgaccggaggtatgtggctggtcagaccgtgctactctacaacggctagttttctagccgttgtagggctgtcattgggccccactgcctaagccggtcagaccgacatggggtggccggtcagaccggcctcggctcagtcagaccgccatcagctcggtctgaccgaatatggctttggcggctcgggatcggcacacccagagcatgccatcccggccatatggctggccggtcagactggcatgtacccgccggtcagaccgccactgcctggccagtcagaccgctactctctggccggtcagaccggccagggccgttggtcagaccgtcactatgtggccggtctgaccgcccctggtcaggccacagtgaggggcaaagtgtttatgtgtgtgttgggagaatgtgagcacaagtgaaaatgtaatgatctaatgtggcaattaaaatcatctcattgctaggccattaccccccttgatagtacgacgaaactataaataaactagcacaattttgatcgcccaacgcctcgatcaattcaaaatgaaaacactagtttaccgtcttctcttccttttgctttgctccgtcaattttaatccatcgataatcatccatgcgcacacatgatgtgaacctaacttaaagatatagctcaaaagaacggttagtccacaattagcgcttgtcattaattaccaaaattaacatcgggggcctagatgcttcagcgcccctccgccctcacctcctcttcctcgccatagggccgcggtagggctcgacggtggcgggcaacgctctcccctccaccggatctaggaggggaggcggtggcggcccagcgtctcggcggccccctccaccggatccagtgggaggggagcagccggtggtccggcatccctgcgacggcggtggcgattcagcggcgacggtggcaccctccctttccggcatcggtgttttcttgtgttcttgaatttatgcggactcgttttttaccatcggagaaggattgaagcaggatcgatcgcacgtgcggtgtaaaaatttattttttgacaatatacgtatatagatagatagattgaatcagactttcttttttacatgttttttgcgcccttttctcgttattatgggtgacagaaacatttttaattttttaagtagtagggataggctgtgttcggcactacctgttcccattctctcctcctcattttccacgcacacgcttttcaaactgttaaacggtgtgttttttgcaaaaagttgcttaaaaaatcatattgatctatttttgaaaaaaataggtaatacttaattaatcacgtgctaacggatcactttattttccgtgtggaggaaatgggttcccagttcgggagaacgaaggcagccatagtctttcaggattatggtcttataattgtttatgctttattcaataaaacttcacaccgtctaagtatcggttaaaaaaaaagcatcctaggcaattactgtttttctttttcaaagtagggatgtttttctttttgggtggacaagaaaaggagcaaacttacacttgtgggagcttctgctatatgttgggatctgtggttgagtaggaatgatatggttttgacaaatcaccatctatttcatatatacaggtcattttcaggcaacatattggctccggttttaggcacaactataaaggtgtgatgaagatggagagtttttagaagttgcatgtcataagtttgagatgatggttatgcaactttttaccaattatggatggagattcacaaataaactttaataaatgtgtactccatatcttacattggttatttcttatttttggttggtgttttcaatttttatttgaactacatgctttttagagtgctagattataataattggctgtacctcttctgagcaaaggccgggatgttccattccattatctaaagaaaaatagggatgttgagtagtggtgaaaacgggacgggtatttcctgagcacccacccaacccaacattcgcggaaagaatatgggaaagaaaatgatatccgttactatccgacttcgaatctgaaacctaaaagaatatgggttaggataagaaggagttatatcatctgtttatgccccatattatgaaacccaccaacaaacatggtaaaagataggttaatcactattttacgagctcacgtgtaatattgtataagtttttcattgatgtgtctctttgaacactttaattgtctccttatatttaatatctacgaattagagatacaaataaatatttattcttaatctgatttaggagaaataatatgagataaaataccagatgagtgatatgttatccgacactacccgtacacaatttcgaaattgaagaaaagtataggttatataggaatggtgtgatccgatcgaacccatccgttttcacccctttgttgtggtctgagcatatgcgtccccatcgttgttgatgaggaaattttaaagcttaaatgggtgtttggcattagctggtgattaattaggggatgggactcgaaaaggtagcttaagcttgatgttgatcaatgatcataaaacgtgcaaaagagaattgaatgtttggtttgcatcgatgtgaggtaagattgcaacctcctatcaaccttcttaaatgctcagttgagacttgagaactcatgtgctgacttttttttatataaaaaaaagcaaaaatagtattctttttctaaaagaaaagaaacctcacatgttcggatacttgtggagtcttaatgcaatttgtataaataatgggatttgctccaagcaataagtatctcggggtactggtacctcaaagaactaaattgtttcccatcgttgaaactagctgggtaggatggacattattagatccaataatcggaaataatttggtaccggtactacctcgagatactttttattggactaaagtaaatctcataaataatacaaaattcaacctgcctagaggtgcaatttgcttataaaaaagtcctgtttagttcccaaaataaaaattttcacgctgtcacatcgaatgtttggacacattcatagagtattaaatgcagaaaaaaccaattacgcagattgcgtgtaaattgtgagacgaatcttttaagcctaattgcgtcatgatttgacaatgtggtgctacagtaaacatttgctaataatagattaattaggcttaataaattcgtctcacagttttctagcagaatctgtaatttgttttgttattagactatgtttaatactttaaatgtgtgtctatatatccgatgtgataaccaaactcaaaaacttcccctaactaaacaaggccaaaatatatggaatcggagaaatcaaacatcattttacagaaaaatcaagtttccttttttcctatgttagtgacgtcataaaaatatatatgaccctagtccccactgctaggacaagatgtcatccatcccgagaaagccctggatgaaatgctcgaatgcatcgtctttctatttgtttcattaacaagaatctgatgtcccagtacatgttctgatgtacacaatcatactagctagtatactgctctccatagtcaattcaactggaaattattttttagccaataaaaagatatacatacaatttctgcctttgcaactatggatttaataaaagaaacccccaaaaaaagatttaataaaagaaactgaaatatagatagcatcttggttcatggaagtcattagagggtcactaacaggaatcaatgaatcaagattatctttgttagcactttattagagcttaaaaaaaaccaatctgatgcatgccttctgctcctatctccccacgaagaagaaagtggacataaatatgaaaataaataaataaattatgcatagaacttttatctttgtactattctcggtctaaaaccaatgctaaaaaatagactactaccagaaaaaacccacaattaactataaaattaaatttaatattcaaatttggctgtaacggataagccaacaaaaacgatcttacactgacatgtccttttgatttctcagcataaaaaaattaagttaaaatgttttttcattatctggagttctggacatgttaacttggtcataatttattgactttcctctaaagcaaggggttactggccacattccaagcgttattctagccctttaattttttttcattgaatatctatacttctttaaaaaacactagtggtggtggcaaatcactctttttacagttttaattaacccctgatattttctgatattatggaatggttcaatatttgtttcaaacaagtgaatatacttacatactcttttaaaaaaaatactattggtggtgctagtggatttgcaactgccattcactgccattaccacccccaccactgtttttctgcagtttttataaattggctcttgattttttatattatggaatagcccagtatttgtttcaaacaaatcaatatacttacattgtgttcgcgaggtggagtttggaactcggagaaaagaacttagccatatatactcatagcagaaaatggagtggataattagcgcgtgattaattaagtattagcttttttaaaaaaatagataaacatgatcatataaaattattttgtataaaccgcactgtttagcaatttgtaaagcgtgtgcgggaaaaacgagatgagtgagttgagaactcaaagaaaagaacttagctatatatatactcatagcaaagcatgggtatctcctgctccctccgtactcgtaaataaagttgtttaggacaatgtttaagtcaaaccttgggaatataaatcatgaataactcttaagttgttgagtttgaaaatgtaaaaattatatgaatagatttgtcttgaaaaatacttttataaaagtatacacatatcacttttcaataaatatttttatagaaataagaagtcaaagttgtgttttggagaccgtgttgctgtccaaaacgacttcctttacaagtacggagggagtagtttccaaaaatggaataatcaactatttaccacttttacgagtagtgataaaggatttgccactgaacccacatattatagacacataagggtccacgtgttatagatacatgagaacccacatgtcatagacagtgagtggcaatccttaattgccacatcttcgaagtgataaaatagttaaatgtccctaaaaaaatagagacagcatgaatcaacgggtgagtaacacacagagccaaccaagccagatctgttttaccaaaacttttgtaactgactccagcatgtaaaagttcttttctcggaaatcagcatgtataagttcagcttgattcaaaaataaaacaaaacaaaaaggtatgcagaatggactccacggagatacctaatacttaggatacagcttcaagctttaataaagttgatcgaatttatgcttctcctacagctaaatcccctaaccgagaatatttagatagaaaaaagataccaaagtgaactaagggtgtgttcgctacagccggctcccaacgtgtacagtacacatgaaaaacggagcggttcattagcacgtgattaattaagtatttattatttttttaaaaaaaaatagatcaatatgattttttaagtaacttccgtagaaactttttgcaaaaaaaacacaccgtttaacgatttgaaaagcgtgcgcgcgaaaaataaggatagagagttggtaaccagctcttgcaaaccgagcctatgtcggcaatatgggtgcctcccttccggcagcagaagaatatatatatcccctcatggacatgcccacaggattttcgataaacaattgaaaagactgcaacaggaaatcgtcatcgatatatatgggcaatcccaatcctccacctagaatgatgtctatgacattaactacattgccatgtatgacttttaacttatgtggcactatattaattaagagagagagtgaagagaagaagaaactgggtctcatacaagacacagcttcaacatgaaaacctatgcactagacactatcaagttttgcattgtgagagaatattgtcttcataatagatgaagaataaatatgattggtagagaagagagatgatgtatttattaatggcccactttaaaaaaccataggttgtaaagtatagtttctattgtgatgtcttattgacatggcaccatagacattgcttatggacattatgggttgggactgccctaagcccctctatatttagtttataagccgctgtgaaatttaaaatttaattttgaagttgatttggtgttttcatcatattttattttccataatttgctcttacatatcgaagaacccatataaaaattttacccataaattattttttatcgctttataagtcataacaagctttattattaggcgaaacgatgtggatgaaactttttgtttattgtttatcatcaagataaatggctatacatggtgggccaaattataggaaatttgtcatatatgtataacggaatcgggttctatgcattaaagaacaaaatgtagagaatctacagtacatgcattcggatatgttcttttacttatgctgtttgatccacattcaatgggaaaggataaagatacagtatctccaaactttacgaaaaataaagcaaattctctagtggtgttcgtttctattaaagataaaattaggacacgaaaaaaattagaaaaccattagcgtataactaattgagcttgaaaaatgaatgtatatgatattttaaagcaacttctacataaaaaatttccgtacaaaatacaccgtttaacagtttgaaaaacatgctgatgaaaaccgatataaaatatgtatcttaatcaggcctttgtacaagtagcattgttgctatacactgttcaatcaatgattctctgcattgcaatttgcaatagaggatatatttccatgcatagtgggagtaccagtcactcgtccactcctatagttctatttgggccatatggcctagattatctgaggctcaacccagccccaagcaagagaacagtgtaacattagtggaactggacaaagagagctagacaaacacaagaggaccacatgttcaatcctaaggaactagaatattttttttgtctgaaatctgagtgagaagataactattgctggatctgtaagagacatggcaatcctactttcctactatgagagcaaagtcatgatcattgataatgtcttttttttccaataaacaacacgagttcttcctagtttgacttatatccacaataatagttttccttttttttgagaaacaattatgattttcaattggttaatgaatataatgatttataagctctaactcctctcaaagagatgaggcttatgatctcatcttaccgaccgtgaccccaggcagccgtccggactccttttaatgtttttgataaatttgagatgaaattttaaaagcaaacacttgatataataaagatttgcataggatctgaaacttttctgtatccaataagtcaacaggacctttcctgacaacccttgcccccctcctcttgccaaccgtctctgtcccctatattgaaactgcagatatgaatttgcaatttgtttcacaaacaactttcagtcatctaaaatgtgccagaattcggtaaattccatcacgaaaacgactagcaagtctatcaaatgcaccgtacacgcaaccgtatgtcctagaaaaaagacaaatatcaattaacacatgcaacaaatgttttccttttctttctgttttctattgatgtcagcctcatcaacaatacaattatacaaacggtttgagacttgtcaccctggacaattccagcccatacattttcacctcacaagaaacttgaaacttgtcagagttggctttgttctgattgacagtagatttgtttgctattgagatatttctttaccttgatttttcttggaaatcaattgtattgcagtgagaagactaagcgcattttcagtggttaattacttaattcgtgatggcaatgtgttcctgtgctagttgacagcagggagttctttcagattcagtgcatagttaggcatggtacgaaaacttgagtaaacccaaatattttttctagggtgaaagttcattttcgcaaactgaagcgcagataacatgaaaaacaccaacttgttcagttattgttaccagttcaccaatcaaaaacaactcatcttcagtaaagtagcttctccatcattaatgaacctattttgacttcaggcacaagtcaaacaattgttattttccttaactatcatcttaataaatctataattccatcctcatcatctatatgtgctaaggtctaagaacccaattatttacatctagtgtacacgtagtaaacacatagctaaggtgattgcagcatatatgaaggccactagggagtagggtgccatatcaaattaagttgctacttgctacaatggcaactttaattgtacttgaccatacacattgtaataattaattggttgatcaaaagccctcatagtagccaccaaacgatatgtttgccctagttgagccaccccctcccatcacagatgacattgcctggttcagccttgatgtctgctgcacaacctgctgcattctctgcagatcaacaaatcaaaccatgattcaggcaaagttctcatggataagattgagtagctaattttgttcagttgtacattgaatgaaaaaacatggtgtcagtaaccaattttcttttactagaacgtaaacgatatgatggttttagattctgtatttgtatcagcccataataacatcgtgccaaaatcattaagatttcttcttgtgcttctagtagaaacttcatattagaaaggctcaagctgcatctgaattaattaattaatttaggtatacatatgcacaacagcacaagtaagctactagcaagattcaccaaaccaatccagagccaaaaaccaagaaatcaatgttttttcttggttttgacgaaaattgtttgaaaaccattgactaccgataaaattttatcaaaaattaaaattatagtttgaatattttctaacttgaccaacaagctaaacggtttgtattcttgagctggtccgagaagatcggttttcatcggttttgtaaaatctggctactaatcgcatagttatagaaggattaggatgtttaggatgttctaccttcaaagtcacgtcacatatcagtgacaaagtcacggtgacttcgaaagtaaggatgagtgatcgccattttggatgattctactaaattatatgagaaaaaaaagtaatcttccatagacaaaagaaaatgattgatgatggatttggtagaaagtagaaacataggactggaaatgagtcaccaaattaaccttgtcatcgccatagagctgaagctggatcttgtgctgctgctgctgccggtggtggtgctgcagcctgccgccgacgaggaagacgcagacggtggcggcggcggcgacgccgaacgagcacagcgccccgatcccgttcacccgcagcttccccaccctgaacaccacgcactccgcccccgccttcttcccctcctcctcctcctcctcctcctcctcgccgccgccgtcgtcgtcgccgtcgaccaccttggcatcggagccctggaacgcctcctcctcctcctcctctgttaccttggccgccatggtctcttcttggctcgtcttggtctcggccggcacggccacgtcgacgccgatgtccttgcactcgtcgtcgacggccatgtcggcggcggcggcgtcaagattcgattcctcggtttcttgagctgtcatccaatcgatcaccgcaacaagaatgagacgcaatctttcgtgacaaatcccaagagctgatgctgatcttaccaccaagaactctgcggccatggccgccgccgccatgggaggatgagctcagctggtcaggcaggacctcccagtcccacatgtccatgctcgccgccgcatccatggaaaccgaagcacctcccttctccatcttggcaaataacaaccaaaagatcgatcttttatataacaaacagcagtgatcaatgaaaaagattcttgctttggggcctctccaatggatgctccccaagcatcaattttggttgctgcttttcaaggctccaagtgatcttttttttcctcaatttttttctcctttcttattatttgcagggaagcaaagggagaaagaaagcaatatatgaaggggaagagaagaggtgtagagactagagagatatcagtgtcaccacaaagccttgaagccagtcctttgcaaagagctttgtgtgtgggcttgtcctaccttgctaggtgacaaagtggggtgaaaatggtgattggggcctaccaccacttgggacttcttcctcctcactcatcaatcactagttggcacttgggatgtctctgaacaattgtagcaaacatgccaaggattattcagagcaacccataataggaaaaaggagcaagccatgcaaggtgtgaagaaacaaaactagtggagaatatctaaggcttgttgatcaatccatctcttttttgttggttcttaataaatatttttagttatcctgcataaatggtactacaatccagtgccttcactgagtatatattcaattcagatcaaagttaacttgagaatttatcccttggtagctccgaagaattatattgttcacttaacatgccatatgtcctaaagagcttctaagtctatccatttcagttgtgatagaaaaattgagaacattcctgaaatgttgatcactatcagatgccgacctctttgaatattgaatatatgtaattttattaaacaagttgtggtttgcaggacggtttatagacaggttcaacgttacgatactgtacatcatcagcaaaggagttgtaacaaggaataaaatgtacaaaattcaggaactttaatggaagaagagtacacaacagggtgccaggatagggggccatgataatgagagacaagataagaaccttctgtagaaaaccacatcaaaagttaagatgtaacacacaagatagtgatggtctgatggataatcatgcaggagttgaaccataaactaaacaatttcaaatggggagatggtgatttgaaacaaacttatattcagagtaaactgttaaagttcagctcacaggccaaagaaagggtattcaatttcaacattaatttattttttgcattgttgttccatccattctagatagtagcctaggcttctttgttttacattgtagttccatcaaggttcttgggtcaagttgtactttattgttgtggactaattcaggttagtgtcaagaaacttttgcctaaggcctagtgttttcttcttcaacgaatggaaaagctcctacttttcttttttaaaaaaaaagaaaaggaaaggaaaactatcatgaatcatgtcacctatggttagaagtagttgtgcagctatcagcaccgtagactttactagaaaaacgaaaagaaagagaagagattggatctcagtaaactaagcatataatgggtacatgaagtgttttttttatttctacatggtgaaatttatgtaaatttttttgtttaaaaggaaacctaatctgttgagtggaatttaatatttaaaattttctgggcttagctgcagattataatccaaagtagttgtgaattttaaagtttgattttctataatacttttaggtagatttgtattgcctatgtatataaatatatgatattattaattttattcggtctttatgtgtaacttcgaccactattttttattataatgcaatgataatatagaaacaaacatatattattaaaaatacttataaaaaatattcccatataaatctttatattttcaaaataaatatgttgaaagctagtcaaagttttaaaagtttggttgaataaagtcaataatgtcatatatttaaatacatcttcttcttagagatcataaaaagcccttaaaagcattaatcctaaaatgaagtgacattctaaaatttaaatcagcttcgaattataactcaaagctccgccaagtagattctcgaaccttacgagtgtgtttgagaggagaaagaaaagaaaaagattgagaagatacacaaaatgaggtgagccattagtgtatgattaattaagttttaattatttcaaatttagaaaatgggttgatatgattcttttaaaagcaactttcttgaagaatttttctttaaaaaaatacaccgtttagcagtttaagaagtgtacgtatggaaacgagggctttctctctttctacggttcaaatgaatgcttcgcagtataatatttgaatcctataaaattcctaaaaaaaatccttccattcaaatggcgcaagagttgtgcaagaagttggtttgagatgaaatttagcgccagacgcggcccatttgggcaccaccgcttctcggcccggcccagcagcggttgatttgggccgagaccaacccaccaccacccgcggagtaggcgacggcggcgaagcccacggcggaagcttctggaaggttccccgccccctcacgcatctctcccctcccttccgacgccgcattctagggtttagctgggttttctccgctgtggcgctgtggctgggcaggcgatgggggctctcgaatcgtattctttttgaattgattgatcccctagttactatcctagttccgtttagattggaggagttgagatcaagatctggattagccctagagttggtaacgaagctcaccatgattgttcaggtttatcggggttagtattgtattattagtttctgtcgtcaagatggagttctttggctgccatctatttgttgatgcatgtgttcttgttaatcattatcttaaaaaacaaatgtattcttgttgatgattgacaggttagtatgtccacagggacattgacaatggatagaggaggggcagcaaaacgagaggcgtcatgcggaacaatctagaagtggtaaactacctccacaacatcttgtagtgctcctgcatttgatcttagagtaaaaaacatcttgttcgcattctgttattaatggggattagaacaggggcagaacaagaaaataggccaagcctagggatgtggaaatgtgtctttagctaaccattttttatgccttcaaagttttcatagtatttttgatggaatctcaaagggttatagtcttacagagatcaacctatggctcaaatcctccacgcactgagtcaggaataggataactatgaaagtgagcacagtaataacttgttgactgctaattttgatggcattggttttcttctagctttagtttgctaactacaattacttgtttccatcatatattaacaattattcccaatactaaattatacggatcttaaactacacatagtaatgatattgtagaggattgcaaattagatccacagcctgctttggaatttatcttttcagtttttgagaaagaactaaagcttgtctccaagttattcacttgttagtatctgaaatttccgatgacaaacagaaactttcgatattttcagtttttccgtggtcacataaatactttgtcatgtgctttgcatcagtcaacacaaatattaaccttccaaactacaatatcatgaaaaattgtgtgctactggtgcagtaggaagctacactacaaggttgtcacggtatgaagatttctcataaataatttgaaatctctgaaaagaatccaccacaagattttactgtattgaattttgcatacatagggaactagggatgtttccgttcaaaaaaaaaaaaactagggatgataaacctctatggcacattggcacctatactgctttgcatctgccatacgtgttaaaaaatgctaaatatgtagcctgacagatcaaaatcaaaaggaaaaaaaaaacttaaaacacatgaaaagcccttcatctaatcagaagatacatccgtcacattactctgcttgctggccatcgttcctcatacgttttgtatggaattggctcatagagcagaagatggactcaaaaaggaggaatcttggtatggggatgtctagttttgtttgtctaatacattaatacttgcaggacagttgacaaatagggggcagatcccacaaggagtcgcacagatcattacccatatcaaaggtttcctgctcctggatgccattcataccatgggagccttgcttctctgccttcatcttatcctggtctgaggccactgggcaagcattgctgcctgacatgtcgcatccatccccaatcggtagtaggctggtgttgagtgcccatgactgatcatattgttgttgtgaagaagccagctgcaattcttcacctccactcatagcaaaattagagaggtttgtagcaaaattaaggcttgagctgttgcttctgctggggctgacaccactggtgcttgtgctggttgcagcagcagggacagtgctacgagcatggtgatatactgcggtgctgaaggtgatggtaggctggggcatgctcttcttgagcttcttgtgggtgaggatggtgcggatcctcgacgcgagcggcgagtctggtgcagcctgcgttgcgaagttggtgcgcgtgtttgagccccggaggaggcatgcggcctcgtcgtaggcccgcgcagcctcctcggcggtctcgaacgtgccgagccacatccgtatcttctgggtggtgtccttgatctctgccacccacctccctgagggcctctgcctgacgcccacgaacttactgctgctgcacttggttttcgctttgttcttggccactgtcacggttggcacttggtaatggcattgctgctgctgggattgcccttgtgttggcttctggaactggagctccatggagaagagagggaagctaagagagtgcaatgtctgtttgccagtttgtgtgttttccagctgtggtctgaactttgagggaggtgctggagtctgaatttaaggggggggggggggggaagaaagggaggttgagatgttgggttagtgggagacttgtcatgttgtgcctgtctctactgttgaaaatccttgtggtgagttcaagaggtgactgagttttctatgaggcataggagcataatgctgcattctgtagtttgtttcaatgttttctgatgtggtcttagtggctggcatgtttgttctttaccctgcaggttgacaaaagccacctttgtttcaggctgtgcgataagatcgacatatctgatgcttctgtttaggttttactgaaccatgggctgcaatccctcccttattgttgatattacagttaactccaaactgttggccttgaaaagcttggaatccttaacagttcactaagcatagaagtttatcttcaatattattaaaacatcttttgttgctatgttttcagttcctactcccatcataaaaccgccttatgatgtttgaaaatttttaagagttctctaagcaaataattcaatggattgctttaggctaaaatgctgtgcagtcctttagattagtttagattcacctactaaatgtttgcaaggctatataatgatatggaaattgcttttgcaggcgtctgacacttgctgcttccaaggaattggtatgagaggatccacatggttctgacattgtataggtagcaattgccatccaagtacatttcatattttcctaagtagtggtcttcaattgaaaattgcaaacgattctctctctccggcacagcattgttttaaacatttgccgtgtgttctattcaaatgacgaaattctagtttatttgttttgtccataactgcccaactgcctgtttaatttgcagatattttacatggcacaccatcactcctaccaaagggaactaagcaagtcgtgaggacacgattttttttgccatttggcagcacctgtgggtttaattgcttcatggcttcatgttaggtgacaagattagagaagatgttggcattctacgagaggagattaaagaatgaagctgtgtgattagcatataatctaatgccatggccgggtgcagaatgttttattttatcaatcagatgtgccaagatcaggtagtgcattatttacctgatgaaatatttcgagtttatttcgctacgtttgactcaggttgttcaagtttcaagatatatactatctttgcttggttaaaattattgatatatttttctgtaaagtggtaaccaaagtttggatggattttgaactattattttagttgtttacttcgttggcggtttggcactgaatatggttcttcccttcaaaagaaaagaaaaataaagaatatgtactatggttctgatactgtaaaatcacagaaattccacgagtactccaattttgtttcatttcaccacattttaatttcatgatcagagactttggttggcaagtcaactgtagatgtggcagcaggttgcttgtgcctcgaatgcaaagattatccttagctccttgaactaacaaattgcgtagaaaatagaatgaaatacctgcgttgagaaatgcagaggtcaaagttaatggaagagcatcacctcacaatagaaaaggaaaaaaaaagatgaaccgtaagaagagtatataagtataaaatgaagagaaaatctcacatgataatacagaatcatcatatgaataattaaatacacatcacggcctggaaaattaaatgtcttgagaaacatgtcggacttcttttgtgtgaagtggagatcatggtttaggtgtacttctcagatgttcaactttatttttttatcaatacaataaatgttttttttggtcaatgcccacgtatttttgtcgagtgattgtgtccttgcacaccaaatgtcaagttgtgacattggtcatagaaaggcctaatgtggtactatgtattatatgctctattgcaaatactttcttccagagtcttgtctaaaatataggccaagtttctccttcacctcatctaaacatattttctataccaagaaacctgagagaaagttgaccatgataacttcagaacttcagcttattttaggcatttttggccaaccagaatgtagggccggcttgcaatttgtgctatgtgagggtccagtaccaccatactgatggtgttgatggcaacaaaatgtgcaaatatcaattaaccatattatgatattacaaaaacgacacaattgacctctcgttttgcgatgaaccactgagaatagcttgttttcaaacaataaaaaaaaaaagctttaaccaacaaataacgcagtagaagcaacaaaccgtatatgcacaagcgccatataatgatttacatggaaaaatctgttggaaatatagtcataatttgacatattttaatccagaaatataacataataaacatgacatatacaatagagagtgatcctagcatgatggtaaacatgaatatgctaacataaacaatagcatctaaaaacatgtttaacaccgagatgagaagaaaatacctggagaatgctccggatgataagttattggtgttgttgttgcctctgttgccgttgtcattctctcttccgttaccgttgttcctgtctcatcctccctagattggattgctgctctccttcctcgttactctagtaacagacagtgacaagcccatctgagaggattgctgctctccttcctcgtctctatcttcttcttcgcgcacgggtactcggcctttctgttcatcctccccagactggattgctgctctcctttctcgttactctagtgacagacggtgacaagcccttacgagaggattgttgctctccttcctcgttactctagtaacagacggtgacagaacttcgtccatccttctgttcatcctccctgaactctctgtcttcttcctcacgcctgggtaggcgagcgatcaagtttttgggaccacattctatcgcgctattgctctcagcctctccttcctcattactctagtaacagatggtgacaagcccttttgagaggattgttgctctccttcattattctagtaacagatggtgacagaacttcgtccatccttctgttcatcctccccgaactctctgtcttcttcctcgcacacaggtaggcgggcggtcaagtttttgggagcacattctattgcgctattgctctcggcaactctcgggactgcttcatccatgtcgctctgcttcctctacggcaatgtcaaccagtcccgggaacggtgacaacagaggagacaggaacgactggagagaacaacaaagacaacggaagcaacaacaacaccaataccttatcattcggagcattctccccccgaactctctatcttcttccttgcgcacgggtactcgggacgagcatgcctccggaacttcgtccatccttctattcatcctccccaaattctttgtcttcttcctcgcgcatgggtaggcgggtgttcaagtttttgggagtgcattctatcgcgcgattgctctcggcaactctaggcactgctttgctgctctccttcctcattactctagtaacatgctgctctccttcctcgttactctagtaacagacggtgacagaacttcgtccattgttctgttcatcctccccgaactctatgttttcttcctcgcgcacgggtaggtgtgcgatcaagtttttgggagcacattctatcgcactattgctctcggcaactctcggcactgcttcatccatgtcactctgcttcctctacgacaatgtcaaccagtcccgggaacggtgacaacagaggagaccggaacgactggagagaacgacaaagacaacggaggcaacaacaacaccaataccttatcattcggagcatactccccccgaactctctattttcttcctcgcgcacgggtactcgggatgagcatgcctccgaaacttcgtccatccttctattcatcctccccaaattctttgtcttcttcctcgcgcatgggtaggcgggcgttcaagttttagggagtgcattctatcgcgcgattgctctcgacaactctaggcactgcttcatccacgtcaagctttgcttcctttacggcaatatcaaccagtaccgggaatgacaacaacggaagagacggcaatgtcaacctgtaacactagagtaacgaggaaggagagcagcaatctaatctagggaaaatgaacaaaaagggcgagtacccgtgcgcgaacaagaagatagagacgaggaaggagagcagcaatcctctcaagtcctctcagaagggcttgtcattgtctgttactagagtaacgaggaaggagagcagcaatccagtctggggaggatgaacaaggatgaacagaaaggccgaatacccatgcgcgaagaagatatagacgaggaaggtgagcgaagtagaagatagagacgaggaagagcagtgctcgtcccgagtaccgtgcacgaagaagaagatagagttcggggatagaagatagagaactctgttactagagtaatgaggaagagtagcaatccagtcgcttgtcaccgtctgttactagagtaacgaggaagagcaatccagactggggcgtctgatactagagtaacgaggaagagcacctctcagaagggcttgtcaccgtctattactagagtaacgaggaagagcagtgctcatcccgagtacccgtgcacgaagaagaagatagagttcggggatagaagatagagtactctgttactagagtaacgaggaagagcagcaatgaggaaggagagcagcaatccagtctggggaggatgaacaaggatgaacagaaaggccgaatacccatgcgcgaagaagatatagacaaggaaggtgagcgaagtagaagatagagacgaggaagagcagtgctcgtcccgagtaccgtgcacgaagaagaagatagagttcgactagaataatgaggaagagcagcaatccagtcgcttgtcaccgtctggggaggatgaacaaggatgaacagaaaggccgaatacccatgcgcgaagaagatatagacaaggaaggtgagcgaagtagaagatagagacgaggaagagcagtgctcgtcccgagtaccgtgcacgaagaagaagatagagttcggctagaataatgaggaagagcagcaatccagtcgcttgtcatcgtctgttactagagtaacgaggaagagcaatccagcaatccagtcgcttgtcttttactagagtaacgaggaagagcaatccagtcgatagagttcggggagcgcgtacccgtgcacgaaaatttagagtaatgaggaattaaccgctcaacaggtgctctcgattagcagcctatttaaatcgaggtccctctacgttggattccaaggtggtattaatcacttaacattaattatgggctcataaaatttactaagatttgattgggcctagcccatttagttttagcaaaaactccttgatgagaggagtaagaaacacggaaccaactagtatgctccaagcctccaagcttccacgtaccatttacaaacaatggttgcaccacaactgcagcaacaccattaagatataatcttggtatcgtcaatatcaataacaaataaaaacaagaagcttaccaccaggcaaacaatgcaatttatacccccttagtatctcacaaaccattgtttggaacatgaaacatggcaaaaatgtggatttacaagttcaaatacccgtttgacacttcagactaactttttactaaaattgttatcatccaaaccgacaaaactcttctcaagtttagtgctatactaaaccgatcctcaaacaaacctttttcttttttggcaattttcttggtaccatcacaaaaataatggagttgggaaataccatcatacatatcaatgacatgcaggtcccgggccacacatgtcattttcaaatgtgatggtattttgcaactcgtgtatctccacaatggtattttacaatgttttctcttttttaaagatagtgatcctcaaaccaaataaccaaatcaaaataatctaaatataaaatgagcttgccgaatttagtacacatcgaaattttaacctataaacattggcctgatgaagacaatgttagaaccacttatttggacaaagtaacgaactactcctatttcttctattttctagtcatttttcactcaaaggttgctctttttttctctcaggaatacttaggtcttttccctgcaaaacagcaaaagggtaaagctagtcagtctttggaacacaagaatatttacaggatttttacatgagttagtctaattcccacaaaaattctttgaaattcctccattccaatttccaaatgatttaggacatgggactagctaaacttgcttcgttcatggttgttcgggccaagggatcttcctgaacaggtgcaagaagatcctctagttcggctaatatatctgagaaagcaggtcggttggatggaatgccatcccaacatctccgcatcaagtctaatacttcctccgtttcatattataagactttctagcattgcccacattcatatactcccttcatcccataatataagttttagagttggacacggttattaagaaagtagatagaagtaaatggtggagggttgtgattgaatgagtagtggaggtaggtgggaaaataaatggtggagggttgtgattgggtgggaagagaatgttggtggataagttgttatatttgggacaaatcctgagggctaaaagttgttatattttaggacggagggagtatatgttaatgaatctagacatatatgtgtgcctagattcattaacatctatatgaatgtgggcaatactagaaagtcttataacctgaaacggaggtaatagctgggaatgtgcattttctgggagccctgggcgcaatcccttgtatacctgtaaaatgtcatgcttagtgcatttcacaatgtgcgtattatggtacaactgtaacaagtaataactgacagcatattatttgaatagaagaaacctgcatatactacacacttacagctgcttggagaggggtcatggtattataagggatctgaaaataccagaaacgaaaatttgacaagccttagcaaacactaataaatgcacaatgtagataattgtgagcctatagtcacagaaaatagtgtaccttggacgttatgagctcccaaagcacaatagcaaaactgaacacatcagctttgttatcgtagggttgatgatttatgacctagcaacaccgcatcaaatatatatttaccaggaatataatattcttgtacctttactagacaataaaaactaggtaactatagaatgtccatgcaaactatagaacattcagatcattgaaataaagaaaaagtattgtctagcaccttgaaccttaagacaaagcatctaaaaccctgagctttacaatacgttcatataacctcctaaagtggtttttgtctaagtggaacacattggatgggtttgcccatgtcgcgtaaatgctgtaacatacagatcaaaatctccacttaccatctcctattggacaaaaccgtttgttcaagtttccgtataggcaaaaccaccatacaaaacaactttaggggagggggcagttgtttaaagatggtattgcaaagtttgggggttacatactaacctttaaaattcaagggctagttggacttccattaaaagcttaaggggggaaagggattggaggaggaggaggggggggggtatgcctatagggaaatttccttgaaacaacaaacaaatctgaactattcactttagcggtagaatatattattgtgataaccgtcaatcaagttttcttttcgagacttcaaaaacagtaacaatattaggcacatttgaaacagaatcactttgctccagcaacagagttgtatctctggtgccatccatctgtatgttccagtttcagctgtcatgttacctccttgatcctgaaaatgagctacaccaaaatctgccactttcacaacctagaaaaataataatgaagttatttattagttcatagatattttctcttaagtgcaaagcagatggctcctgcacatacaaaaacacaaatgaagcatgattgtattccaacaggtaccatttgcccacttgcatacactatactttcttgtctttttttccccctcatatgttcatcaataaaatgttgaagattataggctacgtacatgatctttgtccattagaaggtttgcactctttaaatctctatggataatacccatctgatgcaagtaacacatccctctgcatagatcaactgcaaacttcagcagagttggaaggtccaagacattatgctgcttgtgcaaaaagtcatataggcttcctccagacatgtattctgaaatatataaaagtagatgatgagcattagtaggaatcttccagtccccaagatataaattaagaacccgctctttgtctcataacaagcataattatatggaattaaaaattagcatcttaccaatattatgaaatttagtattgtgtaaaaattattcagcacatgctttcttttaggaacaaactattctttgcaaattccccagtgagaaccagttgatgtcataaatcttaccagcaattatgcaaaattgtggtggttttgtgcacgcaccaatgaatcgcacaacattagtatgctgaatcaaggcaaggcataaatatttagttattggtacttgcatgaacatggcaatttcagacattcttattctaagaacagtaatgcgctaatggctaagaattggatatgcttaaacaatttatttgcgatggtaaatgctaaaaaagaattacttcctccgtttcatattataagacgttctagcattgtctacattcatatatatgttacatacatatatatgaa

SEQ ID NO: 79330 - DNA, 13696 bp, Oryza sativa
ggcccatcgaacccgggggaggcaaaatagacttttgcggaggcattgatttgggaaggatttgaattcgggattgaactggacgatagatcggggattgagatccgagatggcacggacactagacaatcaaacaaagaaacaaatttcgcaattagggtttttaagagataattttcccgctaggcgccacgacggaacgggcgctacagaccaacccccctaacaagaatctcgaccccgagatttagcacctaagggagcagctccgggaactcggcacggagaagatcttctcgctcccaggttgcctcatcttcagaatggttgctccattggaccttgtagaacttgatggtcttccttcgtgtctgacgttctgcctcttcaagaaccttgatcggtctttccttgtaggttagattcttttccagctcgatattacccaggggaacttgttcttctggaactcgaagacatttctttaactgggatacgtggaacacgttgtgcacatctgcgagaccttcaggtaactcaagctgataagccacttcgccacgtctggcggttatgaggtaggggccgatgtagcggggtgctaacttgccggacattccaaacctcctcataccacggaggggcgatacccgcaggtacacatgatctcctttttcgaactcaaggtcatgcctccgattgtcagcgtaattcttctgacggttctgcgctgtctttaaacgttctcggattagcttaacttgttcttctgctgccttgagtatgtcaggaccgaataccagtgcttcgcccacctcattccagcacaagggagtgcggcactttcttccgaacattgcctcattcggcaacatctggatgctggcctgataactgttattgtatgagaactcagcatacggcaaacaacgatcccaagtgccttcgaaatccagtgcacacgcacgtagcatgtcttctaggatttggtttaccctttctgtctaaccatcggtctgcggatggtaggccgtactaaaatttagatcggttccgagggcttcatgcaactgcttccagaaccttgaggtgaactgagtgcctcggtctgacacaatcttcttgggacagccaaatctacatacgacatgggtcatgtagagttctgctagtttctttctatcaaaggtggtttttactggcacgaaatgagctgatttcgtgagtcggtccacgattacccagatggagtcgtacccgctaggggttcttggcgaaccggtgatgaaatccattccgatctcttcccatttccactcgggaatcggtaggggttgcaacagaccagctggcctctgatgttctgccttgactctttggcaaatgtcacacagggctacgtattctgcgacatctcgcttcattccagcccaccagaagtatgccttgatatcttggtacatcttcgtacttcctggatgaatggagtaggctgactcatgagcttcctttagcatgagatctcttaattccttcttggccggtacacagatgcgtggaccgcaccaaactgtgccttgatcgtctatggagaaattggtgtctttcttctcttgtattctttttattaactcttttatcccttcgtcgtctttctgagcctcccggatttgcgattctagggtgggctgcactgtcaagctggcagggacacctgactgtaccacggtcagccttaacttctccaattctctgcacaggcgatcttggccaggccgtatttgagctacattgcaataggccttgcgacttagcgcatcagcgaccacattagctttaccggggtgataatgaattccaagatcgtaatccttaattagttccaaccatcttctctgcctcatatttaactcgatctgagtgaagatgtacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcttttctgatatctggcaaggtgagaactggggcagtggtcaaccttttcttcatttcttgaaagctgtcttcacaggctacagaccattgaaatttcttttccttctttaacagctcggtcataggtctggctagcttagagaatccttcaatgaatcttcgataatatccagctaggccaaggaagctgcgaatctctgacacattcttgggcgggttccaagcaagtacagcttcaaccttgctgggatctacttcgacaccgttggaggagatcacgtgtccaagaaatgctactcggtctaaccaaaattcgcatttcgagaattttgcgaatagttgatgatctctgagcttttccattatcagcctcaggtgttcaacatgttcttccttattcttggagtatatcaggatgtcatcgatgaacaccacgacaaactggtccaggaattccatgaagattttgttcattaagttcatgaagaacgctggagcattggtgagtccgaaggacatcactgtgaactcatatagaccataacgcgttgagaaagcggtcttcgggatatcttcagatctgattttcagttggtggtaacctgatctcaagtcaattttagagaaaactcttgctcctttaagttgatcgaacaaatcgtcaatccgtggcaacgggtacttgttctttatagttacttcattcagggctctatagtcgattaccattctctcatagccatcctttttcttaaccagaagcactggggctccccaaggggatgagctaggtcgcacataacctttactctccaattcttcgatttgtcttttaacttctgctaactcattagctgccattcggtagggtctttttgtaattggtgcggtgcctggtgccagttctatggcgaactcaatctctcggtctggtggcatactcgttcttgtcgttagaaattctattgatgctaattaaactactgtcttgttttttcttgttctggtttacagaagctgatgaaggctggtggtctgtttgttgcatccatcttcgtgatgcgcaactttggtgacctgatggccatctaaagaggagctgatgcgacagtaacgtggatccaccagagctgtgtgtcttgttagctgttagttttcacttttatgtcagcaacgcaaccagacttgttcttaggatcatgaattacaaactgctcactcgagaattgagatagttttcatgatataatggaagccagagtgctactggttttgtgaatcagcaggcgaatctgcgaaaactcaattgggatatcctttagttgagactggccaagttctctacactccaatccatgatgtagtgcattgtactagttgttgcattgtgttgatgacttgctgtgaaatctttatctcactgatatcgattatgcatgttattctttcgtggaagacttcctttttttttatacgaggtatcatggaaaagaatttttgcaaaaaaaaaaaaaaacttctactggtgagggaaccgacctcttctggctgagttcgcttgctgaggttctcaacctttaactctctcaaaactcaataggtcggccaaatcactcaccgatttggcttgttgattttttttaatttttttataattttctaagtgatatataaacaacgataggatatcaccttaagacacatcatgtaggagactcatcgcctcgatcacacacatatactgacatagtacatcgtactatacgtacttatttaagctaacatccaggccagctggtacatgcagagttttcagatcacatataggctgtgtttagttgccggcgtcctccgatccgttacttgaaagcgccaacgtcttcctcgtctcccttccggctggccctgaagtactccttcgggttaccctcgaacttgtcgcgggagatcatcaccttgccgtcaaagcccggcgccttcattgtccgggtcgtcggcggatcatcatctgccgtcttgtccgggtctccactgctctccccaatcgccgacagcaggaacaaggtgccggcggcggcggcggcgatgaaggcggtgacgccgaggatgcggcggcgggtcgaaggcttgtccgtcttctccttctcctttacctcgttcctcttcatctcgcggcaagagagagagagagacagagagagagtgggggggggggacagtgggtaactggctacggagattggagaggcctcagagcatcagggcagcttttgtagtgagctcgcgatgggacccacatggccacagccatcatcactactccatctgtcatgcactcttccgtagtctttaagtaaagagggatcttaatctttaaaaattagtgtagagagattttaccgtaccggaggaagtacatgtaaatactaatgggctcatcttttggtttatacttatatttatcagctaaaatttaaatttttaaccttaaatttggagctgattttgaggtttttttatcgaagtttattttttagtttttatttttagatcgctaagaacatgtatataaaagttttaaccacaaattactttccgtttgcaaatatgccgtttcgcttattccgcgaataagcgaaatgatggctccgtaaaattttgatatctcgagatatctaatatttgtaggtatcaaattttataatagaaaatatcgtattgcctgatattttcttaagaatgataaaattactgcatcgctcacatttcaagaaaattttacttggaaaagaataaagttaaagtgtcccatactattacttttataaagaaagtaaataagaggataaagataaacttactttagaacaacctttagaattactaacttatttcagggtgtcgggatgggaattcttttagaaataatactcccccatccatctgagttgctcgtattattttttgcattatgaccaaaaagagcactaacttctctatgattcatttaatctcacttgtgatttcagccaatcgatctcttttttacaagtttttattaaaataatattatttctaaaaacttttctggggaaggagatggaaggccaaagggttaaaggtgaaagcttttagtctttcgctggacccagcttgactcctctctccactatgtggtttcttcgtggaagatgaaaaagcttttcgtacgtggctgactcagctagactcctctccacgatgacccattagactgtgttcttgagggcaagttttataataaaggtgatggccgcctttaattttatccacgtcatttatccataaaattaaaactaacttatataaatgcattgcatttaatacactagtcccaatacacttaccactaacaccattctcaacccaatgactaggatagtatccatagcattaaataagctgccacctaggatgaaaaatgatatgacaagtgaataaataagaaaagagaaaaaaatcatggtttttacacaacatttaagacatcatgtgagataagtagcattaaatctaagtatggaatagtgatgtttgcattggaagagtagtgtctagtattagtttcttgatgatgtggagtttgtgaaaactatgtatagtgttttgggttaggaatgtcctaatcaacccctttctttttctcttgtttcttaaagtttgtgtggaggttgccccttatacgagagcaaggtcaatagtgcagctagtggcaagctccaaaattttatcatgtcaaggtaggtagaggtggctccttctttctctcttttctcttctcttctctcctctcctccacatcatcatttaagtatacatgacactttggagtttgtgcttaaaaccttatagtacgttggaaactaactcccccaacacgcaaaacataacgataaattaacgcgtaatttattaattattagttaaaaaacttgaaaaataaattaatatgattttaagtaatttttttaatattttttaaatcaaatcatttaatagtttgagaagcgtgtgtatgaaaaatgagagaacacaaaagccttcttcctaatagccaactaatgccgcatcaataaaatgcagaaaatagtcgctttgtgcaatttctttcgaaagagccgatactaggactgatcaatcctccgcctaacaaggttagggtagggccgtataggatttgttcagtagtcccaatattttattcccaaaactatgtttttttaactcctaaactaaatatagaaagtaagaaaactaatctttttaagagatgtcctaaatttgattccctataatgaaaagtgggctctccctttaactaccaacagagaattagttttttctgctcctcccctacgtgcgcaccgcgtggctagcttaattttttctccctacgcgcgcgaaagagcgattgggaaaaaattcgctccttaaagtaggaaacgagatatccggagttgggaacttggattattaggagacaggttagggattctgttggatacgatttttaaccaaattttcctaaatctgaggatagggaataaaataataataaagctgttggtcatgctctaacttctccttaatcattttcttcacatatgtttcccaaactgctaaattgtatattttttataaaaagttatatagaaaatttgttttaaaaaatcatattaattcatttttaaagcttttttaagctaatacttaattaatcatacattaaacatccacttcgtttagagtgtaacggggaaagagggttcctaatagcaagtctaataagcaggcgattagcctatataagagggaaattattttttttagtgctaatacgatcgtttgatgtattatcagcagttggcaaaccgatggcagcctgagcttcttcacggctgttctatatatgaaccgagctgttgacgtataagctgaaatagtgatcgggttagggacgttttaactttcagtcacaaattgacaaattatgattggcaatttggcattgtaccccttgtggagacactgttgtaggatagaaattcgcaagctaagtctgctgttgttgttattcacataattgtgattggtgggttatctaaaaagtattcgacacaaaacggagccaagcacagtcagatttttctcaatctctaatccttacccataatgacaagaatagagggcctccacgtacagactttcacgattaattataaactagtacatactttacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatggctcagccacgtggccggctgagccaaccaaccgggactaaagatcgagctgaacttttttttttttttgcatggtcctgttgctgcatggtttatatatatatatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaatattaactactttactaactagttgaaagcaagtttgaactgaatttgaacttgtttttgttagattttgattataggtatatagcatccatacatataattagttaggtatgtaatcatggattgtaaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcctatatatatatatatatatatatatatatatatatatatatatatatatatatatatatatatatatatatataaaccatgtatatatatgtttcaatacatatatatgcatacatatatatatgtatatatatatattatattatattatatgtatatacatgcataatatatatgtatttatacatataaatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctacggaccggtgaattgtgtttccgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgtgcactacaaataaatgacaaattaacggcgtgagatctaattaatatacagttgtatgtattaatttgaatcggagaaatataaatgtagagcatgtgtactcacaggaaatttgaacttccgcctaagtctttctctccatttaccgcggaccaaatgacggaaccgataccaagccctacatggagtttaaagctatgattcgtagtagcaattaacataacaagattttcttaattaacagaggaacttatgacggtacctgtctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattgaactaactctgtgttgtacggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctataacgataaaagggagtattttattttatatagtctacttatatacaaggacctaattaattaaaggagacgtatagtaagaagtctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtcattgttcttggcggcgtcaactttcgccttcttcgttgcccttgtgtgggcaggcgatggagctgggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatgatgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagatcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcaatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactagctgcttccctccgcgattgtatcgtacaatatctgttcctcatcgtggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcgtgctccaattccttctagggctagctcttccactcaggcttgacggacgactccgacaacacgtcttttctgcaagatacaaaaagatgtattaggataaatgcgaagtataacatatatatatatatatatatatatatatatatatatatatatatatatatatatatatatatatagtaaatttgtttggtgctccatggtgtccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatatgagtgtcctatatatatatatatatatattgcatttcacgttaacgttcgtcctcgttcgttcgctcgttctcgttcacgttcgttcgcttgttctcattcacgttcgttccctcgttctcgcttgtcttcgttcgatcgttctcgttctcgctctcgttcgttcgatcgttctcgttctcgttcacgttctcgtggcaacgtacgttgacatgttcgttctcgctctcgttcgttcgatcg

SEQ ID NO: 79331 - DNA, 15968 bp, Oryza sativa
gtcttataatatgaaacggagggagtatataacagaacaccttattttaatgttaaataccttagaatatatacttcctgtgtgaactcattccaaacattcttattcaaatgctcagatcttagaactttaacagcaacatcctcaccgagataagtcccatgataccttgacataaggataacacaccataaaacaaagtgcaataaatacagtgataaaacaactcagcagtatacaagatccagaagctcatccctcccatcttcagcagtcgtttgtcaatgtaggctccggttatatgacgataagtaatcttgcttctagtagaactcatcgttataacaccagaattatccaatctggtgctgctttactcactaatgataaacacaatgaggctcatactgaagtggaaggaagtttaactgtttgaacctccaaaattttatgttcaggtagtcaaatctatcactaactttggcatacctttttttacacatatttctagcttgcttcgttcagtaagcatcgccctcagagcttcagtctataattcagttctaggtagcaaccaagacagtggcatgcatcttgtaagcacaggctgcttattaactatgttgcatctggtcctcgatacgactccaggatggctccttcactattcctttacctgacatggcctccctgatctcagcagcattaccccaacggccatcaccagcaaaggcatttgataactgaacatgaacagatgagtcatgaggatttagctcaattaggcgcttggacacccggattacaatctcaaggttcccatgaatctggcaggcactgagcagagctctgtatactgaagcaccaggttttataggcatgccattaatcaagtattcagcttcattgagatagcctgctcgaccaagaagatcaaccatacaagcatagtgctctgtccttgctcccacaagataccctttatctttcatcaagttgaaatactcgagccctttatctaccaagccaacatggctgcaagctgtaaggaccgacaagaaggttatgtggtctggctgaacatgtagcctcctcatttgttcaaacatctcaactacctcctttccatggccatgttgagcacatcctgacattagtgaattccaagaaaccaaattaggtgcttccattgaaatgaagacgccattggattcccctattgcaccatgtctggcatacatggaaatcaggctgttctggacatccacaacagaatcatatccaatcttcagaataagagtatgaacctgccttccctctagcaatgaggatgagctacctatagccttcaatacgctggcaaaggtgaacacatccatatcagtgccgtgccttctcatttccaagaagtgttgaaacgcctctttacctcttcccagacaggagagcccagagatcacggaattgaatgatacctgatcttgacatgaaacagacatctgcaccttgacaaaattttccaaaatgccgcacttggagtacatggtcacaagagcagacagaacaaactgatcgtgctccaagcccttcttaagcaccgcgcaatgaacttgcttcccatgatctatgtcctccgggctcgcgaatgagctgagaaggctgctgtatgtcatcaagtttggtgccacaccagagcgttccatctccctgaccaacagcatggcgtcatgaggccttctgcttagaacgaaccctgccacgagcgccgtgaaagtggccacgttcttttcttccatctcccgaaacacctgctgcgcggcgcccagatgatggcatttggcgtacatgtccaccaaggcagtgccgacgacgacagaagcacagaagccatgcatgaggccaacggagtgcagcgttgctccagcagcagcatcctccagcctgacgcaggcgaccaggacgctggacacggacgacgcggtgggggagacgccggcgcgcgccatgcgcgcgaaggccgccacggcgaggccgggcgcggccgaccgcgcgtggccgtggatgagcgtgttccaggtgacggcggtccttgcgggcatttggtcgaacaggtgctgtgcctcggggaggcggcgggatcggcagtagaaggcgaggagcgcggtggtggcgaagaggttggaggcgaggaagccgagcttggttgcggccgcgtggcactggtcggcggcggcggcggaggggcgcggcggctgggcggcgaggagctggacgaaggcccgcggggttcgcgcgtcggcgtggcggaggaagtcgcgcatctcatcgttcaaacctgatgtcgtcttgggatggatggaggtagcgactgctgtgtagtagtgtaggggaagatcggaggaggcaatggcaaatctagcggcggttgtcgtgggagaaggggtggcgctagtcataatgaacgacactatcctccaatcagccgttgtctaaagaatcttactttactatagtactaattgatcaagcaattagaacaaatattcctatcatctatacttcaaataaaattttcttttaaattactcatccgatttacaatccgattacaccgttgtgttcgtaacaattaaatctttacaacaagatctcacatgattatattttgataaaaaatcacaaattacttttataatatatctaaattactttagatctcactaagttacttcttaaatatataaaagtaaattcaataaaattttaaagtaattaacatataatataattatagaagttactttctttttccttttttttataagttacttctataatatatgtaaattacttttatgttatattgaattacttttatatgtttaaaaagtaacttagtgaaatctaaaagtaatttagatatattacaaaaataatttatattttttcatcaaaatataatcatgtgagatcttgttctaaagatttaattgttacgaacacaacggtgtaatcggattgtagatcggatgagtagtttaagagaaaattgtatttgaagtgtaggtggatagtgtttatcatagatagagtggtagctggtttgtcggtttagacaaaccagctagcactagctgtgtagccatgtccatgaaggaggaaaatgaaaaacggaataatcctagggacgtggaaggaccttgttgcaaaacaagtttcttcaagggtggacaagacattttattttacagtatataagccttgtttagtttttaaaaacaccacctcgaatctttgaacatatacataaagcattaaatataggtaaaagaaaaactaattgcatagtttgtatggaaatcgtgagacgtatcttttgagctaattagtctatgattagacataagtgatacagtaacccacacgtactaatgacggattaatcaagcttaataaattcgtctcgtggtttccaagcgagttatgaaattagttttttcattcgtgtctgaaaccccttctgacatccgcttaaacatccaatgtgacaccagaaattttcttttcgcgaactaaacagggcctacatataagagccagtttaaaagtatagtcaactattagcttcaaatcatctatagtcaatgtaatagccaattcatataattagctacctataaacatatactactacacaattaatatctggtcctacctgtcatacatatattacgtcttgtagtctatgcttaagctggctacaagtctatagccgctgctcttatctctcatcatttatcttctcgatatatatttatagctagcttatagtctgctaccgtacctgctctagatctagttctatttctcaactccaattttctcaatttccgttagcaagtttttcaaactgttaaatgatattttttttaaatattgtatataaaagttatttaaaaaatctcaaataaatttattttttaaatttataattattaatacttaattagtcatgtgctactcgttctgcgtgagtcgaaaatctctctcgaaacagacagatcgaacgcagccgtctcagccccggcgccgtcatcttccgtcttagcctcaccgctccgttccgttccgttccatttccgccttgctcgagccagcaaccaaactgcaaaaccgaccaaccgcacccacccaccccacctctccccacccccaacctcccaaaccctaactctctctctccctcgtcgccggcgaagcttccagaggcgggggcagcgcgagcgcatggagtcccccaccgccggcgggggcgggggagggggcgaggccggcgccgcgtcgtcgtcgtcctcctcctcgggcccctccacatcgtccgccgccgccgccgccaccgcatcggcatccgcgtcctcatcagccgtcgccacccgctacctcgccaagcgcgtgctccgcgggagcgccgtgctccacgtcgcccagggctgcttccgctcccccgactgcgtcgacgtcgttctctgcaaggtcgggaaacacccccccgcttcccgcactcccattcccctgatcggcgaatcgtgtagggcttccgatcgccgtgcgtagaggatggacccccaagggtggctgggttttttttttttttttttaattttatggtcggctcggagcgtcggggatgatgctccttatgccatagatcatgcggttgttattcggtttggaggtccggtctggggtaaccatggttgctctgcttttagtggtgtaaggacatggaggacatgttgccccagtgattggaattgctaaacccaaatattgctgtcatgctaccgattgggttgttgaagctagcgtcggatcagttccattaggagaataataaatgaataattcaaaacatttgctacaccgtcatctatgcctggatgtccctttgttttaccatatttgaataaatttgtgtgccatgctggtagaagaaacagaatgcgggacgatgggaaaagataaatgaaaagctatagacttgtatcactgcgtatattgagtgagctgcttaaattcttacactctgcttgtttgatctatggttgataagccgtgggaaaatgaaataagcaaccaaaaataatttgtgggctaaacttttatatctgtgttcttcgcggtttaaaagtcaatgctggtaattaaactacgatgaaaaaaaccctcaaaatcaactctaaaattcaaatttggctgcggctgataagacaacaagcagacgacgagaggaacatgaatacatatcaattaacatgtgaactcactgtatgatctctgttacaaggctgctgggttagttctgcagaatcctggtacttatttttctttcatccttttattgaaaatattggttattgctgcaggaaaattcactggaattggttgttattggtgaagatggtgttttacaatcaatctgtgaacaaaccacatttggtattataaaagatgttggtgtcttaaactggcgctgtacacactttggtttaatgccgaaggtgcagttctttctcatagcaaagcataatactttgcaatacttttcctgtgcatatggctgtctctacttttcttctgatgacagatgggaagataattatttgccatattcttttcagatagaagggaaagaaattctggttatactttcagattctggaaagctatctcttctttacttttgttctgagatgcataggtcagtgctgctcctttcttatttgtggcatttttttctatcttcacagatcaagctgcttgtataaactcaagacccaaaaatataattaataatgatccaaagtattaagtactgtaatagcctaatgattacatgcaaccagaggaaacagtgagaaatttaaaaaaatggaaaggatgccattttttttatgcctatcacatcacacttgtataggatgtgtatcacttttaacatccaactcgtgtgattgtgtcgaaattgccactagaaagttattaaaatctggaaacacatgcatattagactaccgagaattgaagtgaattgcactgctttttatcactaataactaagctcagttgtacacattttattttttttaatatactgtgtttttcacagtgagaacaaagagcaggataatatttttttgtaaggttcattattcacggaagaatattgtttgcaggtttatcttgtgcgtggcattttcattctgcagttgttatcctgttttgtttgagatttacaagatttgctttgatatattgccccaaaaataactgttgacacagcattttgtatcaatttattgtaggttctttgcaattgcaaatattgaactatcgaaaccaggaaatttgaggcatcggctcgggagaattttagctatagaccgagagtgagtgaaagttcctctctcttgaagtgtttgtttacataaagcttcatttgttacatgatagaatagtctccattatttttatcattagttggtgatacattaattgttgtactacatggcaaccaaaattgatatattaattgctggactgtgttcttgtaaatgggtgcaatttcagtgtcttatagggagaaatatgaaaaatggcatggtatttcagcaaacggcatgaacaatggatgtccaatagtaatgtttcccttgattatgtggcattaagaaagttaaatctttcctgttggtgactgtactctctgctcatgtctgatgtctgatggttgacagttgatgcttatgttcgctttgaacaaaatggagctgtcaccgtttctctattcctgatttcaagtttgcaacacccaggttattagtttatgggaatgtctttcatcaaagtgctattagatctaatccatggacacaactaaactgtagaacttagtgtttgaatactctgggaggcctgtctagtttgaatgattatgaacttgtggtcttgattgacaattatttgttactatctctgtcacaaaataaccacaattctaggagtagtagttacaatttttcttttgttgcgtaatgcttttaggtgtatatgataatatgatatcgtaaactgcattatagttgtccaacgcaatactctaatacaaccttttacattataattgcttgatgtgtaaataacctttttgaggacttaaagttaaatggtttatgaagtttcttaactttggttgtctcttgtcagatctaggtttgttgctgtcagtgcatatgaggatgagtttgcatttgtacgtgtttcagtggatcacaaacttcatgctcctaatggaggtaaaatttctgaggtgactcttgaacgtaaacaatgccttttgtgactctcattgcttatgcttagtataatacttacagtacattgttccagactttgaagatttcccatgtcataatttcagaaatatttttatccaccagaaattgaagaggatgctaaaatcatcagtactgcatataataccagcagtatccatggtacagtttggagtatgtgcttcatatcaacatgcctggatgaagaatattatcctgtagttgcaatgatagttaacaggtttgctccaaaatcatattcaatagagctgctacttaagtttgtggcgattacctggcattctaatttatattctgaaatatctttgtttcaacaggggctctgatgtaaatgacttggcactctatgggctagattcccataaacgtactattgaccgcatatctacttatttagaagctggacctttggcacttgaaatctcagaaattccccaactgtatggctttgcacttatgtttcgtgctggtgatgttctgttgatggatctgaggaacccaaaggacatcagttgtatccatagaataagcttgtcaactagtctaattggagatcatgtctccgttgaagattcctgtaggggattagatgtcgatgatgatgtggcggcttgtgctttgctggaactgagagactctggaaataacatgatgagggatgacagttacatggacattgacggtactgataacaaagctgtagtgaaatcaaggattgtttgctcatggaactgggagccaaatgccatgcaaggacatccaaggctgatcttttgcttggatgatggagaatttcatcttctagagtttagtttggatatggaaggagtgaaggtattgcctgagtgtgtccatagaggtttgccttgcaaacctcttttgtggatggacaaaggaatggtagttggatttgtagagatgggagatgggatgatcctccaacttgaaaataatagattggtgcataaaagtgcaattcagaatgtagcgccaatattggatctagcaattgctgaccaccatggtgagaagcacgatcagatgtttgcatgttgtggaatgtgccctgaggggtccttgcgagtaatacgtaatggtgtcaatgtggagaaacttctgaagacagatcctatttatcatggtgttactggtttgtggactttgagaatgaaaagaactgaggcttatcactctcttcttgaattgtcattcgttgaggaaaaccagaatactatcagtaggactcagttttaatgacatctgtgatgctgtaggatttcagactgatgtttgcactctggcatgtggtttagtagctgatggtttgcttgtgcaaattcacagcaaatgtgtaaagctttgtttacctacagcatgtgctcaccctgagggaactttgctcccgtctcctgtttgtgctgactggtatcctgatgtcactatcagtgttggtgctgttggacataatgttgttgttgttgctacatcgaatccttgttgcctttacatacttggggtcagatcattatcttcgtttcagtatgagctgtatgagatacaacatgtccagttgcattatgaagtatcttgcatatctattccacaagaggactggagacttgataattcatcttctagttgtgcaacgagtggtgattttcggaaagattttgcagctaatattcgcaagtttgctgtaattggaactcacgaaccttctgtgcatatcatttcgttggaacctggagaagcatttcagcaacttgctgttgggcatatatcagtaaacaacgcgctcggcactcctatcagtggttgtatacctgaaaatgttaggtttgtagcagctgcaaggttctacattcttgcaggactaaggaatggaatgctactgaggtttgagtcacaaacaagcaaagggcattgtttccctggttccttttacaaggagtcctctaccccttgtgatgatacatcccttatgttgattgctgtacggcgtattggaatcactcctgtagttttggtaccgttgcatgacagagccaatgctgacattattgttctcggtgataggccttggctattgcaatctgctagacacagcttggcatattcatccatctcatttctgcctgcttcccatgtgacaccagtgtcttctactgattgccccagtggtctgctgtttgtttcggagaactgtttgcatttggtaagtttctaggactcgtgaaagtgaaatccacaagcaaaacatgcacatattcttttttagggatcaagaataattacattattgcttgcatttcatgctctgaattattaggactcataaaccatgagattgctaaaatctgggatcgaatcccattataatgagttctccaaatagatagtcaggaacatagaaatcatggctgttgattgttatcttataattttctttatgcactcggtgaaaccgtattctctcttctggcatcaaaatttcacacttctcttttttgctgctatttctttagtatccgtttctcttttgccactatcgttggtcaacatccgttgaccatcacatttgccaataaaaaactgttgtacccttgcgaaactaacaaaatataagaaattcaaactatctaggaaaatacaatttacctttttagtttttaaaggttgtacaaataattatggtaggaaaattttcagttagtttaaaaggttcccacgtgtatcttaaaaatggaatttttaaaggaaatatttttgcatatccacatacaaatcaaacagcatagctaccaatattcatgtaaacaaccatgcacataattccttagtatagattattctgtgaaacatttgagaaccaaatcattcccatgctacatttttaaagattaatattagtgataatataattcccaattttatgtttttctaaaaaagtgtattaagtggccataatttagttttcttgataactttatggtataggttaaaatgtcaagtgctgcattattttggaacatgtacaggggtataatggccttttaggggctaacttaacagtcaatggatgttgactagacggtaatgatgaaacaaaaatttgctctgacagaatagtggcaaaagagagaagtgcagattttcgatggcggaagagagaacacagttgcaatgagtgacaaaaagaaaaaaaatcccttgttttattatacatagaactaatttgattcgtgacatcgaaatggtactcacagattttccatccatggtttctctcatatcattgtatttgagattttctttttgctagcatataatttttgaaaactactccctctgtcccataataagttcatttttggtttcttctattttccccaaaacaagttcatttttgaagaatcattgcagagtttgtggaagtaaggaatgattatttgggagaagataaagtgaggaatagttgcattgcgatatgataaagtagggatattctagttgtatatgtgtgggatgggtgaaaaatgaacttatttagggacggaaggagtaactaggtaatgtcatgtaccttgtagttttctctaatggggcattttaccagaggggtggcaatgtagcagagagtgtgtcaccatgtcaagtaaaaaaccctcccattctgtattctattttccccatggccaaagggactttagtccttttcttgttcgtctgaaacatgaaatctcttaatcgtagtcatcctgttttagcctttccctgttaagtttatgtgcttatatttcaagtagatttcttttgttccagtcccttctgttgatctgccataagtatggtgcaattactaggataatttattctaaaataccaagatgataataaaatcatgaccttgtgggtattgttgaaacttgaaagcaatgcttatattattctctcactattggtatgcatgtatgtgttctcacatagtcacatgtttatctcctaaaagtggcttgcatgtgcatttcattgtactgtcagtttaaatcaagtttatcttttcaggttgaaatggttcatggcaaaagactaaatgcacagaagttttcgattggagggactccaaggaaagtgttataccacagtgatagtagaacactgttggtgctgagaactgggttaaccagtgtatcctgttcttcagatattgttcaaatagatccaagtaatggggcattgctttccagattcaagtgcgaacctggtgaaacagcaaaatgcatgcaaattgcaaagatagggaatgatcaagtattaatcgttggaactagtaagtccaatggccgaccaatgatgccaaacggtgaagcagaaaggtaaggacgacaactcatgttttgtttctgctgaaccttgttttgtcaagtttgaagtgtccatggtcccttagaatttttgcactactaatgtttaacttgcaatcctagtgttttttttttgcttggtttgagtataattattaatattaatgatctgttgttttggtctccacttttttgttttctgtctgcccgttgtctggtattctgcaaaagtgacatgggtatgaatttgcaaagcttgcaaccatgaggcacattttttggtttctcactgattgtgacggtgttgccattgcgctattgatcattcaatgcatatttgcagttggatcatcaatatttttttcttgttttttctgcacttaatttagtttttccatttccatatctttgaattgtgtgtatagttaaaagctgcctttatattgttattataactattctctttggatgaaacagtatcaagggtcgtctaattcttttaagcttggagactattgaaagtcctcgtgagagcggttcgtttactgcagcttctaatttgaattcatctcatgctggttctccattcccggaatttgttggatatgcagcagaggagctgtctagtaacagcatgtgcagcagtcctgatgaagtttgctgcaatcaaattcaacctgaactcatggcaggccatttgagatcactagtccaacatacattcaatggcgctgttcttgctgtacatccatatctagatagatatgtgttggcagcagctggaaatgtggtatgattagaagtcaatttttatcatatatgatagtatatctattaaagagtagcttagctcggtaatggatctagataaataaatttgcaaagaagcttgaatgcttgattggcaagttccggactcttgacatcagaatcagttaatcaacatttatcctggcaaataacactatttatgtggatcgtatggtgttggcttctttcacttctatagattgctagaacaacagaacgaaggtgcattagcactttagcatatgagccacattaatagcagaggatttttttttgtaataactactggagagatagactagtgacgattggagttgaggagatggagattggaagggttatttgccattataaaaaaaatcctgaaagaatatcccaacaagagtgttattattttccaaaacaaacagttatcatgacgtcactaaattttctatcattctgttactatctggtgctaatatgttgatgctgacagatccagtttgaataccacaatatttgaaaatcatgatctgagattttctctgccttatcttgacagctttttgtatttggatttttaaatgaaagtccccatcggataaaaaagtatactacgagtaggacacgatttacaataacctgtttgaagacgtatgcatcacggattgcagtgggtgattgccgcgatggtgttctcttctattcttatcatgaggtacaagttgattcaattgaaacaatacatttttatgatgtttatttttatggagcttctttgtcgttacctctaatcctcgtattgatttatgccagaatcttaggaagttggaactgatctattctgatcctgcccaacggctagtgggtgatgttgcccttttgagctgtgaaactgctgttgtatcagatcgacgagggagcatatctgtactgtcttgcccaagattagaaggtatgccttggtatagatgtctatgttatccctttctttttagtttgtacctgttcttttctctggattctttttaatggtagtgcctcctctatactcttctgcatcttggtcatactttgtaattttgtagccttcatgtttagtttctcaatctaattcctttattgacatactaaatatgcagtataaacatcacaatatagctggcataaaatttgccagtgtagtaaggccacatagttgaatattgtgcctagaagctttatgaatttcgtaatagaattcaaaattttgcattacgtttgtgtacttctcatcatatatgcattactttgtaatatctacctaaattaatttaaattttacattacgtcaagatttattttgactttttttaacatatcttgcagtatccgaaagtccagagaagaacctagcggtgcattgttcattttacatgggtgaaacagctatgagcatccagaaggtaagcttctgttggcatcttagggctaaccagtgtgaattccattaacgaaaacataccaaagagagggttttgaacatgggtattgggtagctgctttggatttaaaggatgaatcatgtgtttgtaacttgatgaactaatgggctgtttggtttgaggaatcaaatcatcctaggatgagttttttccagcatgacccatcatgagtaggggtgaaacagtgcggaaacggacggaaacaacctttatcgttttcgttttcatattttttttggaatcggaaaccccgaaaacgaatattttcgaaactgaaaacagagcgaaaacgaaccggtgcggatacggtaatgaaaatttatcggaatacaaaaacccctcaaactgagcttcaaacttttgtcaagtctaattctcaagtctcaacagtcaacaattcgtcataaaacacaattatatcaagtctaattgttaagtctcaacacaagtacacaataacacttaacacggagtgacggaggtggaggttgaggaataacacctgctggctgctgccactgggctgctggctgctgcgaggcgaggcgttgtcggcggtgaggaagagtcgccagtggggcttgaggtgtcgtagacttgtcggtgtggctatggcggcgtcgtcagtggtggtggcggcggcgaaacggcgagacggcggcgcgaaacggcgggacggcgccgcgagatggtggcggtacgagacggcggtatgggacaacgaagagcgactgcgagagaggaagggtgggcacggtcgcgaggacggcaggggcgaggtcacgaggagccgaggacggcagaccagcggtggcgcgggcggtgggcgctggggagcacgatgccgtgatctggattctggatgcgctgctccgccgccggctcgcggtcgcgcgatgccgtgctcccgtgcagcgatcagtgtgtctctcctctctagggttagccgctatttgggtagatgctgcgatttggattgggctgggaacttggggacgacttatagactattgattctatgggcctttttaacttcagaaattccggcaaattttttggaatttttccgaccgattccgagttccgacggaaactgctattatcatattcgatttcgtttccgagaaaatatttccgttttcgattccgtttctgagaaattctgaaaaaattctgaccagctgattccatttccgaaaacaggcccggaatccggaaagtttccgtaccgttttcacccctaatcttgaggtcatcccatgattttgatgggatgatccaatgatcccattcatctttttttttccaactaagcatgtcgctttgaggaatgaggtagaaatttagtagtccattctgctcttgtttggttcggaagttggacctgctggtgcattgagtatccaattacttagatgaaacagcccataattgatctaggagatttgccttgttatctctcatgatcccgttattttccctgaacatttggttttcattcatcatgacccgacccttttctttctatatgagccccatggagaagtgtgaccgaactagtttcatgttttatattgttgctttgctttcctatggttaattcggtcttgtaatttgctgtaggttgcatttaagcattggcttccaattgatgatttgacagaaccagtgttggagtcggtatacaactgtgtcgtcgcaagcactctgctggggagtatctttgttatgattccactcacaaggtgtagttttgaagattccaactctagaatctaaattcatgctattagctatttatctgtgacagctcagtcagggccactgctagcctgtcggtaacatctaaaccaatttgggagattgaatttgctttaagttaatcagggttgtgaactatgatagttttggct

SEQ ID NO: 79332 - DNA, 664 bp, Oryza sativa
ccctagcagaagggcaccaaccttctgccatatgacatctcgactaccggcccgcagctcgtgtagccttcatttgccctgaagaatgtccatcgacacccgacttcatccatctccaatcggtgtacttttgtttatgactagactgagccacaaactaagccttacccattagacatgtggaagtacagtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatttcccaagtctaaagttataaaaaccacctaatgttgtcctattaatcagcgaagcatctacctaaattcatactagtggaaccaggaatagagtacccactagttggggttttgtttattctagggtgaacaaggtaataataacaatagcaataataatgtcataacaaaggtgaataggcatggctaaataaaacagtgataacgcgggaatttaaataaagcgataatgcaataatttaaatcaacataattttacaaactgggattcaatatgttcaaggatgatg

SEQ ID NO: 79333 - DNA, 2457 bp, Oryza sativa
ttttaaacccggttagggttaataaccgggactaaagattatagcactgcatatgattttctcttacatatgtgtctataaaagagaagttaatgcattaacattatttaaagtacaaagattaatgacaattacttcgaaaaattatttttgtctgtaataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagcgtaggaattatattctttgttagctcctaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcgtgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttggcactaaccccattttttgctttccattgcaactactccagagtggtatccaactttttatgcccctgctcgcaacctgggtacaacgaagttctgtggtcctccaacatcttgtccaatttatgggcctccttttcactttcgcagtcctccctggcgtcctgcaacatctgactaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttattttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatatataggggtgggactttagtcccggttggtagcaccaaccggggctaaagatcaccgggatctttagccccggttggtgctaccaaccgggactaaagtcccacccctatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaat

SEQ ID NO: 79334 - DNA, 5200 bp, Oryza sativa
  unsure (1)..(5200): unsure at all n locations
acaatcggcggtctgaccgcccaacacatggcggtcagaccggcccactcggaggaaaccggtagatttccaaattttggtaatctttcctattttaatcctaggtgccaaatttgggtgtaaacacatgcccccctacctttttggtgaacaacgtgaatctaaaagcatagagcatgtttttggccttaggacgataatccaattaccggccatagtacctcctaagcatcttgccaaacactcgggaagtatttcttcaagtatttcccgttgattgctcgctgaaaacgctccccttaaagtgtctccaaaaagtatgcgttcccccgaacaatgccgcatattcgataaggaccttcccaactaggagatcacttaccgaactccttggatcgagtacccaaaggcaaaattgtcttccaaaccaagtctccaacttgaaacaattttgctttcaccctcttgttgtatgccttggccaccctcttcttctctttctctatctcttccaatgccttcaagcgcttgtcgacgacttcatcaaggttgtctcccatcaacgtcttgtaatcttcacttgacaaatcatcttgcttgatataacgaagagaaccaagatttacctctaccggtaaaatggcttcttgaccataaaccaactcaaaaggagtgactttagtggcaccatgtttagatatcctatgcgcccacaatgcttcggaaagcacctcatgccacctctttgggtgctcctcaatcttctttttcactagttttagcaatgtcttattactcgactcggcttgaccattagcctgagcgtagtaaggagaagaactcaacaatttaataccataagattcggtaaaactattcacttctttagacataaaagaagcaccttggtccgtagtcaatgtttgccgaacaccgaatctatgaataatatgcttcaaaataaaatcaattacctccgtatgagtcatattcctcgaaggcacggcttcggcccacttggtgaagtagtccgtagcaactagcacgaacctatgcccctttgatgacgaaggataaatttgaccaatgaaatccaaagcccatccccggaacggccatggtttgattatagggttcaacacggcggcgggtgccaattgaacattgccgaaccattgacaagcctcacatcccctataatatttgaagcaatcatcaatcatcctcggctaatagaatcccgctcttctaagcaaccaattcatcttatgggccgattgatgagttccacaaattccttcatgcacttctccaatagccactttagattgatcttcatccaagcacttcaacaagacaccgtctacgtttcggcgatataatcttcatcaagcaatgtatatttgaatgcttgccgccgaatttttcgatcaaccttaagtgtgggatcttttagatattgaatcaaaggaattctccaatcctcttctgtatcctgggcacaaatgtccgaattttcaattaatccggcctccaaattgattgaagtgtgcccccagcatcctgcccaaaaccggtcagaccggccacacagggccggtcagaccgctcggggtcgctgatcagaccggcggcatgtggccggtcagaccgcccctggtcaccggtcagaccggccgtgcaacgccggtcagaccgcctggtctccaattttgctaatttcgcacaaagatttaaaatcaagcaccggttcttctaatatcagaaataatcccttcttcacattataaccagatgcttgttgtgctaagtcatttgctctagaattatcatgcctagcaatatgtctaatagcaaaattatcaaaattggcaataatatctaaacatgaatcgaggtacctatttagtgatccatccaagcatgtgtagactccgcgacttgttgcaccaccaattccgaatcaccaaaggcctccacatatttagctccaaccatctccataacttgtaagccgaacaataaagcattgtattcggcttgattatttgtgcaataatattcttagcgaaccgatgcctcataacacatgccattaggtgaaaacaaaactacccctatgccttgaccttctttgcaagaagaaccatcaaaataaattttccaaggtataacttcaactaagcaaatctctccctcataagcaacatctatatgatggtctactataaaatcacatacaatttggccttttatagttttcaatggttcataagccaaatcatattctatcaaagcatatgcccacttgccaattctcccacttagaattggcctttgcaacatgtgtttaataacatcggcttgacaagtaactatgcatgtactagataacaaataatgcctcaatttggtacaagcatagtataagcatagacaaagtctctctatagaacatacctcgattcggcatctaaaagacggcggctcaaatatgtaatgatatattccttggcatctttctcttgcgtcaaaacggcaccaatgactttgtcctcggaggcaatatataaccgaaaaggcttttcggctttaagcgctcggacaacgggtggagtagataaatacctcttcaactcttcaaacgcctcttggtgttttgccccccaagtaaaatcggcttcttttttcaagcgaagaataggaacaaaagcatcgattttacccgctaggttagaaataaacctcctcaaataattcaccttacctagcaacttttggacctctttcttgcatgtcggcgctttgaaatcacgaattttttctatcttcttaggatcaatctcaactcctctctcatgcaccatgaatcctaagaacttccccgccgacacaccaaaagcacatttaagtaggttcatcttcaaaccataccggcgcatcctctcaaaagctaatatcaaatcggctatatgtccttccataccatccgatttgacaacaatatcatcaatgtagatctctaagataatacctagcaaatcatggaaaatcaaattcattgccctttgatacgttgcgccggcactctttaaaccaaaggtcatgacaacccacttcaaataaaccaacaaaccccggacacctaaaagccgtcttgtacatatcctcttctgtcataaaaatttgattgtagccggcattaccatctaagaagctaatcaccttatgacccaaggcatcattaatcatcatgtcggctataggcataggatactcatctttaggagtagctttatttaaatctctaaaatctaagcaaactctaatcttaccactccccttcttctccaccgggactatgctagaaacccactccgcataacgacatggcctaataaacnccgccttcaacaaccgatcaatctcctctttgactcggtcatataataaaggattaaaacgacgaggtggttgcttataaggcctaaaacccggtttaattggaagccgatgctcaacaagctcacggctaagacccggcatctcatggtactcccatgcaaagcaatcaacatattctttaagtagctcgattatcttaactttataatcggctctcatgtttttgtttacaaaagtcggccttggtttaattccatcacctatgtctacttcttctaatggatcggccgatgtaaacccttgcccaagcttctctacttcatcaaaatcttcaacggtctctccaatatcgttctttgtagaccgatattcttgcacccttttttgtaaccactctaaactagcctctttattcattatacaagtttatatggcttagccgtgctacactagcaagctttacagagataggtacaaatttgccatcggagatactaataaaatcatagctagaaagatccctccccgataagcatgggatatccccataacgccactcaaaagtagcatgggccattgcaacctcggccgatgtatccgcttgaacattttcaacatcatcgccgtcccattggattaaacattgatgcaaggtagaaggcacacaacaatttgcatgaatccaacaacgacccaaaataacattatagttcccccccccccttttttttttgtgggggccccccacacacccccaaatattttcccgcggggaaagcccccggaaaatttgggaaaaaaaggaaaaaaaagggcccgggggtttttgggggtaaaggcccgttccatttgtttttacccacggtttgagtctccgccgaaaagatacccctcgcctccattggttcaccattgaagccattgaggatcatgttggtcttcttcaactcatcatcctcatgccccaacttcttgaatagcgaatacggcatcaaattcacggcggcacctccatccactagcatcttagagaccggtttcccatcaacatggcctttgagatagagaggcttcatgtgacggtttgactcatcgggcttctcaaaaaccgcatctttaggacctaatgagaattgggcaacctcggcttcatccatagcacaaaactccataggcaacatacacaccatgttgatatccatgtcttcctttggagacgatttatctttgtcaaccgattgttcttccttctcctctacatcaatcggttttgccttctctatggatttaggcctccataccggtggtggtcgtaactcattgaaccttttatctctttgttcttcggcctttttctcccttaattcttgggcccgaagacattgcaaccttctcttttgtgtagccgtcaaatccttaggcatccacctaggattcggctctgttctaggaggcaaataatgtcctctattaactttgcttgaagacgatgaagcccccacatcgccctttgcagccctctcatcaaaccgacaccggagcccggtcagaccggctgtaggccaccggtcagaccggccagaccggcctgaggcgtcggtcagaccgtcgtcaggtcggcggtcagaccggcctgatggcccggtcagaccggcaacatggctgcggtcagaccggccagagggcctggtcagactggccgactgcgaggagctggtaccggcttcggattttttgcttggggactttccaactccatctccagaaggtataggcacatcatgagatcctattt

SEQ ID NO: 79335 - DNA, 1021 bp, Oryza sativa
tgacttttaaatgccgtttactgcaaaacttaacctctatgttattatccccttgtactcccttgcattaattgtgcatctccggtgtggcttgctgagtactgtggttgtactcattcttgctcaatcttttccccccttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgtcaagctggtatcagagccatctcgactgtaggataagccaagtggataaaacctaaggacatattttataaataaaactatttgcgaaagttcctctttttctccttcccctaatgctatttgcaaagggtttactcttttctttcttcttcaaatttcaactagtactagatggtcagctttgcgaagaagaagatgtcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctggctctcccctttgttttccctctctccctctccaaacctttgcaacagatggctgacaatgagaaaaggcaataaggtcagaagtcaggatattgggacctcaagct

SEQ ID NO: 79336 - DNA, 12478 bp, Oryza sativa
ctaaagatcccggggggggcctgacatgacctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgttatttctcaaaccatataattaacactacataacactccacacatatagtaaaaattgcaatataaataccaagtaactacaatgtaattgatacgcaagtataatgcaactgagatgtaagtacagcgtgtaattggtatgtaggtacaacggaactaggatgtaattactttgtaatgaatattaatataattttggctatggagacatggagtcagcacaactactgtgctcttttttttttaaacttaaacatccaataatataaaacgacagagttcatatgaataaatcccagtacattgccaaaaggataaagagaaagcataagaccatccgtttcgaaagaacggaaaactgcactaaggccacaatcttcatatagaaaccacacagcagagaaggtgcacatcgacagggagctgcagtgatgaaactgcactaaggcaatgccgcgacgattgcgaccttgggcctccttcagcgtgcacaacgcttgacaatccggtaatccccatccggttgcctccacgaaacgacacaaaacggaggtctgctactgagccgtagattttggagtaagcatccccgggctcagcaagagatgtccacggagtccgtcgtcaaatctgaggagcgagagctcaacccgaacaacaaaccctgcatggaacaagccgataggaaacacataggaagaaagagcctaaatccaaatccccatatccactaaagaactcgaatggtggcaaacgaattgctgtcttcgtggattgacgtacgtggatggggaagtgaaaatctgcaaagcatgactgatagaaccatggcattggaagcacatgttcaggcaccagagaaaccgccgccacaacgctgacgggctgtcgcccgcaccacgagcggcgagctccgggcgacaacagaaccagccagcaagggacacaggaagccgccgcagccgacgcaagaagcagggcggcggcctcccagctgaagacggcgacgcagccgacgccaccacaagaagccagctccatccatcaaatcgcccactgatcttcggatctcgcacttccaccgccaccaaccaacacctccgccgaccactccggcacctgtcacgccccgaactagtaccggtcggtactagcccgtgacgctccaaattaacctgttaatcgataccagtcccaggaaacagtgctggtatcacaggaagatagattatcacagcaacagaggtctctttattatagagtagaggtacagtcatgttgggctgcggacagatcccgagctcacaactgcattacaaaagggaagcggaagccaagacttggaccaaacatcacaggcgcgacttgggaactaggccgaaaccctaaaactcatcgtagccggcttgctcctggaagaactcctcatcagtaggatccgcctcatcttcttcagcaactgggggggattatttatatagagcaagggtgagtacgggagtactcagcaagccatgggaaataagtgtttaatgcaggcttcaaggaaggctgttgtttttgcaattgattttatttgaactcttttctgaaaacaactaagtgagtgcttctcaaacgacacggatgagacagtgcgtctcgtccggtcggagtatgtgcaatgtatcagtctttagaattgatcaagattggcacccagccagcgactttcaaacggccacccgggccaaccactttcaaacggccacccgggcctagctgatcccatcagctgcagattttccaaacatcgatcccctttccacaacagcaatttcacaagacaatagtcaaacaaagctacgctaggaatcacctcacatccgcccatgaccgtgggcacggctgttctaacagtttgttaacctctgcagagggggtacactttacccacacgacattactaacccggatcacccagccgtggggatcagccacgttgggagacctccaagctttcatgacaaggcatttccaaagccgacacaggtttaccatatgccgacgagaggggtcccagaccaacaacaggttaggtcccagaccatactgtgccagtgtcacaccctgaaaattcaaaatatataaattgttgtttaaatggaatttttagaatttattttaaaatcctagaagagaagatctaatttttaattaataaattccaatataaaatggggccatataaaatttcattaaatactttgcttaattctataattcctagatttttctgggatttatttgagctaaggaagtatttttaataaatggaattgcatttcatgaatgattttaattgaaaaaggttttaaaaagtctcttttggctttgggccgaaagtcggcccaaaaccgctctctctctcctcggcccagtccggcccagtccgccgccgcgcgcgcgcgcgtccgcccgctgacaggtggggcccacctgtcagggtcgtcgtcaacctccggccgccgccgcccgaaaccctagtttcgcgccgccgccgttcccttccaaattcgatcgatcctttccgtttccggccgaattgatagaggggaaacaatctccgggatctcctctaccttttctcttttggaaacatcggctaattcgttttggaagttcgtggaatcaggttcgattcggattcgtctctctcctccgaaccctaaaccttccttctcgtcgccagccgccgtgggccttcgccgtcgcctccgagcccctttaaaaggttccccggtgtctcctctacccgtcgccaccttcgtcttcgcctctcgtcgcccgtagcgccctagcgccgtgtgccctagcgccgccgttgccgccgccgctccagccgtgcgccgccgccgtttcagccgtcgccgtcactcgggaagaccaccgtcgtgatcgccaagtcgccgccgttctcgtccgctccttcgccgccgccgaagaccgccggagcaccgctgccgccgtcgacccgaagtttgccgccgcttcctcctcgtcgccgtcaccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcatcgccgacgtcatcggggccgttcgctgtgagccggtcgtggaccgttcgatctcggccgtccgttttggatcaagtcgatctcggccgtccgttcgcgtgagccgtcgcctgtgcgcccggtccaccgaaaccctagcccgctgacgcaataatcctccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcaagcttgtttatgtgttgttttggtatttttgctcttttctgtttagattccgtcgtttccggagagtccgttttcgccggagaagagtttgaagagttccaaggccagcaaggcaagtcacacagatcccaaacaaccctttgagcatattgatcctatttaaagctattgtttctattcaaatattgcatttattttcgaatgtcattgggtggaattaacctaaggtttgttatagcccttttgttcttgattaccttattccttgataccttgggttattataacttgactggttgagctctatatgttggttcaactagatgtattagatataattgcttagccctgcttagaaacattagcacactattgggataacttatgaatcactataatttaatgatggcttaatgatagttcacgatggccaatcgtgatttgttaattaattatttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaatggtgcgctgcggtggattgtgttatacaaggggtattgtcacaactcctttccgaggtaccgtggtagtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcatcataataataggtgctttaattggtaataatttgattagctcctggtttggaatggtatattcctggtttggagatagaactgtgcagccgggatggttgttcagaatggttgagcctatacaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagtggaagagttctacagtgaagctgatggtgtggaggattaggtgtagccttagtcaagctgcctgtggagtggagccgtccgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacagccaggaagcccaggggtcctccccgacaccaccccggcgaatccacatgtctctcggcatcaaggctcccctgataagctagttactcagccaggggtgtcccattccacccatgtggtcgtacttgtcttatctttggatgaaattccaaggaaacggtccttaagtgcaagagtggaaaaccgtacacccggtacgttccccggtccgcggttttgggaatttcatttagttcgcaagcaccgacccaggtgtcgggttttccaagtcttttgtaaaacccaagttttatccaagttgtttttcagatttttaagtttgaaggcgaccgtcgatactcgcacagggtgcacgaatatcgaggcacaactagatggttacaaggggacatgatatatcaattaacaaaggaaggatcaaatgcaacaaactaggtaggtccgccaatctgccttgcagacgggacaaacagattaagtgcgatcctatcaatgcataatattttgcaagcaacataattaaattcaaatataggctcaagatgttcaaaggtggcttgcctttctcgagatctggagcttgatcctcgaaatcctcgcactgcgggtcttcgggcttcgaaactacacgcaaaacgggatgactcaacaaacggtgaaaataaagccctattaatgacctataagcttgccattagatagatctcgagatttgaggaattttggaagttgaacggagtcaaacggatttacggttgggaagatattgaatttttaagattattggatttttggtctaaaggaaaaaggatttaattaaatccttttttggaaaagaaaagaaaagaaaagaaaagaaaagagggagggaaatcagacttttcctcgggcggctagggcgcggcccgagagaaatggagcggtccggccgagctcaatgggccggccggcccaaggcggcccaaggcgcgcgcgcgcgggagggaggagagagagagccggtggaccgggctcaccacgcgtggtcccgggtgggacccgcttgttggtgacacggttcaccgtgcggagcgagcacgcggcgcacgcgcgcgggcgggggagggacgcggtgcacgcgcgcggttcgcggtggaacggatgcggcgggcccacgcgcagcctcacggcttgcggtggaacgcgcgcacgggaggggctgaccggggtcggcccgacccgatctcggccgagctggcgccgacgtggcgcctacgtggctgccacgcgggctggcgggaggtagacgacgacgccggccggaacggacggcggacgacagcgacgagcggcggagcgaaccacggcgatacaggcgaaagcgagcacaccgggtggttgctcaggacgaggggagacgagccaatggctcggattcgccggagggagcttgacggcggcgaattgaggcggcggcaaccggcggcgggagaagggggaaacggcgacgaggtcacgaggggccgattcccggcggcgagagcatctacgcggctacgggaatccgttgctagcgtcggattgggcggagctacgccgagcgaggccggcgacgagcggcgcttccgagctcgggcggcgacggcggcgagcacacggcgagcggcggcaacggtcggggcggcgccggctagctacggggaggctactcgtgctactacctgagtctaaggggaggagatggaacgaggaggaagaacggagggaggcactaccgtgcgggggtgatggggcgcagtgacgagaggccgatggcgcgggagtaatctctccggccttgggccggggaagaggaaggagagggcgcgcccgaagtcccctttcgcgtcctcgctcgtgccggctcctccgacacgcgcaacgacgaacggcgacggcgaaacagaggggcggcaacaatggagtggaggcgatgggacagcgagagaagaagagagggagggcgcctgggctttaaagggcggtaatgtcggtttggaaaccgactttgggcggtcaaggcgcgagctggcgctccggctagcggccaaaacggcgacagggaggagggaggaggatgacgccggcgggaggaaaaaggggaaaagagggagagaaaaggggggctttgtcacagcctgaatttcatttcaggatttataaattatttaataaattattaatagaatttatattaaatgttcattaatttacaagtgaagttaaatgtgggaaataaaatttcctaaatataaagcatggttggatttaatttttattaaattctccatgattaattacactctctggaattttctcggatttttcggagctcaattcctaattttaatcatacaaagagcatttcagtaattacccacatattaaattaatcattaaatggtctaattataattttgttaagtactttgagtgtccaagtatgttcaagatttttcttggaattatttgagcattggaagtatttttaacaattgaaagatcatctcattggttaatttatttggaaaagtaataaaaatcctcctcctcagcttgggccgaatccagcccattccctcctttcccctctcccttcctctcagcccagataaagtctgtttgacctccctggcgctacagtactccatcttcctcctccagacagagccgagccagccgtgctcgtgcacagtgccgcctcctcccaccaatccgacctccccgttgctcctctttccaaattagttgcgggaatggaatcctctcaatctcctcttccttttccccaagaaatccccaaatgtttctatggaaatcctttccaatttcgcggttcaacctttcctttttccggcgaaccctacctaatccgtcgccgattccatccgttcccgagtcgatctctccctcttctggctataaatagcatcccctcggcctcctcttccgtttgcctcaagtcccaagccgagccgtcgcttgtagcgccgccgccgccttgccctagccgccgccgacgccggtgaccctccagccgcgtcgcgccgcctcctcggtcgaccccaacctgcgccgtcgcctccctcggcttcgcaagggtgagagctaccccggccacccgttcccttgcgccgaatctcgccggaatcgctctccccgcgctcgccttctctctccacctccggccgccgctccagcagccccgcgccgtcgctgtggtcgtcgccttcggtcgccgctgccgccattgggttcgcgaggaggagaagaagaccggcctccacttccccgtcgtcgaagaccctgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgcccctcggttgttgcctctcgtcgccggaaagccgtcgccatcgtcaacccaaggtcgccgcctttggaactcgtcgcctgccatctccctcgccgtctgtcgtcgtgtaagtggtggtaagggtcgccttgatctcctctctctcccggtgccctccgtttgcatctttgtaccgtggttcgctggtaactgccgttcccgtgcttgcggtcgtcgatcctgcgtggcagccatgtcatcgctgatatcgacgccatcttggccatccaaaattaatataaatttgtcatctcttttcaatgacatattattcatttttaatatatgtcatctaccaaatatgatctaatctttttccggaggatgttttaatcttctgtctcagttataaatcttttgtaaattgtttaatcaatttggaatagtcttttctttaataggtttaattggaattaaatcttgtaaaattcatatttaattcatttgaagtcagaatgaggccgttcaagtctcataattcatctaaaattatgacctacatgtttgtttactttttatgtattatttatttggtttttattagtctttttcttcgttttgcgtgttagcttgtcgtttccgtcgttgtgaaggttcgcgagtgcgccggaagtattcaagaagattatttgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctatttgcattgattactttattccttgataccttgggttattataacttgactagttgagctatatatattggttcagctagatattagatatgattgcttagccatgcttagaaacattagcacactattgggataacttatgactcactattatttaatgatggcttaatgatagttcacgatggtcaatcgtgattggttaattaattatttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttactgtcacgcccagaaattcccgaatagaattccaagcagaatgtgcataaaaatccccgtccaggaccagccggggtacacaagcgacaatgttgacatacagatccacgtcttacaaacatcataaaagtcttacaaaaatgcagcggaaaacaaaagataactggagctaagccttgactaaactttgactaaactgcagcgggaacaccactccacaggcatcctcgacggcacggacgaagcctactcctcggggaaaccttcatctgacacatacccgtcctctggggttgggaaaagtagagcaagactgagtactacccactgtactcagcaagtcataccggaataggggtatgatgcagggaattaacaaagaagagctagagtggctcatttgcataaagcgagcatttataaacggaaattgaaagatttaaacagttgtaacaattaattaatattaaacatccgctgtccaacgctaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccagagcggtggtactaatccaacattaccattagaaccaacagtctaaacattaatatgattttccccattgtgaactagttgaactaagcatggctaagcaattcctagtccaaactctaatcatgttataacccaagctaacaaaggagcatggtatcaaaatagcatggctgtaacaataggtaaacaacccatagtaatattataaaacaatgcagtatttgaaagaaaacaatagagcatttgcaatttaggatcaacatgttcaagtgacaagcatgacttgccttgctcttctgctgggggaacctcggcgactatctcgaagtacaccggagcgtcggagttatcggaatctagcgacatacaaagcaaacattgcaaacaggctataacactactgaaacagagaacaaaaccatttttaatggattctacacatttttcttgatttactgagacttgaatgggcttaaacggagctcggatgaattagttatgaattttagaagattcactgtgtttattactatacaagaaaaaccttaaattatttattgcgcaatatattccagggctgacgtcagcacggaggggatgcggcgccgacatgcggggcccgcatgtcagcggcgcacggatggccggtctaccgtggaccgggaccacgcgggtgatccaccgccggtccacgggatcgacggcccggatcggcccggaaccgatcggacggtgcggcggcggccaggctaggctcggctcggcacaaagccggccgaccggtctcggcgacggcgcgcgcacgcgcacgcgcgttgccgacgacggcaaccgccggcggagacggcagcgcaaggcggcgccgaagggcggtgaggctaaagcgacgactaacgggcggcgacgctaaagcggcggctaggagggagagggaggggaatagaagggagagggcgcctcaccgagggtggccggcgcggaggaagacgacgatgaacggcgacggcaagccacgggaggacgacgtcggcgggcggacgagcttcggggtgccctaaggaaggagaagagagggattagagagagggagatggaccacggcgaccggaaaccatggccgaacgcggcggtggaggtggtgctcacccgagtgcgagggaacgagggctccggcgacgaacctcgacggaggaggggtggacggggtggatctcggccacgcgaacccgacggcggcgacggcgcggtgcggcggcgagcctagcggcggctagcggcggccggagcagcgaaaatggcggcggcaaagggttgcacggcgcgggagcgatgggaggctcgagagagtgcggcgaaatggggaaaaagcgagagggagcgacggcgatgcttaaatagggggagagggaaccggacgtggccgggagaggcgggaatcgccggccgacttggggagtgggggaggagagaaa

SEQ ID NO: 79337 - DNA, 2192 bp, Oryza sativa
ttttaggattttctttttataaaacctttttactttgtttatttcttttcaattattatttgttttctgaaaattccactaaaatttatttacgcattttaggcttttaggaaatatacaaaaatcctccaagcctcatttgacttttatcttgcaccttttaattgttggaggctttcacattgaattttacttattcttttgcacaatttcgaggatgaattttagagtcgatttgggacgcgacagccgccgccgctccggacttcctcccgactcggcgacccctccatccgcttcgccgtgttgccgccgaccccgtccgccgctccgcttcgcccgcagaccgtcggagcgccgtcgccatcgtcatcccgagccgcgccgccgtcttcttccgctccgtccgccattctcgtcgtcgtcgttgtcccggggtgagctgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgtgggtgcggctgacgcgcgggacccacggggccgaccgccgccagccgcgtgcgcccggtccaccgtggaccgagcggctgacgcgtgggccccacccccgtggacccggtccgcgcgtcccctccctcggctgacgcaataaataggttttttaattaaaatttaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagagtaaaagcctttttcttttccgttggtcgtgtagacgctgcagcttcagaagatccgctcttcgtggaagtcgaagccgtcgattggggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttattactaccttgttcaccctagaataaacaaaaccccaactagtggacactctatttatggttccactagtatgaatttaggtagatgcttcgctgattaataggtaacattaggaggttttacaactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtgtgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgaccatcaaaaataaacagcagcggactagcgggcctacggctccatcttcacaggcgctcaactggggtataagccataactccacctaagacctctcctccaaagcttctcttactgaagagggaaaagattgagcaagaatgagtacaaccacagtactcagcaagcc

SEQ ID NO: 79338 - DNA, 1924 bp, Oryza sativa
gcggcgcgagcgcgagatcggcgggaggagggagacgggcccgacaggtgggccccacctgtcggcgaccccgagagaggaggcggcagggcggcctggctgggcctcggcctgcggccggcccagtaaggggggggggggaaggaaggagggaatgggccggcggcccattcggaaaaaggaggaaaaagggagggaaaagaaaaagaaaaaggaaaaaggattttccccggaattaaaatattgcttgctcaattttaattggttaaaattatttctagagctctgaaaattccactaaaaatcctgttaatgagtttcgacatgtagaactaaagaaatttccacatgtcaaatccgattattatttgcattactttcttagggttttctcctgatttcaccagcattttcttagggtcatttatcaaaattacaattttggcttgggaggaaaacttcggggtgtgacatttaccttttgtataacatggttcattgcggagcaccagactgagaagtggcggagataagcccacgggggtcgctggggagtccatgccttgttttataagggggtgattatgatccaggaaaggtgcgctgtagtggattgtgttgtgcaaggggtattgtcacagctcctttccgaggtaccgtggtggtattgaggcacatggtgacatgttgtggggctgtgtcttgtgggtacagtggtacacctctggccagagtaaaaactattcgaatagccgtgcccgcggttatgggcgggttgagcaatgtttttcgtgattagtctcacacctctcacaataattatggatgttatacctggtaataatttgcttagctcctggtttggagttagatctatacagccgggtatggttgttcggaatggttgggcctgtgcagcatgggtgtgctgttcagtgttgattaaaattcctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggggaagacgtttggcttataccccagttgagctgcctgtgggagtggagccggagcttcgctagattttattttccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaggcttgccccttgcctctttgggaaaaggaagaggggagcgggggcgacgcggcagagggaggagggggctctgcctccgccccttggaggctagcaagcggagtggcgggggccgggcgatgacgacggcgatgacggcggggctgtgtggagcggagcggcgacacgggcgacaggcgcgggcaggcgcggcagagggtgacggcggcggcgaccaggcggtcggccaccacggcacgcgcgcgggcgggttgcaacgggaggcgcggcggtttgagcggcgcggctcgggcacgcgcgctggcttgcggggccgagcggatgcgcggctgcaggcgcggcagggcagcggggccgggtgacgcagacggcgcaggcgcggcacgggcggcaaccacgcgggcgcgcgcgcaaacaacgccgcgcggggccgatttcgcgggcggggagctcgccagggatggaggcggggagaaggagagcgaggggaagggagggcgctcggcgcgagcggctcacgcgcacgcgcgcgcggcgcgcgggcggagca

SEQ ID NO: 79339 - DNA, 8409 bp, Oryza sativa
tacatttcctactacttatcatatttcctctgatacttggtgataatcttagccgagttcactagaaaaccctgagttttccctccatcggctattcgaccagctgtatgtaccatattgtcaggaaaaggattgccatcaaccttcatcggcttcttggaatcatcaaacttgattttgcctccctcaatagccgcctggatctgctgtctgaagactttacaataattggtagaatgagacccagaattatgccacttgcaatacctcctcttgcctagctcttcatccgatggaattgtatgaccagcaggaagttgaatctgtttttcccgaagtaacaaaccaaagattttatcagccttggtgatgtcgaagtcatacctctcttcttttccagaactttttacccattggcatggtataaccttcttgctcctaacccactcagctgctgctacctcggaatcatcatcatcatcatcatgatcagatccatatatgtagagacagacatgattgacctttttaaagttcttcctggcttctgcaaacctctgttcatgcaaggttaccttctatgcaagatgtgacaaactatcaaagtcctgggacgagaatttctccctgatcggagctatcataccctgaaaagccaaatccgctaaatgggcatccgtcaagctcaagctgtagcacttattcctcatctctctaaacctctgaatgtagtcctgcacaggctcatcatgcctttgcctaatcgctgttaaatcagacaatttcatctcgtgaaccccactataaaagtaactatggaattgcttctccaattcggcccagctgttgatttatccatatggcaaagaagaaaaccaagtaaaagccgatccagacaaagacaaaggaaacaacctaaccctcaaggcgtcaacagccgatgcttcaccacactgagctaagaatcagctaatgtgctcataggtcgaaacactgtcttgctctgagaattttgagaaatccggaactttgaaccggttaggcaatggaaccctctcaaaccactcagggtatggatgccgatacaagtttccagtgtcctttggcttgagcccaaattgctctctcatcacctctgcaatcatatcggcccatggtccctgttgaggcaccacctacgcttgctgtggcacaggctcgaactggttgtactgaggagcaaactgaggctgagccgatcctccttgttgattctgaacttgtggcaatggaggctaatacttgtaattaaaattgcccccttgataattcttaaagtttggttgtatgttgtgcaccagatgctcgggaataacttgaggtatcaccgattgatctagttgcacattatgaaccaaatgctctgggacaacttgatttgcagcatgctgcctcgagtgattatcaggcgttctgaacccagccgatgcatttagcaaaccttgctgctgaatcggttgagcaacttgctgccttggtggcgtctgctgaatcggatgagttggtaagaacatagctgcaacttgctcttgagttagttgattcacattttgtccactatgttgtggctgctctctcaccaacaaccgaggattgattaattgccctggtgccgatgatggtgcagcaggtgcaggagccgatactggtgctgtcggttgaactaatggcgcattgggagcaattgactgagcagtctgttgattattagtgatcaagggccgataatttgggaaaacacctcctgataaataaaccggtcctatagcctgatactcagctattgtgccatcaaccatcgacttcaccatgtttgacaaagtattgactaacaccctagattgattaatcaaagcatgttgcacggcaaagtcaatcagatcttggaatttgttaaactgtagttgtgccgtgttaccatctgggctgagatcctcaccttgcactccctgagaagcatcacctttatcacctaagccatctgcagcacctttatcacctgattgagatgtaccatctgagacctgttgtacttctccatccttggaaaaacttgtcccagtgtcacatcctgattttcgttttaggatttataaattatctaataaattattattagaatttatattaaatgttcattaacttacaagtgaagttaaatgtgggaaataaaatttcctaaatttaaagcatggatggatttaatttttattaaattctccatgattaattgcactctctgaaattttctcggatttttcagagctcaattcctaaatgatacaaagaacagtttagtaattatttgatcaataatgatctaattataattgttaagagtttttccttgtttaaaaaaatccttaaattataaattgttgtttaaaaggaattattagaaatgatcttaaaagcctaaaagagaagatctaattttaatttgttaaatctgcttaattctataattcctagatttttctgggatttatttgagctaaggaagtatttttaataaatggaattacatttcatgaataatttaaattgaaaaaggtttttaaaagtctcttttggctttgggccgaaagtcggcccaaaaccttctctctctctctccccagcccaagtcggcccagtccgccgcagccgcgcgcgcgccctcgctcgctgacaggtggggcccgcctgtcaggtcgttgtcttcctccggccgccgccgcccgaaaccctagcgccgagccgccgccgtctccttctaaattcggccgatcctttccgtttccggtgaaatcaattgaggggaaatgatctttgggatcttctctaccttttctcttttggaatcatcctctaaatcgctttggaagttcgtggattcgaggtcgaatcggatcggtctctttcctctgaaccccgaggtttccttcgcgtcgccggtcgccgtgggccttcgccgccgcctccttgcccctataaaaggatccccggtgtctcctctacccgccgccaccctcgccttcgtctctcgccgtcggaagcgccctagcaccgtgtaaccttgtgccgttgtcgtcgccgtcgctccagccgtgcttcgccgtcgctccagccgtcgtcggtcgccgtcaccaccatcgggttcgcgaggtcgtcgccgtccccgtccaccgcttcgctgccgccgaagaccgccggagcaccgccgtcgtcgtcgacccgaagactgccgccgcttcttcctcgtcgccgccgccgtccgttgctcttccaccgtggttttggtcaccggtgagttcgccgcgtcgccctctacccgttggtgccctccgtacgcgtcctcgcgccgtcgttcgccggcgagcatgcgttgccgagccgccgccggtgctgacgtcatcgctgacatcgtcgctgacgtcatcgtcgctgtccccgtagacccgtcgtgaaccgatcgatctcggccgtccgttttggatggatcgatctcggccgttctttcccgtgaaccgctgccgtgcgcctggtccaccgcaaaccctagccgctgacgcaataattcccttttccttttcaaaaataattcattattgcgtcataattcaattaaaatcaatataagtgttttaatccgatttaatcttcaaaaattcataactaattcatcttagctcggatttagttggttcaagtctctaaatttttctaaaattgagatctacatgttaaaaatatccacatgtactgttcatgcttgtctatgtgctgttttggtgattttgctcttttctgtttagattccgacgtttccggagagtccgttttcgcaggagaagactttgaagagttccaaggccagcaaggcaagtcacacagatcccaaacaaccctttgagcatgttgatcccatttaaagctattgtttctattcaactattgcatttattttcgaatgtcattgggtggaattaacctattgtttgttatagcccttttgttcttgattactttattccttgataccatgggttattataattcgactagttggatttatatattggttcaactagatgtattagatataattgcttagccatgcttagaaacattagcacacaattgggataactaatgtttcactactacttaatgatggacttgataatggtagctcacgatggtcaatcgtgattggatagttaattaatgtgccaactaaaacttgataatggtgggttgtgagcacctggttttgatggtcgtactcatgacaattaaggaccggttcacgagtttcggttgtgaaacattaaccgtgccaaccacaagccagcgtgggcaacggctttaccttttgtatagcatggttcattgcggggcaagtggaggagataagcccacgggggtcgctggggagtccatgccttgtttataagggggtgattatgatccaggaaaggtgcgctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtttttcgtgattagtctcacacttctcatcataatagaagatgctatatctggtaataatttgattagctcctggtttggaatggtatattcctggtttggagatagatctgtacagccgggtatggttgttcagaatggttgggcctatgcaacagggtatgttgtatagcgttgattaatattgtttaattattacttaactgttttattaaattctcaaatgtttgctaaatgctgctttcgcaaatgaaaccctactatgccatcctttggtatccttgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcccacacatgtaagcgtttggaattttggatagaaattccgggcgtgacacccaggaacatcaacagctaatttcatcttgtacctctgaacaattgttcctccacgggtctccatgaatgagttcaagaactggttctgtgtttgctgcatcatcacctcgagatccttcttttgttcaggtgtcaatttgtctatagtgatgagcacgatgttgctctcatgaacttcagacacaccaagcttagggatcctagatttgggaggaccctctttgccagccgaagacggcgttgctggtggtttctcaaccatgagagaacgctattgcggttctgacttctagtcggtcccaacgggcgtgccaaaagcgtgttgatgtaaaaacacgaggcctgggagatctgcttaactccattgcaggtccaaaacttgcctttgggtgtgtgagcgtgccagttgatttgatcctgcaagcaacaagaaactaagacaaagaaaccacggttaaatccataaacgatagccgatcggctagtcgccgatgacatatcatttatctttgagccgatgtcatatatgcatcgatcggcagtcattaataagtaagaaagaactaaatctactcaatcggctgtagatattaacaatatataatccttatatcgatatatacttaaatcaagtgattggaatagatcggtcgcatgccaagacagtataaatcacttagatcaaaatatatactaataataagactatatatgttcatagcatagccgatcagatagatgtagcatgtatcagctaatactccaataccactctatattaagagagtaaagcaagtagaatataccaaacgaaagcctaatatacttaaatgcgacaagatctcaacataaagggcaaatttaacatgtcaatcgagcatataagataaatgtagttagatcaggtaagatcggctgaaaccctgatgctaccctaatcagcaaccaaaagcaggctagagattgagattctaatcacgacttataaggtcaaactcaactggtagatatcctatataatctaagtcaacatcggtatttcacctaatcggctaccttctattgacagatgttagccgattgtaagttagatggcgatattgccggagattatataagataaatgataattcgacgaattacataaacaagattagagtataatgaagatgaaagcactaatcccgataacaaaagccgccataacaagttttacctcttgttgaagatcgaaaccgatgcaactcaacctgaaagcaagaactcgtcgaaacaaaacgaaagtaaaagggtggcgatgcgctgagattgtattaaacgtgtgttttttattacatggggctctgggtctatttatacccaatattacaaaatatgtccatatcaaactcgactcttatctctacaaactctaaaataccataagtctttgcggaagactttttcccaaacatatctctaaggaaattacataaaatatcctaattaatagatacaattgccttctcaggactctatccatgcatggcaatcatcatgaagtaaatcaacctaacccgacaacgtatgccgtgtcatattgtcggattcggctcaatcggctaaccctgtccaactcggactctgtcgatcctggtcacagccgattcggactccagccgatccttactctgtttccgggaagatctccatctcgaagtccatctcgatttcttcttcatctccgatccttggattaccaaatttggtcgttaacacctgggcatcgttgtttccttctccaggaaattctgcatgaatttcaccaggctgtccgttttgggtggctccacttcgaccacttgaatattctgcggttttggcccgtactttatcttgaccacggagcattgttccgtcctcggttgaaactcaaacttttcttccttcccgttgatgtggaaactgatactccccgttcctacgtcaatgtaggctcctgcggtgctaaggaacgggcgccccgggatgagcggcgtctcttttcccatgtccatgtccagcactacgaaatcaaccaggatgaagaaatcccatatcttgactagcacatcctctgctatccctgccgggtaacgaactgacgagtcagccatttgaagttgatcttgtcgaagacgtcttttggcatgacgctgacactggctccaaggtcgcacaaggcttggtcgaactgttgtgccccgatcgagcaggtgatcgtaggacaccccggatccttcttctttttcgggagcttgtggagtattacgttgctgcattgatccgtcagcttgaccacctccgttgttgggagcggtctcttgttgttgagtatgtccttgagataacgggcgtatgttggcacttgcatagcgtccaacaacggcacgttgatgtggatcttctggattacttcaacaaaacgagcgaattgctcgtccactaacggtttcctactccgttggggaaacggcagcaaccgtgtgttgcagtactcctatggcactgtcttttctagctgaacttccttgtcagccgagtcactagatggtgcttccttggttatcccattggttcctgcagggttaggatacagcggatcacgagtggacttacctcccctcgtcgtgattgccataacattttcaatggaggagtcgggttgccccggaatcctcctagtttcatttgcagggactaaggatgccaactgagctagctgtgattctatcattttattaaagctcagctgattttgaaaagcagaagcaaagccatctaacttgacattaatgttctttaggatattgtcattggcagcaagctttttgcttagcgcatcagtagttttagcttgcgcaaaaacgagatccttcaaggagggctggttagaaaagttaccgttgttgttacctccttgataatatgggcgtggttggttccaccccttacctccttgtggacggtacccattgttgcccatgtacatcgcctcctcacgggtttttcggcagtcattcccagaatgacccgtgccgccgcagacctcacacgtgacgt

SEQ ID NO: 79340 - DNA, 2813 bp, Oryza sativa
gtttccaaaatagcttgagcaactaaacgtcttcaaatgctgttaactgcaactctacccccttatattataattccccttgtactcccttgcatttattctgcatttgtgggtgtgtcttgttaagtacggtggttgtactcagtcttctttattttccccaagcccagatgaggagctccttaaagatgaaggcttcggtgtatagctcgtgcctgccgtcaagcgcctgtggtcttcgccctagtcttccgctgtttttcgttgtctttgtgtgctgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaaaacacgaggcctgggagatctgcttaactctagtgcaggtccaaagcttgccttcggatgtatgagcgtgccagttgatttgatcctgtaatcaacaagagatagaacaaagaaaccgcaattaatcctataaatgatagccgatcggctagatgccgatgacatatcttttatttcaagccgatgtcatgcgtacatcgatcgacaaatatcaggcgcttgacggcaggcacgagctagaaaccaaagccttcatcttccaggagctcctcttctgggtttgggaaaaattgagcaagactgagtacaaccaccgtacccaacaagtcacacccacaagtgcagaataaatgaaagggagtacaagggggttataatataaagggttagggtttgcagtaaacagcattaaaagacacttagttgctcaaagctattttgtaaacacggtcctggagctatacaatattattaatcaaggccgtgaacccacacgagcctgccttaacccaaggcctctgatgattcagaccgaactggcaacccgaccctgggtcccagctcgtcccaatccaacccaggccatccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacgtacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattctgaatagaggggggcggtgtgaatccaattccacaatatttaaaccattccatagtgtccaggtgatgagaaaattcccaaagtctagagttgtaaaaccacctaatgttacctaattaaacagcgtaccatctacctaaactcatgctagtgataccatgagtagagtgtccactagttggggttttgtttattctagggtgaacaaggaaataataacaataacaataataaggtcataacaaaggtaaataggcatggctagataaaacagtgatagcgcgggaatttaaataaagcgataatgcaataatttaaatcaaaataattttataaaccgggattcaatatgttcaaggatgatgtgacttgccttgctcgctttcccaaatgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaatggatttattgcgtcagccgaggggaggggcgcgcggaccgggtccacgggagtggggcccacgcggcagccccacggtccacggtggaccgggcgcacacgggctcgcaccggccggcgccgtgggccccacgcgtcagccgcgcccgagggcgcgggcggctgacggccgggccccacgcggcagccgcggggcgcgcccgaaggcggccacgccggcacagccgacgggaggcggcgcgcccgcgcccctatggtcgccggcagcggccataggcacggcggagcggcggccgacagaggggaaggaaggggggaaacgaagcggcggtccacggctcaccccgggtcgacggcgacgacggaaacggcgaccggagcggaggaaggcggcggcgcggctcgggtggacggggtcggcggtgctccggcggtcggcgagcgaaacggaggggtggacgaggtcggcgaggatgcggcgaagccgaaggaggcggcgccgagggggaaggtggtccggggcgacgacggcagcggaccggagctcggcggcga

SEQ ID NO: 79341 - DNA, 43089 bp, Oryza sativa
  unsure (1)..(43089): unsure at all n locations
agagtcgacctgcaggcatgcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcaaggctgggagagaaggcgctacccttatttaagcttctcaaaagctccgggccgtttacttggacagaggaagctgaacgtgccctcactcagttgaaggcgtatctcagctctcccccagttctggtcgccccagagccaaatgaatccttgctactctacttagcggcgaccccgcaagtggttagtgcggcgttggttgtggagcgcgatgaggacaatcctcattccgcgcacccccaccctgtgctggcttggcccgggagagagcagcgaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctaaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacgggcccgaggccactgtgggaaggccgcccctgtcgtcctccgaccccgaggtcgtcggcacagaagacaagtgcaccccgcgaggccgcttggacaaagagcgccccaaggatgtggcccctagcgaagaggatcggccccaccgaaaggtgcagcggcccatctactttgttagtgaggccctccgggacgccaagacccgataccctcaggcccagaagatgctttacgctattctgatggcttcgaggaaactgcgccattatttccaagcgcatcgggtcacggtggttacgtcttaccccctcggccaaatcttgcataatcgagagggtactggacgggtggtgaaatgggcaatcgaactttctgagtttgatttgcactttgaaccacgccacgctatcaagagccaggccctcgccgattttgtggcagagtggaccccagctcccgagcccgtctcagtccccgaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtttgtaaggagtaccggtgctctgacccgcagatggacgcttacgtgtgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgaccccttaggggagacggacgcgcctgacaggcccccgatgcccgtcggagtccaggcctcgggacccgaggggagcgctcccagctcccttagattgattgcttggatcgctgagatctaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggttgacctggtccggcgatgcagagcgtgtcaattccacgccaagcaaatccatcagccggcccagaccctgcagatcataccactttcatggccatttgctgtctgggggctcgatatcctgggaccgtttaggcgggccccgggcgggtttgagtatctgtatgtcgcaatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacaccaagccgagcaaccggggaaacgcctttcttcctcgtctatggcgcggaagcggttctcccatccgagctcaccctgaggtcccctcgggccaccatgtactgtgaggctgattaagatcagcttcgcagagatgacctcgactacctggaggagcgaaggcggcgcgcggccctccgagccgcgcgctaccagcagagcctgcggcgctaccatcagcgccacgtccgggctcgatcactctgcgtcgacgacctcgtcctacgccgcgtccaaacgcgtgctggattgagcaagctctcaccaatgtgggagggtccgtatcgagtgatcggtgtcccccggccgggctccgttcggctggccacgagcgacggcacagagctgcctaacccgtggaacatcgaacaccttcgtcgcttctacccctaagggggatcgggtgtcaggtttcgggctcgggccaacctcgcacccccctcgggcgtgcagggttggccgggggctaccacacatgcatattcttatttctcttatatctgtatctcaataaaagcatttttcgatttcttaaaggctgtatctgttctgttatttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagtcaagacacaaaaggaccgcggcacagacatcctcgtctcatacacacaacaaatataattgacacaaaaaatttcctctttatttgattgcagattaaattagtctatacaagaagggggcccgaaggcctcggaagaagaaaagaaaaaactatttaaagattggcgggggcctgggggctcactccgatgcacccgggtcgccagcctcgtcgccactgtcgcccacaccgccgtcatcgccctcctcgtcggagctgagggcgaacgcgagccgaggggccgaaccctcgaagctgtggacgatatggtcggcggcatcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcccctcgagctcctcggggagccgctggagagtcctggccatctccgagaggcgctgggcgaggcccccctggttggcggcgtacttcacagtccgcccgccccagagacccgcctgccgcccagcgcggtctaaacgggacacggcgtcgcgaagcatgctgggccctatctcgcctgccaggcgaagggcctcgacctccccggtggacgaatccagcgcgccctgcagatccgcgatggtgtgttcggtagctgcgaggcgggcggctaagtcgctgtcgcccgtggccgccccgccgctacgcgcccttgcatccagctcccttgcctgcgcctcgagttcagcggcccgctggttcagtgcggccctctcggcgcgggcactttccagattgcgacgcgcttgttcctcttgcacagcctcgcggagggataggttgtccgccagccgttgcgccgcggcctcggcctcctcgagagcttgctcccgctcggtgagcgcgtcctcgcggaggcggagcgcggactcttcttcggcacaggcggcttcgtgcaccgcagcgtgacctcccgaatagcaatggcggcctcgcggtctgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccatattgaaggcggagggtgtcctgcgcctcgttcatcatggtgatggcgatgagggcagccccccgctcctcctccacctccttggcgatctcccccagcaccttccgacgggcttcgagctctgtgacgtgccggcggtgtgccttgcggcccacctccaccatggcctccaccgagcgtcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcagaagttgtcgccgcctcggcctggcgaagtctggcctcctcctgagcggcttcttcagcttggcgagctcgggcggccacctgggcggcctcctcggcttcccgtaggcgatccgcggcttctcgccggtcagattcccgcctccgagcctctgtggtcgccgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggagccgtttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcggccgctccccgggcccccgtcgcggggcccataagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccatggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaattccagaacatccatgaagaaagaagaaaatggcggaaccagccctgccatagcaaaagggaggaagaagacagaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgtccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcatgacgccgggggctactgtcggtgacatgggaccgggagtatcgtgacttagagacttgaggcagaaacgatcacccacgtggcctagcctcctcgggggggatcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgctaggcttcatcctaaccattacaggcaagatattgtatgaagaagggcgaacatgtagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcaaccatacaagtctccgtctgtttatgaataaaataggataagtccccacaaaaaagagagagatggtgcatgtggtatccccttgaggtataaaaggaggaccttgcccacttagaaaagggggatttgaaaaaagaaaggaaaaaacgatcccagaacgatcgggggctggctcgcactttgtagcttcttcatacacagatccaccaaaacacaggagtagggtattacgcttctcagtggcccgaacctatatacgtcgcccgtgtcttgtgtgtttccactcttgcgaactttccataggctaggagcttagaacctcacccagggcccccggccgaaccggcaaagggaggcctgcgcggtctcccggtgaggagccccaagctccgtcaaggcctatctcggaagtgtctccctccatctccacgaattagcacttaaccctagctttattttcctctataaatagctttgtacatcctcaaaaatatttgggttttgtttagttgaattttgccaagtgccattcaccttgtctctagtcctcgctcgattagtcggcgactattgattcagagcccccaatagttggtgtgttgatttgccgggtcgattagatctaccattttaatcgcaactattcctctgtgcttaatcacccattcgcaatatttagattgtatcttatcttgttcttgcagtgttctctcgtttgcattgcaggaatcatcaaccgcgcgtcacggttggtacgacatcgtttgtggagtagcgattgcatggcgtcctggacttgttctggttggtagccacgtcgcaaacgtcgcactcgatcaaagcgagagttattccctcaccagaagatcgggccacgagagagagcgtcatcagttggtatcagatcctcaattgcctggtgaggattttagttttatagatttatttttcctacctatccatctacaaacttgccgcaccacttttccctttaccaaactataggtttgtgctttgcaaatttctttcagctttgtgtcgttgaattctagtccgtggtcgctctgaatcaacacaaatcggagttggcatgaaggcgctagatccgtttgaagtcagtgctgtctccggaggctgaactagacttggacttggaattatcattggagcgtgtgaagttatgagcgtatccgacaaagtgatgtcctcatcacacagagagcaatacatcataagatgactgacaacatatatgcacgtacaactctgtcatatatatatatgcagtagaagacactgactgacgaatacagcacataactgaataatgaacctgcatgccaggctaatggaggactaaacacacgaatacaacactggctagatcagtgctttgcttatgttattgctaggacaaggcgagacacaagatctgtttctattcttttttgaacgagagtacatctgctactactgaactggagtatatatacacgatacgagcagcaataatacaatacgagtcactgaactagaacactcagacttgtagataaataagattaagagattagctcaaagctcaaagcttatagtgggattgcagcgtaccgtccaacctcgagcgagcaatacaccctcgatcgatcgatcgatccatcggtgttagttatatagactgaacctgagaaggggcttgtttgggtttgggtggttggcaagctgctcctccacgtctttcacaaagtcgtccctgtactgcctctgcctaccactcagcatgaattccctgagattttcgagctcttctagccccgacgaaaatccaacgcgtgagccaatgaaatgactaaactgcagcagctcaagcttgggggttgcgcctcctccaaactgcactgattcgaggcggtcatgactacatatcctacttacctccaacaccctcaggctcgggaacaatactactgcggtggcctcctgctgctcctggcggaagttgagacagaccacatgatcgttgaacgaatgctcccacaggcgcaggatggccagccttggcagtgtcccgaggactttgatggcggcatcggcatcctccagttcggtccacatcagtctcagcttcacgagattctggagctttccgatccactgtggcagtttgcctagcgcaccctgcagcttgaggctctgcaagttctccggaggaggcgaggttgacgacgacgacgacgtgccatgtaggccttgacaccaacctgcacacaccgacaatgactctagctggctgagcttggagatggctgaatagaaggatggaccattcttcttgttgatgcccaccacgcctaacttacgcagctgggtgagtctctctatctcttgtataacagtgtttccccacgccaagtgcacgtgtcggagtgtatgcaggctttttagtttcctgctccctcgtggtagcatagggaaatcattatctaagtccatcatgagaacacggggctggatgcagcaattgtagttgcaagcatcacgcctgttgaagtctcccacgagacgaggtacgtagcatgcgcagcatgctccagtacaaagctctagacttctctctgctatactttgctgacccacaattccgattttaccagcgtggagatattttagcttccgaagcttcacgatggttttcggcagcatcgctataaacgtgcttctaatgtctagtgtctcaagttgcctcaagtcacacaacaaatctggcaggtgacaaatgttgtgacattctcttagagaaaggtaccttaggtgaacaagctttccaatgtgctcaaggtggtgatcaactagaccttcagtgtcttccaagtcgagcactcgtagcatcctcatcttttcagaaacgaaaaaaggtttccattttccaaacaccgttaatgaccttacacgggacaggtccactgtgttctcaaactcatgtttgtctccttcccaattactgcttatggcaagatgacgggctgtgccctgtgtctttgagctgcaacctttctccagcctaagtacaaggttttcctccattgactttgtgatgctgatttcacgcatgagatcatgtagctggcaatagtctattcctccctcaggtctacttgcgttttgagcaaccggtagtgtcatgctcctacttatgagctcaatgaagttgtcatgagctatttcgattggagatttgccacgtgcctccgttgtgtaaccctcagcagtccatcgctgcatcaaacgttttcggctaaccttgtggtcttcggggaagatggacagatacaagaaacatgacttgagtttgtatggtaaaccatcgtagcttttcagcaggactgtgctaatggtcttgagttctggattcatctcaagctcagcactaatatgctcatttatcttcctccacgccaaagcagtctttggttggtttgccaagaaaccacctatggtgactattgcaaggggaagtccattacacttcttcaagatcagattcgcttgttcaactaagtaaggatattgttcatccaaatttgtcttttccttgaatacctgaaagtgagacagtttgaagtcctttagtactgcatgccaaataaattaaattaattacttatgcacatatgcgtgtactaagttaatgaattcaaacgttttgacgaggacaattgccatttattttgtaaatgcacatatgttagctagagaatgaaaggctgcttctggaacagtgcatgacggggcaggattcttcaaacagaatctggacttttaatgaaaatacctccttaccttgcttgctttggagatggtggtattttcgaaataaaatcaatgcaggggaaataatgctatcaattgatggaatttttcaagatgtcaggttccatcttgctgaacaagagaggatgagaaagaagaagggaggtgatagacaggaaagagcgcaaagatggaacttgccaccagtcggattctacaaggtaaatgtggaggtggatgggtttttgttgctaggaatgacacaggggaattcctagaggcggggggctggtaatcttgaacatgctgctagcgcattagggcagtcccaaccctccatctaggatggtgtctatggcattaactacattgccatgtaggatttttagcttatgtggcactatattaattaagagagagagtgaagagagaaagaaactgggtctcatgcaagacacagcttcaacacaagaacctatgcactagacactatcaagttttgcattgggagagaataatgccttcataatagatgaagaataaatatgattggtagagaagagagatgatgtatttattaatggcccactttaagaaaccatgggttgtagagtgtagtttctattgtgatgtcttattgacatggcaccatagacactacttatggacaccatgggttgggacttcccttacaggggaagctatggcgatgatgaatagtttggactttggagaaagtggcgcaactcggtatggcaagaatcattgttgaaacagatgcgaccaacctgggacgagcaattacattgcatgcgttggactgcagcccctatggagctctgttcaagaagattagggcttttttaagtatttctttgatcagttcattgcatttgtttgccctagaacttgtaataaggcggctgattgtctggcctccttcatcgctgttgccgtggactctgtctcaccatgtttttggagccaaagccccggagtttgtagctggtttactctttggtgatttttctagagctactggttaattgaaggtgaactccttcgtgtaaaaaaagttagttaatgaattctctacacctcttccatgttttgtttccgttttgtggtgatctcttccaccttgttaacaaccgagggctgttgacatcacgtttggcttcgagacacatgactttcgatctcttaggtgttttttcttttcatcaatcaagttgtctaattaatttccattttctttagttaggttctctatcatatctatctatcatattacgaagatagctcgaaaaggagacacatgtttgctacagagactaaaaattctaaagaaaatgaaaaggattgagtctcctagtttttattacttaagttcttataatgggatctgatagaccttctcatataataaatagcctttggtgaagatcaataataaggcaaattcattataagtaagtctcctacaaattttgtctgatgcataacatcgatctttctgtccaacaagtcaacattcgaggaagatatatcaataaattaaggagatgggtattataaataaatatcatatggttccctttcttcgagaaattgcagctttgccacgtaattggatggtatccttcttcaactatgtcaaggatatcgccttttctcttttgacatatagttggagggataatctcatttgctaattttaccgaactgcccctttcttcctcagccagttgttcgcacaaccttgtgtgcattgctccctgctacttgcatggcaccattgctgctcgagctacatgagccaatgccacttcctgtttgttgtcactgattattattactacccatcatctctgcccccgctctctcgtaggtggggctaacaaggtcatcagaactagccttgagagagagagagagagagagagagagagagagagtcggaggaagaagagggtgaatatgtaactaactaaggtccataccctttgaaaataagtcaacattcttgaaatttacttatgactttgtcctaacaatgtgcccgtcaaatatggatatggtcttcatgttaggaggcacacatcggtatgggcgatacgtgatgtgcacaatcgatttaattttgtagtgtcacttttggattagataaaatcctatgattaagcgaaatcacttacttaaaatcaacaaaaggagaatctttcgagaatttaaaacaaccaaacttaagatttatgaagtaagaatgtgttcactttgttgcaatgttcaacttcagcattaacaacactgaaaaaggcaacatacaaaacacactattactaacacaagcctatcagatttatgggtctatttagttttgttgccatttttcaactttatcaaactttggtaatgccaaattatggtatcactaaattttggtagggtaaaagaaggttgggtagtgttttttggtagaattttgatggtataaagttgtggagttactaagatttggtagaattttgttggtaatagtgtgtttaatttgttggctttgtaatttcagaactttccaaactcaatattctaccaaaatttggtaaggccctaattataccaaacactacataattttaccaaattttttccaacaaagtgaacacaccctaaatattccattggcaaacgatcgaatggtcttcctgttaaaaataatcctcgaatagtctcaagtatcactttaactttctgattggtgttcatagttttgttcacatttgttttcgctaaccttggatacagtagatggtatatatatttgatttccatctttaatcccaaaacttgtggattacgggctttactaaaacttgtgcgtgtgtgtgcatattgccttttcaaccttatcaattttgacattactaatatttgcaaggaaacgaaccaacacaccattgtcatcgctaccctactggtaattttggaaccttttactctagaaaactctttacgaaaattttgtaaagcctcaaatcaaactccacctaatctttctatatcctaccaaaatttgggcattaccaaagttagaaaaggttgaaagtagcaaaaaaatgaaatacatggcctacaaacatttattatatgatatggttgcatcactatattatttgattatttccatagaaaaaggttctgcttacaaaatgtgcatgatgatatttaccaaagcaaagcatgctcagtaattgtgattaaaatgcagtaatatcaagcgaaacaattagcagcgcatggcataccatttcagtacctctttcgtgagtagatcatgtgcttgattattgtctagcccaccgagctcgtatatattatttatttcttttggatatgtaataacaactgaaattgttaatagcgcattgtagtagtgctatttcattcgtacctttttagtgaagagttggagtgcttgatcattttctattccgctgagcttgtatatatgtgcattagttgtttcttttgaacaatgcttagcaatattctcttcccttgtggtgactatgatgcagcttccagctttgttgggaaattgtgccaccatatcatcccattccttggtatcccatagatcatcgagaacaaccaaatagctctttctttctaagagttcggacaaatctctcttttcctcatttccaaactgcttagctaagctgtgaatgagttgcccagagttaaaagggcgcaatactgtaacacaagcacgtgcatcaaaataactgctaacatcttgacttcgatatatatcttggactagagcgggttttccaaggccacccattccccaaatagagatcacttgagattgttgactcacttggtttttaattagcttgataatgtcagatttttcttttgcacgaccgatgagctgagattcctccaaggttgataccatcgtctcagtgcgaccaagctttttattagctgtgagattgttgttaccattactcgtggttatgtttgagctagaacttggctccactaagagtgttccgtcttgagaaccctacacacaagtgagttgttaggtatatatatacccttcctttaccaaaaacaatatttttcttgtgtttaaagcttgtaaatttatttataaggccttttttggcaggccacaaatcttggcccatccctcatggaatcctggcccacccatggagaatgggatgggaatgaggcctgccaaataaggcctaaaatattttgactatgaaaaactaaataaataatgtttgtatggtttggatctcagaggaattacatatctggtgacaatattgctggatcaatgaaagaaatagctttaggtaggccagggatatgaacaaagccacaaaatttgcacactcaatgcattaaaaaaaacttccatagttgaagttattttgcaacatgatgataaatttcataattttttccatgatgcatatagtgacaacaagtttgtttagggtttttatctatctactctttccatcttaaaatatagctatatttaggatttttttagggattaactattaaggaaaagtggaaaatcgaatcggataatgttgtgaccagttgatatgagaaaacatgtggagaaagtagtcatattttaagataaattttgaatgctaaatgcattatatgttgggggccaagaagtatttatcaagacacatttatcaacatctaacaactctcaagtctataattttatttttgtatgacacaagtaatactctaaatctctaacttgaaaaataaaaggaataaatttcatagaaccacatatactttggttaaattatcacaaaactgcagatttaagataatgtataaaaaaactacagatttaacacaaaatttattggataactacaaatttaacatgaaatttatcacagaactataagtggagtatttatgtttatcaagtacgggattaccggtttgtctccttaataaagaattgaggaatatgaggtgaatcccctaggaaacaactagagtttttcagattcactggacagagaatagtatcctctcacactaggtcatatttttcttcctcgttaagcaagaaagaaaggagagttttcacaagaaagaactacgatcagttttggagggctatcttaccgaccatcacttctcctttgtatgtgctgaagacgcaagtagcccaatgacaggcatgtgttggaggacaacatgcataggtcttttggcaaaattgggggcttgttgatctgaccgtcaatggtggcgagaattttgcatttggcctcaactattatgcagtatgccccaaatcgacttccaccactccctaatcggattagggatggagcgatgattagggcagcggcgcagtgcaatttgaaagtggtggagtcgatatgagataatgtagcggaggagtctaaatgcaatattctcgctatagtggatggccactttagcgcccgagccatatcatgtgcactttgaactttgggtggtacattaaaccaagattttatatctaaatgtgtattttataagtttatgaaattagatgacaccttgatacaagtttaagagccaatcatacattttttttaaagaaaagatgatagaacatgggtaccagcatgtcaactatagtatgttgggccggatgaaagtggcgccgacgtgtgagacgacttctatgagactacgacggtaattgtagttaactgggaccaactaagtaatcagtatatcttgtatatttgctagtattctaggtttgaatgaaatttaactacattagaagttgagctagatgaataactagctaggttgtactgactaactagatgattttagtagtttaaaatttacctccccatttagtttcaaaaagaaaaaaaaggttaccttctcatagaaagcatagataatctgatcatcgagcaatttcttgtgctctgggggtacactgtcttgcggtacacatagtctggcaacttcaacatgctctgtgcacaatatgattcggctccctctatcattgcttgggaagcatatttttatcttattccactcttccagagaggataagtcagtaagcacaatcaagtaactcttctcattcagatatccctcaaatgcactcaccaaatcatcttcctccatgtttcccatcttctgtagaattcggtccactaaatcagttgcttccattttaaattccctagtctcttgaagagaattctcgtacaattgcctgctaatgctctgcagcaaccatgtttgattgcaaagactttttagcctgatccaagcgtagcactcaaacttcctcatcttgagatcatcataggcccttctgataatagatttatcatcgagaagaccattttttctccataccccgatcactctaagctccttgtcattggtgttgatcagtccaacaagatccattttagctttgtcctgttgccgccttgtttcttccaattcagacatggtcgttgcaccggcaatcctagactgcatgccatcagttgccttggaggcagaaccatcgatgaggcggtagcggttgttcctctggctgacatcctcaaccttggctcttagctccttcatcttctgagccacacgacgccgctcaagcagcattcttgggctgcacttgcgccaccaagatggcttcccgacacggacggccatgtcctggaggcagtcctcgacatcgtaggcgacatcacggacctgctgcacccaggccttgacaaccttgtgcttgtcacgctcctcgtccgcggccatgaggaaggcctgcatcatatggagctcgtccctgataaaggcatggtcccgcttgatgccgagctgcaggcccacctcctccgcgacagcggattgggcgtagccaagcgctccactcagcacggacttgccaaggctcagcaccgtcgactccatcaccaccctggctctctctccctctccacacactgtacacacccaactcttggttgatttgtgcagattctgtggttgaggaagttgcagcaggcagctagcgcaatgagagaccaacagagtgatgaacgactataaacatatgttgcagggaaagtaaaggcctttaatttagaagatgcccaccttgcttgctgcttttacgttgtgttcatccaggcaaagcaagagatcgtatgatactttagctagatatctttgcgtgctctcattctccaaggatagattctgattaaggacaacatacatgatgcattccctccccaagtaagatcatgaccctcctctgtactgtacattacttgcccccaaggtttgggattttttttgtccgagtatttcttcaagtttcttatacatgttacgatacggcaggcagacaaaattgcaggatcaagctgctttgttcttgcaattcgtcaggctttcagagaagttcattatctcacaaaagagaaggagctagtccgatcgatacatcggaggacgaataaagatagagcaaaaagctcaaggcacattctaattagatgccatctttccgaactattttaattatttgtcatctggatccgatccactggtttgttgctattttgccatttttgctatctacgcagcaaaccgtgtacaaaagacctcattgcctctgatctcgttcctcctatctgtcttcttccctggagctccatgtctccatgattcagcacaaataaacatgcaaagctcaagctcatggcatcaacagaggaaagaaacaagaaatgaaatacgggcaggcatattatctatacaaccaaatagtaccagcgtacgtaggctgcgtagaacaggatggatgatggatcatcataatcaaagctcaagctccagctctttttcttcttcatcatctctaattacatttgtgcagaaaccaaacttgattgttaggcggtaaactgctactccccctgttttatattataagtcgtttgactttttttcttagttaaaatattttcggtttgatcaaatttataaaaaaaatttagcaacatcattaaatttaatattgaatatattttaataatatgtttattttgtattaaaaatgttagtatattcttttacaaatttgatcaaacttagaaaagtttgaccaagaggtcaaacaactaaattggtgtgttcttacccaagtttccaacacatctcactcgttttccgcgcgcacgttttcaaactactaaacggtgcgtttttagcaaaaattttctatgcgaaagttgcttaaaaattatattgatctatgtttgaaaaaaatagctaatatttaattaatcacgtgctaatggaccatttcgttttccgtgctcactgtgctcgatgagaactagaaccagcgaacacacccttagagtagtctactactgctattagtagcacagagacagagacaaagtcacattacaaacgttacagctaagacaagaacaagaacagctactacaccacaagacaatattattagcttcggtgattcgatttccctgccatagcgccaggagaaaaaaaggggaaggaattgctgccccatcattgcctgattaatcttttcgttcttgatttgaaaccattagcacggggcgacggtgacagaggataccattagcacgatgcagtgcaaaggacatagatgatttgcattcattcggaactctgttgggagaggaaggcgttacacggttctagctcagattagagtactgcctcgaagcaaatcttaaccccatgactacaacctaacagaagagatgacactacattaagttccaacaatgtcttcatcacatgaggatcagaaaactgccatgttgggttctgacccggcaggttgtgaacactgtcatattctgaatgtgtgccgggggatgatgaacagaggacttgctgagaatacccaaggtggatgtctcctcctgactgtgtgccgaagcaagaggaggaggtaggaagtctttcccccatgaaggatggctggtatgcctagaaacacaggcaatgactaattatatatgatgaactcaaacaatcattttatttgaacggttcagttttatttttcaatatagaattgaatggctaattagttgcttgtggaacttttggacttcttagttaaataattttaaagtggtgaacatgatcaattagcttttaaacaagtatggttcacaaaacccccggtaaacagtgaaaaactcattcaaaaaccatactttgatgcaaatttcggtttccattttttttttggcaaaaaccagagcttatcacataaactgccaaaacaggggtagcgtattcagggagccatcgtttttttgtaaaccatgagtatggatgtgcagaacaagtggcaaaattactagtaagaacacataaattgcacaagtaatttcggtaaggtgatcggctacctgtttttatcatagaagttgcaagcgagacgctaggtagtacaccagtggacccaagggtcaagtaggcgtgtatggtcactgcaaattaaggcacattctaatttatctttctatatgacgatgagaaaatgcacacatgggtaagccaaatggaatactacaacatacctcaggacactatcgaggaacatcaagttacccagtagtatgtctaggacaggattgaagcatctctctgtggaggccaatagccttcgatattctcagtttagcctaaaaaacaagaagtctcattaaaaatatcaaaagtcaattaactagagaacaggtttgtgcatataccattcttaatatcaggtacagttacttatactttgatcgttttctccaatcatctggaggcaataagcatgtcgagaaagctttcaaagaaaaaggatcatgcttttcaaaggaatacggtccaattgccttcactttcttccttctaagatcaatagctaccatctttcccttacccaagctagccttagatctcatgtacacaacatcaccatcatccacacccagggttggagaagctaaattctctgcaagatttggacttaaccctgatatgtcaacagcatcaacctcacaacctttttcccaacagttggacgaaacatgccgactccatgacacaatcctccaaccatcctttctctgcagctgctggggtttcttgttcaaatctttgaggttatatgacactatcaggtcagtgtcgtaaagaacttgcattttgctgggatcacttggcttctcagttgttacgatcacacggtgttccatctcgacgaagctcatcacaccgtcgacgcacacgagatcacggaacgacttagccaaagttcctgggagaaactccttcaatctgtaccagttctgaggcagcggcgcgggtagaggaacgtagcgtaaaccggggacatcttcacgcaggtcgcaaaccatcacgccgtgatcgagatcaacccatcccagcacaccttccgcgatcgtgatcaccttggttgcaataaccttcctaacctccgggtacggatcgaccatcggaatgactctccagttagtgtccttggatgaatagatgtgcatcgaatacgaacacttcatcggtgaccgataatcgacgacgagagcagctagatcgaaatgtttaccaccatttgggacgataccgaactcctcgattaccggtagaggataaacatgaggaagtggaacctgctccagcgacgacgaccacgactcgccattgtcaccatagccatgtagcttatacatcaaatagtcgtatctctcgctgccgcgagggcttgcgagagcagtgaggaggatgaacgagccttctgctccgacaattttggcatcgagttcgtcgaagttgttgtacctagggtgggaggagtagtggcagtggaacgataggtaggagattgccggaggttgggagatccaggaagataccttgatggtgtggcctctgctggatgtgagggtggcgacggtgtcgtcgttcatggcgtcggtgatgaggacgttcgtgtccaggagaatcggctggcggcggtggccgttgatgtcgatcgattgacgggacgtcgacatcaagtcgccggccggagcgtcgtcggagtcgatggcgcggcgtcgactcgccggagaggaactcggtggatttgggatttagagttgggacttgtaattcagagcctactgtttttttttaaatctagtttttctggtaaatatataaggaaaatttcgttctacgtatacgtatcgcgaatcctgacatgcaattttttagggaattagggatgtgccgtgtccaacttccaaacagaataaagatccgtctccttttgtacgacggcctccaaaatattcgcgggccttttgccttcggcccggcccatatatcgcctcaaattcccccagccgatcgatcgccgactcgactcctcctcctcctcctcctcgtcggcggtgctgcggcgctgatctccacgatggcggagcggtcttcttcttcgtcggagtcgactggtaatggtaatgtcaatgtgaatctctctctctgtctctcgtaggttttgtagtgtgcccaagatgcgatggatcgtgctctcgttgattgttcgggatgcgtgattactggttcggttgttggtttatagggtttttgtttatgtgatctaggtgtaataaacccgcgaattagtgaaacgaaataagcccttcggtgtttgtttgattcggtttatttatgtttatgtagatctagccataaaaaaaaagaacttgtcagggcagatcataccatcatcacccacagctccttgtaaaggagtaaagaaactgaaattggaagtttatcatatcatgttagttttttttggttcatatcctcatcctgataagaaaaatatcaaccttgatttggtgttatagtagtagtttcttatgaccgacattatttttgtattttagaatttgtttatgtgattgtcagctgatgagctgataaaatcgaattgggaattatttggtgcgttggtcaaatccatcttcattcatagtagttgcgttctaatccactttgcaacctcaatttttcgcggaaaagatttattgcattgcagcttccctcatatattgtaagaagaaaaggtagaaaagaagcaaggaatcagttcttttattcagcttctttactagccagttttatgctttgttgtcaaagctggctacggtaccatgcgatgcatgtttctgatttgatcaattctcttgcagatgagaaaaaaagttcaaaaccacaaggatcatccaatgatcatcaagggtttctgccaggaggctctcctgcaaatacttttgattttgcttctttgcacagcttgctcaatgtatgaccccccctccaccaccattataataagtttgcactacatgctggattcccaattggtttctgttcacttgaactctaaatacattttgtggtttctgttcacttgaactcttcatacattttgtttgttacagttattttacatgatcctgccagctgcatacttgcgctttagattttatgaaccttcggtactcccttttcaattgcttcaagtctccaccaatgtttttcaggatccatctgtaaaggagatagcagatcagattgcaaaggaccctgcgttcacccagatggcggagcaggcactggaaggcgaaggagaacagggcatgcctgcaatagacccttacattgaaacaatgcaaaagttcatggaaagcccccatttttttacaatggcagagcgtcttggggatgctcttgtgaaggtaccatgtttgtttcctagtttgtccaaatatctcccgtgtgctcattttccttgtttaatttggctattgttgtcctaaatgctccacaattcaattgcatggtttaggatcctgcaatgtccagtctgctggaaaacttgactagtccaatgcataatgcaaagatagaagagcgtgtttctcgtatgaaggaagatccagccgtgaaatcaattatggatgagttagagactggtgatcctgctgcactgataaagtaggtcatgtttactactgatgatatgcgaatatgaccatatgtttatcacttattgatgtatcctgcttttgctcataataggtactggaatgacccagaaacatttcgaaagatcagccaggcaatggggcctttaggcggccctgattttgctgaaccttctggaactgaaggaactgaggaagaaggtgaatatgaagatgaatccattgtccatcacactgccagtgttggtgatgatgaggtaagggggccagagtgctaagtagtacagctaaggattttaaatttcaaatccctcaactaacggcaagaataatggacgaaatacatacatggtcagcatgtggggcaaaaaatcttgcgagaatagcgccttaacctctcatcctttgttgtaattttccttttttctgctctcctccccctgtctttccccttgtcaccattggtggtatttgtatagtgcttatcttctgaaatataaaaccagctaagctggctaaggtttcaaaaaaaaggattttaaattattattaatattactatttagtcttgagcttgagaagtgcatatgtttctatgtcttgttggtgtgtaatgtataatttacttgagaagtgtccattcgtgtgtgtgtgtggttatataatatcttcaattacagtaatctgcctctccgttttggttttgctctgaacaacatgtctaggttttcgcacaaattgtgatctcgatggccttttctgtttcattatcaattcagcttgcctttctttacaagtttaagtcatctaatagggtctgaagaaggctttagatggtggagcagacaaagacgaagaagattcagagggcagaagggccttacactttgcatgtgggtatggggaggtatgcaagtctgcttaactaaacccaatgacaattgaaacctgtgcaagtagaaaatgccgaataaatactactattatctactagtacctatttgttgttattgcaaatgactaggttagcaatgataaaaacatctcgttgcgaatcctgtgcaaaacggattgcatgtatgccttactagtcttcagaaaattgcatgtatgcaatgtgacagttcattgtgcaaacgagtgtatattgttgccatcagtatccccgatactaattgaagttcccctaatgtttttttttggtagcgagctatcgttgaattcagcttatttgggggctagttgtctttttgcattctatgatgagttttgacaaatttattgatttatcttttttttttgcttttaacacacgtttcaagatttttttggtactccctccatcccagaatataagcattttggacatatgcaatgaatctggacatatgtacatctagattcatagctagaagttgttatattttgggacggaggtagtagatggaaaggtgcagagcttgctgttttactttgttagttttttgggggcagttcattgatgataatccagacctcacaggtcaatccacagtaacctgtccattgaacattgcacaaacttgccagatcaatgtgcacctctcacctagctataatagtatcgaactatgagtttccataaccctgctgtttgtataattgcatttggtgtgcaatgctagagcacaaaagttaatgaatgacaaactaccttttgattcattgtcttgtggatctagaatgtggtgtgagactttttttggggaactgcatctgctccttacttgttcactgactaatcaggatttggggtcaaacttttattttttcagttgaagtgtgcccaagtacttcttgaggcgggtgctgcagtggatgctttggacaagaacaagaacactccgctgcattacgccgctggctatggtatgaaggggtgcgtggatcttctgctgaagaacggagccgctgtgtaagttaaacctgctcgctttgctagctgcgatcacatcttttttttttttttgcattctttgactgtctcgaattgcatatcgcagcaccctcgaaaacatggatggcaagacggccattgacgttgcgaagctcaacaaccaggacgaggttctcaggttgctggaaaaggatgccttcctgtagatcgcctttgttattctcatgggcgcatgaacagtttggctccaggatcatcattctttaatttctttggtgccgccattcatatttctttgcaacccagtggcagttcataagatacggtgaaggggctgccacacaactgctgtggttcacgatgacttgcgtaccccagctttgtttctcttgttttcattagtgcaatcgagattgtgtatccacattttttttttcaatattgcgcatatattaaagatgatatatatgtcttttccttttatgtgaaatcatttatggtttatgtttatgttatttctcaaagagacggcacggctaaaccagtcagtatttttggaaggatatttagacccaaatataggttggatcttaatcgtatcccttaaccgtaaaaccgatataatcattccttcaactattaaaactgtgtaaaatgacagtgttgactagtggttgtcattgacatgacacacacttggtactctattcatcacaaaaatttaaaaagcgtttaaaaaaaatacagtgagaccccgcggcagcagggtggcacttgggccttgccgtgtcgccgtcgctggagcttcccagaagaatatggaatttggctggatcggctagctagatttttttttaataatggattaaaccggtttctacatttaaacggatatacacggcccctaatgcagagcccctgcgttgtgattgtccggtgcgcgagcaagcgttatccgccgtgcgcgctcgccggtgtgtgctctgaagaagttacctgtcgttgtgcaaattgcaacttgccgtcgatgcttccattcctcgcttgagtcgcaacacactgggatgatgatcgctatttaccacactctcttgacatgtacaggtttatctggactctggaaagctcgggctggaaaaaaaaatgaaatgggtggatgctgaccttctctcgatgaatgcggaaaagatcaatctcttccagccttatatttttcacttatacttataagccgaaatctgaatttttaacttcaaatttagagttgattttgaggttttttttaatcatagtttattttagatggctaagaacacacatataaaaattttattcacaaattaattttcgtttgcaactatatcgtttggtggccccattctttttttttaccgattcatacattgcatccagctactttccacctcccggtcgattgttgggttgttcaccatgtgcgtcgctaacacggccacctctcgatcgttgttaccaacaaagaagagcgtcgccaccctggtgccaccgagaaggcaatagagacatatagaggagatagggaagaaagatgagggagaggataacaagtaggtctcactttttttttataattcggtgatactgaagctaccacatcagcaaaaagacacattcaacaccacatcagtaaaaagacacattcaacacaatcgtggttggaagttcgcaccaaattgtcacctttgttctgaggatggagagtcctaccaacacattttccaggcttgcaccttctcgcaacaggtttgggtgcaggttcaggctcgtttgagcctctccttcttgccgccgtcctcggattttgccagttggtggctcgctgcccggcaatctattgcgaagatcgatcacaagacgttcgacaccggagtcattctcgttacgtggttgatttggaaatggcgcaacgcacgggttttcgagggaacggcctcgtcagtcacgcaactgtgtgcggccatgtgtgatgaatgggaaacttggaaatcagcagggctagttagctcgttgagtgttgccgtagcgccagctttagagagattacaacctttgtaatttgcttattgttgtaaaggcggtgttctgacgcacacattagtgccccttcccagagggtttgtgcagttttctcctttttttaatatatacatcggtcggtattcttcgccatcccggccaaaaaaaaaaattcatacttttttttttccttttggaagcgcttcgatcacaggtacacagcccattcattgttccatggcccaacaaacgtacacacacacctgtggcgacagaatggagagaaagcaagatcggttggggaacggcgggcgtgcggcggcgcggcggcgtggcgggcgcccgccgcccgttcgagagtgcagcattgccacgatgggcggaaaagggtgtgggggcaggcgccggcgccggcggcggtgggttcagcggcagtgcctgcgggtgaccggtttctttccgccgtttcgcctccaaactgtcaccaaatctttcgtctgcgcatgaacttcttctgaaattttgctggtatttccttttgaactctgctgaggcccccaaatagtttcagcagttgtcaaatttaagattcacatgatgtgtcctcagttaggtttatcagtttttgacctctagctcttaatttgtgtactaaatctccttatgggaggggatcgttttaaatctagagaaacgtccagcgatcttccggctagctccacaaggtggtgggctagtcggcctggtttcgaagcctcaccctctctatttatttgatattaggtttttccctagtattctcattttttgataatgatacctaaatgtggttgcatccgcgatcctatcactagctatcaactatgtatcttgaagagccccagatgttcgttcaattccagttccagcggtccagccattcccagcgcaatttggtgaagcaatttggttatggtggatgtaagtgaggtgtatttagtggtgaagctagcaattttgattgggcgaggagctcgatttgagggaaactgacgcatcagatttggagactagcaatggagtatgtgaaacaggtgggaagaatccaagtacaccacaaatggtgaatatgagggctgggctgatggagatgtagcgtgtagagcttgctttggcgccgatggcttcgccgtcaaccctgctctcctgcagctggtattgcaaatagctagcaaagtgacaacgaagaaatgagaagctgcagctgcatgatgattcaaatggctaataagctcaattttggatcaatggataagaaccaggtggcccccaccatcttggcatgtttgtccctgagctgaagctcctcattttaataccccgttggtttctgctcaagtcccctgcattggtggcagaagcagacccatccacacaatcaaagaagaagagtcagaagaagagaggtgagctggccagcaatggaggcgacggcggtgagcgtgggcaagtcggtgctcggtggagcacttagctatgcccaaaccgcgatcgcggaagagggagctttgaagctgggcgtccagcgcgaccaaagtttcatcagggatgagcttgagatgatgcagtctttcctgctggctgcggacaaagagcatgatggacatcatcacgaggtcatcaggacctgggtgaagcaagtacgtgacgtggcctacgacgtggaagactgcctccaagactacgctgcccggttgaagaaaccaccctggtggagcctcccttgcacagtacaccgggagaggcgtcgcatcgggaacgagatgaaggagctgagagccaaggttgaggatgtcagccagagaaacatgcgttaccatggtgtgtctgcagctgccccacagtcttcttctgttactgctgctgagctgctgcaatccactgccgccatcgacgacattgatgaggctagacgtgccgccaagcaacaagaaaaggtggacctcgtgaagctcatcaccaacgacggacaaggtggacttagagtgattgctgtgctggaaacaagaagtggacctgctgggacagtgcccgttgttcgagctgcctaccaaaagctcaaaggagagtttgaatgccacgcctgggtaaggctgatgcactcctttgatgcaaaccaattcattgggagcttggtgaggcagttcaaagcgaactctcgcgagggtactggcaagacaccacaaggaacaccttctggggtgtctgttctgaatgagatggaagcacaagattataatctgcttcatgactttactggatatgtgaccaacaagaaatacttggttgtgcttaatggcctgtctacaatagaagagtgggactggataaaaacttatcttccaaacaatcataacgggagccgagtcctagtgtgcacacagcaagctgaagttgcaagctgttgtacttgtaccgatgataagtacaaggtgtctgagattcaacacgaagggtcattttccaaacctctttatgtcttctacaaggaggtaatggttatatatccaacccggcacgttgatgcagaaaaattgcatgataaaatagtatacataattttccttttatttcaggtagggatacaagaattttttgatgaaactacgaataccatcactcattcacattgtttgtataggaaacaaaattcttaaatgcagtaacaacataattcaccgtgtcccaaacattacatttcaatatgactctgataaatgacttgatattcaggagtaagttcatcctattaaggcacctttctttagataatgatattaaagccacctactagcataagaggtcttttccttatcagataaagcatgtttgttgtcattgattgaccaatcttcactgaatagttggagtacaatcaaacaaccattttttgtttctcagttatagtgcattcaccaactaaagaaaaaaaaactttgaacaaacaattatccaggtcaatcaatgtaatgcttcaaaatccattcaactaaatgtacttaattttggaggtagttaactattgtctaatggcattttcttttttaggtggtctctcagccagttaattcagattccactaagatgaaatcagagaccaggtccagcatggagggtgcctctactactagtgacagcaaaacagtaccttctgatggcgtgatacaggaggatggcccgaaggacctgcctgaaagcagtttaccccctcacctcaacagagattccaacactgtgtctgtgaaggaactttctcgcagcacgacacagctcattggtagaggaaaagaaaaggatgacgtcatcaaactgctttctgattgtaatccgatccgtcaagtgatttcggtgtggggaatgggtggcattgggaaaaccactctcgtcaaaagcatctatcagagctccgagcttgagaagcttgggtttgagaggcgtgcttgggtaactgtattgcgtcctttccagcttactgagctccttaggagcttagctcagcggttggttaaagattcccctggaaagaaggtagaatctataccaggacttgcaaggagtggtttaagcacgatgggatctgaagaattaattgacaagttgaagcaagatttaactgggaagaagtacctcattgtccttgatgacctatcgactactactgagtgggattcaataataagaaacttgcctataaccaacaatggtagccggatcatactgactacaagatttaaacttgttgcgcaacattgttccaagaaagaaatgaacatgcacaatattgaaggtctaacagacggagatgctcttgagctattcttaactaaggtaaatgctcccacatttttttttgactaaatcactgttgtgtgtgtgtggggggggggggggggaagagcttccccacctgaattttgtcattgccataaattaggaggtttacacatagagttacaatgaatttagatttcgaagggggaagagaatatttccttccacatggagattacagttttatcttcagtttttaagatttcagaccatattgccgcttcactgacgcaccgtcttaagcacaattgtatcgacggtgcactccttctgaaaaccacatcgtgtctatggttccacaaagcccagaaacataggaggtagaaaactctgaaatgaggcatcggaattttctgcactggctttagttcgtgcaatcttgccacctcctgaactgtaggtgtaacctgaatcttttcccaaaaactttgagcgaaagggcagaggataaatgctcccacatacatagtactagcttgtttttgcccactatgctatatccttcatagatgttagtttcaaatttttatatttgaaatatatccttcgggctcgatgtagtcgtacaaaccgtctcctcctggcgcggagatttcactcgctccgactacaggaccaacgtcggcgttttctatttatgctacaatcattaccacaataaataacagaaaaacaaagataaccaaaacaaatagtatcataacgtgcaacaatggatgaaaaggattaaagaaataattttagagatttttcgaattttgacaaatggcgaaccctaggccaaaattagggtttcgtcaacgggtgctcagattgcaatgaaactggcacatatgggtttggaataaatctaggagtttggagtaggtctcggattttgatggccaacttgataggaaaagaaaaagggaattttctgatttatttttcaattggaaaatccggtttttctcttcttctctctctctacacagaagccggccgaaatcctcacgacgccggcggtggaggactcggttttggacaagggggcgccggttttgtgatctaggggtcaaggtgattctgttcccgcggtcggcggcgaggctggcggcagcggccagagacaggaggcggaggcagccatggcagcggcggttccagtgatctccagcgagggcgacgggcttggtgagcatcagtgaggcgaggagagtccaaggggggcggcagctcgagctagcgcggctgggagcggtggcgcgccatgcggccggcggcagccgaatagagtagcagcgtcggtggcgttccggcgacagattggattggaaaagagaggggaaagggactactcggcatggagaatttgttttaccttcaatttcagaggattagcaatgtgtgcgacgaattttagagctctgtgaatgacgccgaagtaggggttttggggatttttccctccggaggttggggcggatttgagagggtggaagaggtcgaagttgcggttcttttgcctccggtattgagatttctagtggaaggacgaaagagatatgatggcgggaagctggagatgttgcggcggcatttgtccgtcggtcgtcctcgtgcaagcgtgtgtgagcgtttggcgtgcttggtgcaagcatgagcaagcgtggtgcgaggcagcacggctggctcggccaggtcgagtagagaaaagaaaagaaaccagagaaagggaaggagaaagaagaaaatagaaaaggaaaaaaaataaatagatggaaaaagagaattaaggtaaaagtagagaaggaaaatatggagaaaaattaaaatggataggatttgaattagtgtgaaatttaggtggttcgactttcgggataaaattaaattggatcaaaggaattatttgaaggatgatatgaactttgtgacaattaaacaagaaagaaacatcgaaaataaacattgaaaataataatttaaataaactactaactcgacggttatatttttagagaatcaaagcaaactaaatcggttttaaaaaattatcaaattttagggctgttacataaattctagaagtagaagttaatttggtatacaactcttagtttttgtttccataaatataattatattatttttgtggttgagatataattatattatgtatgcagctatatcaatcaatctacactgctatgatctaatattaccatgatctaacaatcaatatctttttcttcaattattgtaagaatctgcaaacctccaaaacaactttcaggttttttaagctatatttataaaaaaggtagttaaattgtcttctcttgttgtaatgcatgagcatcttgctagttaataatataatcaatagtcctagacacatacaaattccaacttcctccattccaaaatataaggcacaaccactcttaacccaaaaaccaagaaacaattattatcacctcctagttttgatcaccataataaatataatgcatgcacccaatagaattagagatcttgaagggggaggatttaaatgataataatttagtggagaggaggtgctagttaattacatgcatgcatgccttgcattgtattatgaaacatctaaaaaaaactagttatgccttatattatggaattgagggagtattagttaaacctaaattttgtaattgttaaatcttgaagaaattaaaattgagatcgcaaacagagtactactttatattggagtgcacaccagctgcaacttgctaattattaaattataattttaataattggtaaattgagaaaacaatatattaggattctataacaagtacaattcattacttattaattgcaaatgtcagagattttaaatcataaaaaaaactataattgagactcctaaccatgtataactttgtatatacttattaatctcgtatctcaaaaatgttgaattgagacattccaataaatagaataaagtattagagtgaatccttgatacaattctgtaagtactaatgcaaggtttttgaagtattaataaaagagaattagtttacctgcatacaaactatgtaatataaatagtccatgtgaatgcacatgttaccgactagttttaaataactgattgccatgtctatgtcatccatgtgtatacatccttgtgaggtagattgatttgttatgtatcatgtcgattttcgccttttacatttttttcccttttaaaattaatgaaacaaaattttcagacaactaagattttcaaattttccattgggattttattattagaaaaaactagagcacacttccttgtgagtgagacagaaatctttagatatttcaagtatttagcttgttaagtgacatttgctgtaggtacgcatggatggtgatgaatcagaattgaaacctgacttgaaggaggaagcaaaaattatcatcaagaagtgtggccgacttccccttgcagtcgctacagtgggtgggtccttgtctgccaaacctcgaaatatcatagaatggagggagtttagtgatcgcatcagtgaagaatttgataacaacccacgtcttgagatgataaagaaaatacttgcatcaagctatgagggtttaacttaccacttgaaatcttgctttctatatatgtcgattgttccctgaagactctgacatcagatatagacgattattgaagcgatggactgcatagggttactcaagagcaacgagaaacagggggcacgagaaagtggcagaagaacagttcacagctcttctcaacaagagtatgatccaacaatcaaaaacgattgccagtgggaagacaggtttctgccaagtctataatctcatgcatgaaatcatcatttcaaagtctgaagaagaaaaccttgttcttgttctagatgaccacatcacctcgcgctctaaagataaagtacgccaccttgttgtgagcaagagctggagcagagaaaagaacgatatgcaaaatatagtggatgtgtcccacatacgatctctgacagtctttggggagtggaaatcatttttcctttctaagaagatgaggatgcttcgagtgcttgatttagaagatgcagaaggtcttcaggatcctgaccttgtgccaattggaaagcttcatcatttaaagtacttgtctctacgaggatcttttggagtcttcaatcttccaaattcctttggtaacctgttgaacctggagacactagatatcaggggaacatgggttacaaagttgccagcaaccattggtaggctccaaaacctgaaatacgtccatgccggatctttagatgatgaggatgatcagccgataattaaactactgcatcagttcagatcaatccgagaagagatgggaaccaggttcgctgtatcatatatcatgttgttcatcaccgcttggttaagaaacctggatgtatgtggtgttaaagtgccaagagggattggacggttgaggtccattcacacactgagcatcgtgaacattgcacggggaaaggccttgctcaaaaacctcaaaaagctaacccaactgtgtaaactaggtgtgactggcatcaacaagaataactgcaaagagctctgttctgccattgccgaccatggccgcttgcagtccttattactgcgggcagagggtaatgctgggttagaaggttgtttggataacatgtcccagcctcctaaagaccttaagagcctccagttgtacggcaatctggtgactttaccagaatggattaaggatcttaaaattctacaaaagctgagccttcgcaacaccaatctgaaggcagatactaccatggaagtgcttggaaacctaccaatgctagccattcttcgtctccaggacaatgcgtgtgaggaggaagaactctgtttcggtcccgagcgtttcacaggtctgacgtcattggagcttctcaattgggagagcctcaagtcggtgaaatttgaacgaggagctactcctaaactgaaggtgctactgctgcactactgttggcaaatacacaatggtgggttttctggcatagaaactctctcgaccctaaaggaagtttcaatcttgggctataattatgaccagacctacaccgaattcaaggaacaattacagaagcaacttgacatgaacaagaacaaaccaaatctaagtattctgtagtccaaaactgccactggctttcatagaattgctccctccacactcaaatatgtggcattgggtcattcaggtagtgtttcaaatttcaaaatcatgtataattatgacaatttcaacattaagttttactcccttttttctcctcatgtaccatacgctttaagtaattaagtgtataagtttagtttagtttcatggtgaaaattgtagtacctttaccatttacttccagtggcaaagacaacagaaaacacaaagtggttcatctatttatcgtaaaattatcagtgtttatattgtataaaataatactccctctgttttttaatatataacgacattgactttttaataaacatttgatcatttgtcttatttaatttttctttttttgcaaacatgaaaaaaatacaaatcatgcttaaaaaactttcaatgataaatcaaatcacaagaaaaaaaatgataattatataaatttttttaataagataaatgatcaaacgtataaaaaaaatcaacggcatcatatattaaaaaacggagatagtaaaaggtaaggaaagcttgagggcctgtttggttctcagttcggctccttcagtccatcgtttgatctcttctactacccatctgctcaatcaatggctgcctgtccaccctcactcttcgccctaaacctgatgttaatttcattaacaactacatacttcgtacttccctgtagcctgtaagtacgtgtactcgcgcacacggttaaccacgatcccttgttagagatcgaaccgctgccgagtttcacgccggattctgcattccggcctcttcatcacctgctttgccctgctcgtcactagctcctctgcctccttgtagctcctgcgtgcatcagagctctctcagtttcaagcgaaatggcaaaagattacagaaccatgtacgcatgtcaggatgcagcaattgacagcttaaaggcagcatatatacttgtatgagtatatgaggaggccaggccgccgtgccggcgaagccgacgaagtagatccagtccacctggccaagagcaaaaaatgacggctttgatcagtgcagttcagtccaagaatcgatcagcttgtgtagtgaaaggaatgtgcagagtgcagaccttctcatggtacggaaagatggggatgagaactgcccacatgtctgaagtgagtagtaggggggaaaggttcagcatggttgcccccacatagctgcaacaggcaacgaaatgataagcaattgaacaaaaagcgtgttcattgacatcatttttggatcatgcacttacgaagttccgatctctgaagttagaaatttcataagtaaaaagcagaacaaatgtgtcggcgttgtcagtgcgtgatttgtgtgttttcttcttcttccttttttttttctgattatagcttttatgaagcatctgaaatattacaaataggcatgccatgaaaattaatggtccaaatcatttcgatacttgttgaagttttcttcttgtgtcttttctttttttacaagagatacttgatgaagttcgatgctattttttttcatgcaagaaagtgaagaagagggccttggcttcaacttacaaagcattttatgaaaacactctgtgtgatcacccaactgaaccattccacctcatttcctctccctctgaccagatctggccctgccgccgccagagctggccggtggtctacgcggcggctaggatggcggcgacgggaggttggaggtagcggccagaggaagccaggcacacgtctggccacgcggcttggttacggcaggaggtggtcaggagggtggtgggtattggcgaggcgttggtgacggagctccttcggacgacagtggggccggcagaggacggtggcggcctgagcgtcgatggccgctctgcggcaagaagaagttggttcaggcggtgtagcgcccgttctgtcgtggcgcctagtgggaaaaatcctaaatgcgaaaattatttctttgtttattgtccagtgtccgtgccattccagatctcaaatccccaatccatcgtcgaatccaaaccctaatctcaatctgtcccgaatcaaatcgtctcgtaaaagtctattttgcctccctcgaactcatgggacgatctcttctcccccggccctttccctctcagcctatctctccctcctcctccatccttgcccgcacgtgcgaggcacgtgcgcagctcgggcgctgagcaagagagagagctcgctctctctttctcttctccctccctctctgctctcgctactgcttcccgccgacgccgctcaaatcgccgcgccacccgttgcttcttgcgcgcgcgtgccgccgtcagcgcctgccgcgcctgaccccgcgcctgccgccctgtagccgtgcccttccaaaccgcccccgccgtcatcgccgtcgtcacgacccggccccgccaccaccgcgcatgcttccaagggttggaggcagagctcctcctcccactgcctcatcgccctctctccccttcattcttttcccaaagagccaagaggcaagtctcctttccctctttcttgtcttctttttctccnccgcgggcatcatcctccctgtcgccgttttggccgctagccggagcgccagctcgctggcttgaccgcccaatgtcggttcctccctcccaaactgacattgtcgcccctataaatccgagcccctttcctcattccaaactcccttgttttcgccttccgcctccaccgcgccatagtcgctccgccctgcttgcacatctgtcgttcgtcgccaaagcaccgggagagccggtgcgtccgaagcacgcgtgaaggggactccgggcgctcgtcttttcctcttccccggcccgaggccggagagatcactcccgtgctgtcggcctctcgtcacagcgccccgcctcgtctcggtagagcatgccccgttctccctcctcgctctctctcctcctcttagatttgtcggtagcgatcttagcactccctgtagccgccgcccgagtccggtaaccgccgctcgtcgccagccgctctcggggtagctccgcccaatccagtgctaggaatgcaatcccgtagccgcgtagatgctctcgctgccaagaatcggcccctcgtggtctcgtcgcccttcccctcttttgccgccgccggtgtgcgccgccgcgattcatcgccgtcgagccatctccggtgcatccgagccgaaggctcgatccctctcgttcttgtaatcacaccggtgcatctccccttggccgaagatgtcccgacgagctccggtgagcaccgccgtcgcccgccgtccgttcccggccggcctcccttcgtcctcctccagccggcccacgtggcagccacgaaggcgccacgtcggcgccagctcggccgcgggctaggactgtttgacctcggagaagccgctcctccgatctgtctcccgtgcgcgcgtggtccacggagagccagctggctgcgcgtgggcccgccgtctcccagtccacccggtgcaccatctgtgagccgcatccgcaaaccctagctcccccgcgccgcataaaccctctctcccgtgcaccgagtcactgactcgtgggcctaccccgggaccccgcacgatggatccggctcatccggatctctctctctccctctctctctcccccgcctccctctgttgcgccaccttctgaggccgcgccggcccaaccaattggccgagccgcgccaactcctcttgggccacgctctagccacccatgaagtctaaatcccctccttctttcgttgctaattcaaaaaggatgttaataaatcctttttctttagtccaataaatcctctaatcttagaaattccatatctcatcaaccatgtatccttttgactccgttcaacttccaaaatctctcaaatctcgagatctatctaatggcacgcttagaggtcaataataggactttaatttcgccgtttgttgagtcgtctcgttcgcgtgtagcttcggagcccgaagacccggagtgcgcggatttcgaggatcaagctcaagaactcgagcaaggcaagtcacctttgatcatcttgcacctatactttaaacctaagtatttcttttccgcaaataatgcatggataggattaacacaagtaatttggccgcggcttgcgagatagcctaccggccccaatcctaattgttgcaattaccctccttgaattattgtacacttaaacctcctttgtcaactattgtacttcgatgtacgggccttcgggcacgcacgtcggagtcctcccctcaaatttcaaatatccaacgatgggtaaaacctgggttttacaaaggtcttggaaaaacccgacacctgggtcggttcttacgaactaaatgaatttctaaaaatcgcagaccgggggacgtgccgggagcacggtttcccgctcttgcacttaaggaccgattcctttggaatttcatccgtacatataacaagtacgaccacatgggtggaatgggacacccctggctgagtaattagctaatcaggggagccttgatgccaggagacaagtggattcgccagggtggtgtcggggaggacccctgggcttcctggcacagtatggtctgggacctaacctgttgttggtctgggacccctctcgtcggcatatggtaaatgtagcgcccgttccgtcgtggcgcctagcgggaaaattatctcttaaaaaccctaattgcgaaatttgtttctttgcttgttgtctagtgcccgtgccatctcaagatctcaatccgcgatcgatcgtcgagaacaattccgaatccaattccttccaaatcgaatcccaccacaaaagtctagtttgcctcccccgggttcgatgggccgaattccgctcgacccatctcttccccggcccccctctcttccgggcgctctctccctctctctctctctctctctctctctcgc

SEQ ID NO: 79342 - DNA, 7925 bp, Oryza sativa
gtgcatcaatatagccactggaatcataaaccgtgtcttcaggatgagcatcgtcgtcaccactcaccacttcctcattggaaggtgtctccaacgcggcaacccgatcagttagtgtggatatccgcttgtccaacctctccatgtggttcaggaagccgattttagtgaaggcatctggacagactttgcaacggcttccgtgatgtccttttgagtattttcttggagagttcgtagttgctcttgactgacacagtcagcaaaatcctggggactcttctcaccttcgttacctgccattgaaacaccaaaacggcaacaaacggtgaagattgtcgcgaccgggaaaattgccttttcccgaacgctagtgtattaatccccgtcccaggaaaagccggggtacaccacacaaacatgatataaaagacacatctttattatatcgatagtatttacattattacagaggcgcttcaggcctggcaatcaaaaataaacagcagcggactagcaggcctacggctccatcttcacaggcgctcaactggggtataagccaggactccacctaagacttcttctccaaagcttctcttactgaagggggggaaagattgagcaagaatgagtacaaccacagtactcagcaagtcacaccggcagatgcatgattaatgcaagggggtacaaggagataataataggggttaagttttgcggtaaacaacatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcagtgtgaatccaattccacaataaaccaacaattccaaagtgtccaggtgatatgaatatcccaaagtctagagttgtaaaaccacctaatgttacctaattaatcagcgaagcatctacctaaaattatactagtggtactatgagtagagtgtccactagttggggttttgtttaatctagggtgaacaaggtaataataacaataacaataataataaggccataacaaaggtagataggcatggttaaataaaacagtgataacgcgggaatttaaataaagcgataatgcaataatttaaagcaacataattttataaactgggattcaatatgttcaaggatgatgtgacttgccttgctcagagagaacggccttccgaaccttcggcgacgaccacgaaccacgcttcgggaacctccggaacgacagaagctacgcgaagcacacaagcaaagctacaagcctataaagaagcaataacaatacataaaaagaaaacacagggttctttaggttataacaaacattaagagacttgaacgggtcgattcggagctcgtatgaccaagatatgatcatccgaagtttaatgctgttatatggagatttgcggattattataattaagctttgcaactataaaacaggtgtaagcgctagcctggaaaagacaggaaggctgcgccgttgacatgcggaccccacatgtcaacaaaaaggaccgcggtagtccgagtacacagagacggtccacgggtcgatggaagcggatcccgtgtgtcaaccgaggcgagtggccgacaaacggactccactagacaccacacgggttacacacgtggaaaccacgtggctaccgagcgggcacactaacacggtcaccacacgcacacatggacgactaccgacaccggtgcacgggtaccggggccgacaaccgcacaacgagcacgggcgacactgaaaggacgaggacggggcagcgagaggacggatccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgaggacggggctgcagcggctcgcttgacgaacgcggacgacggacgagaacggctcgacggagggacgaacgccacgacgaccgggaacgacgagaggatgacgacggcgacgaccggggccggcgaggaggcgacgagggcagccggcagcggctgcacggagacgaggacggcgtggaacacgccgctgcgatgttggtgaaggtggtggtgcagcggggcgacgagccgacgaggaggaatgggtggttggcgcggcggcggcgttccggcgaacttcgggcgacgccgcagccgggccggagaagaggatggcgctacagcaccgacagaggtggcagcgacgtcggccggcgctcaggcgaggcggcagggatggctggagacggtggagtggtggcgacaccactagtcgtcggcgaggacgcttctctggtgatttccccgcgaaacggaggcgaagccggggaagaggaggcagctgcgacgccgggagaggtgacggcgcagccggacggcgctcgggcgaggagggagaggcggctggaggcagccggcgcgaaggaaagagaagggcgacggcgggaacgtagctccgggggtctccgcgggaaacggagggcaagccggggaaggggaagccactgcgacgccgggagaggcgacggcacggccggacggtgcacgggcgaggtggcacaggcggctggaggcggccggcggcgtgggagagagatgagggcggcggggagaggtggtgaggccacgggagaacgcgggagggggctaaaactggagaacagatcgagggggttccattttataggagaggagagggagccggccacggggaaggtcggaacggcggcggaaaaggcggccggcggccatggaagttggccggagttggcgcgggcgttcccggcgattgggggcacgattcaagggggaaattggggggaattgaagaggattcaatggggattaattccccccaatcaatttggaaagaagggcattgattcgcgtggatttaggggaggaacggcgctaggtttccggggagagagagagaggaggccggctgggggaggaagacgaccgcacgtgctgcgcgcgtgcggggagcagctcggcgtgggccaggtggctgggtggcgcagcttgggccgggcgggaaggagggaggggaggggcggcccagaaggaggaggagaggagggagtgggccgggagagagaggggaggggagggagctgggccgggaggggaggaggcccaagaggaggagggagagaaggagagggagagaaagagagggaggagagggagactttgggctgggcttggcccaaaggaggaagaggatttatttttaggtttttctttttaataaactctaataattgtttttgttgcttaataattatttccggtgctctgaaaattcaagtaaaatttgagggctccttttagaccaaggagaatttaacaaaaattcttcgggccacattcgaatttttcttgtacgtattttagtgtttgccaatttcttttcgaattttaattaattctattattccttttagcgaatgatttttaattcgggatgaatttatcaggacgtgacaaatccaccccccttacaagaatctcgtccccgagattcgaggaggctagcatgaagataggttgggtggtcttctcttcttgtttgacttcttctgctccgtcttcacaaactttcagcaaaacttcaccactcggaactgcttggcttgacctcctgttgcggatggaatgttctcttcacctgacttgaaccagggtgcaccttttagctgactcagactaggttgcggtagtttaatgatgcttccgttccagaacttctcatgattcatatcttcggagtcaacctcatacaagttaccacttcatgtcatgcgtcaacactagcttgtcattactaggataccatgtttgtcatcataagaatatcatgcttgtcatttacttctaacttgccaccaactgcctcatattagctttcctggtctccgggtgatagctacttctgctatttgatgcaagggtcgataactttgcctttgaattatgcttcccaagagaaccaacttatcccacttgacatactttgacgtcttcccaaatggctttactgctggatttgttattgtctaatcattatcctgccaaatctgaggcttcgttgttagatgtgattttaatctgacctctgtagattatcttcgaacatatcacttgattcataactgggaatagctctcacgaacaagcaactcggattcactttctttatgttcagtttactttccactattctcttcatgttgtcatcatttagcattcaacgtattcctttgcaccttcagccttgatgtgttctttctcgatggatcgattgctaggaaagtgcgttgaacgatactagtgcaagtgcttttattctagtagcatctgatacaaagcccaaggttgaaccgagctttagattccactgttcaggttttacttcttgacttcttggtcatgtcacaaaagttttcatccttgtccccatagaagtacttctacctgtggtcatctctcttactcgtgaattcaccttctttaatgacagggcaactgttgtagggttgattgctatcgggagtcttcctcgagtgacacaaatcatggttctcgttatcctttatcaatcacctttcgacctacttcttttcccagtaaccaaacatcttttccgatctcttccattaatcacctttcgacctttctcaaccaggtactcttcgctccgggtgttgaggatgcttctggggcaatgaggtccttgggcgtgctgtctttcagagaaaccttgaagtagttcgtcaaaagctagactgacgattgttgcctttgatccgaagaagacacatctgaaactcttagtccaaacaaatgtctctttggttgatcacttgattttcttcgccatcaatcgctaggttatttgattcataacagattatgggtttacggaaatgagaccctaggtctccctaatcaacaacaaaatgtacacaactcacagcacttgcaatcttaacatggatccttcataaacttatcaaactcattcattatctcatgtttctctgttattacatgattgacggggaacaactataaaacaaaagtatttgaacactgatataagagtattatggttgcttctgactagcgctaggcttaacaggtaccgcatttgctccagtgaccacttggcgattggcatgtctgcttccttaacaggtactacagttgtaacagacaataactttcttacgctcgggttcttcatcttgtacttgatttcttggctgctgtgctggaacatccaaaggtacaatgccgatactggcctctgtcttgtcaactgatggctagggctgaaattgagcattgacaccttgtggtaatgcactcgctggagttggagctgttgcaacgcgggctataggattgcttcgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccggactcggcattttcttttctcattttgattcctctgtcctggcactggagttaggctgaaactgaaatcttggcgaggatttgtgttgccttgatgcttctctccattggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaatgcatgtagtggcacacgagctggcaacatgaccgatttctccacaacgagagcatgccttacgtccatttcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcggttcgcattgatgtttttcttttctgctgaggacactcccttgcatagtgcccttgctcatcacacataaaacaaatgatacttgcttcttttgagtcaacatgtggcacgtcaccctgggtccttcgggatgctggcggcatgctgacttgtggtgtgagtgcttggactgcctccaactgcacttgaggttgtatttgactcaggttcagaattggcgtctgatgctgctgtagtatctctataagcaatcggttctggttaatcaggtgttggactagtgtcacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttctgtgacgggttctcaagatcttcactcctgcttcacagctggcttcactgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggggaaggagaaaaaaggaactttcgcaaatagttttatttacaaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgat

SEQ ID NO: 79343 - DNA, 37346 bp, Oryza sativa
  unsure (1)..(37346): unsure at all n locations
aggggatgacgggtgggccccacccgtcagcgagggtggcgggcgggcccgcccgtcagcggcacgcgcgcggggaggagtccgaatgggccgcgggggagaggagagagagggagagagatgggccgagccggcccaagagggggggaaagaactttttagagcttttctttttataaaaccattttaactttgtttatgtcttaataattattatttgtgctctgaaaattccactaaaatttatttacgcattttaggcttttaggaaatatacaaaaatcctccaagccttatttgacttttaactttgcatattttaattgttggaggcttgcacccagattttaattattctatgcataatttaaaggatatattttagggtcgttttgggacgcgacaataaagggcagatttaacgtgtcaatcaagcatatagaataaaagtagttaaattagataagatcaactgaaactccgatactaccctaatcggcaaccagaaagcaggctagagattgcaatttgaagcacgacttaatagatcaaactcaactgatgcagcattaagtatgaaaagaagaacaatatctagaaaatcaagccgctggaagtttcatagagtggtagatatatcacataatctaagttaacgtcattatctaacctaatcggctgccttccattagcagatgttagccgattataggttagataaagatattatcgaagactatgtgagatatatgataactcgacgaattatatagacaagattagagtgtcataaagatggaagcactaatcctgagaacataagtcgtcatgacaagttttacctcttgttgaagatcgaaaccgatgcagctcaacccgagagcacgaactcgtcgaaataaaagtaaagcaaaagggtggcgatgcgccgagattgtattggatgtgttttcttgtttttacatagggctcgggtctatttatacccgaggattacaagatacgtccataacggacacgactattatctctaacaaactctaagataccataagtctttacggcagacttttgcccaaacatatctctaaggaaattacatagaatatcctaattaatagatacaatcgccttcccaggactctatccaagcatggcaatcaccttgaagcagatcaacttgaacccaatgactttcaccgggtcatattatcggaatcggctgtatcggctagccccgtccaattcggactctgccgatcctgaccttagccgatttagactgcagccgatttttactctatctccgcaaagatcttcatcttggatttcacttcgatctgatcttcatctccgatgccaatagtgatagaatttaccaaatttggtcgttaacaagttaccaaaatttgtcagcaaactaaatgtaaccacttttttgacaactttaccaaaatttggtaagattgaaaatggcatcaaagtgaacaggcccccaataaaaaaaccaacctagctcttacataagtattgtcattcattatactccctccatctacttttgatagtcatatttcatcttatcacacagaccaagggtaagtaactctacttatcattcatttaaacatgctactagtcattcctcgtaaacaaacaattcattaatatttacatttctcgatgcccatgtagccaatgttgtgtggaagaatgaagagtcatgcattaaatccgagaaagtcattaagatggttgttgaattgaaatattactatcaaaaataaatttttcagatttgaaaatatgactatcaaaaatagatgtagagagtcctatataatattataattattttttatggaacggaaagagtaaatgacgtaagaagatataatgtaatacagtttttgtgtcactgcatcacgactcaagccgcattcgagataagagcatatgaaaacgaagtacatgcgcttaaaacgattatttattagcaaatgattaattaagttttagttatttaaaatttaatttttttgattatttaatatttcaaagtaatttttatatacaaaatttttacataaaacatattgtttaacagttaaaaggtcgtggtaacaagaaccgaattatgtatgttaataagaaaaaaaaaggccctcagagacgtccatgcaccacgtacggtaccagtaattaacgaaaactaagtagcaggtttaacatttctaacagccaacaaattacatcaccagtctagctaatatgataggtttaaattaagaagcacacgacaaactacatcactgagtctagctaattaagcggcagacgtagccacgtggcagcatctcaagccaagacgagcagcgcggcggcggcaaccccggcgacgcggtggtagccgncgncaccaccaccaccacgcgacggggagacgacggcggcggcgctggtattcccgtgcggcggcgtcggcggcgaccccgacgagtaaccgtaccccggcgtgcggtacgacccgccgctgtcgtnctcgtcgtcgccgtcgccgtcgggcgacggcgcaccggccggggagtcgccgccgccggcgcccttggcggcgtggtccgccatgacgcggaccgtcatcctctggcggccttgcagtggcccggcgcgccgctgatgaagtagaagttgccgttcctgtcgaggcggaacctgacgtcggcgccgtcgtcgaaccgctgcaccggcttgtcggcgctgcagagcttgtagtcggcgcgcgacaccaccaccaccgagtcgttcttggcgtacttgaaatctgcacactcacacacacacacaatgccgcgatcatgtcaccaccatggacgacgaatgcaatgcagcaagcaatatgtaatggaaatggcgatcgatcgatcgatctcaccgaggaaatcgccgatgtggaagcggttccgggaggcccagtggttgtacgtctcgtcggtgcccgtcggctggctccaacccctcggcccgtcgccgccgacgacgaacacgcgccccggcggcgccgccgacgccccgccggagaggacgacgcaggcggcggcgatgacggtagccgggaacagcagcgctgctccggccatggcagcaacactacttctgttgctaactgtcacagatggacgaacactaatacagttggctcagctcagcgattggatgattggatgatccgtcgatgtcgtgatctctccggccgggggggaggagggatgattatataggagtggacgtacgagtgcggtttcgcggttgcggacgtggcggtggtggatgccgtcgatggcgggcgtcgtggaggcgtggacggcgggagatgcgcgggcgtgggagggtgacttggtcagaggcggcgatcgagatgcatggtggcacaagtggcggcggtggtggtttggtcctgcaggggagtggcgttgaacgaggcaaaaccaggtgaaataggcctccatattatttgggctttaaaattttttcagatgggccctggcaactgagcaagagcaaaactaacgatttcagatgggctttaagtttttcgtggaattaggaaaaaaaagtctatttagctacctcagatatgggtcgaatctgattcgtaataatgactccctctctaactattaaaaccaacataaaaagtgtgaggtatgtggcacccgggtaccccatattgaggactaagatcgcgtcctcaggggtgggccgaagacccaattccgagtatggtaggtgttgtatagttggtaagctatagcagatatggcaatgaaccacgtatcatgtaatagtaggcaagtatctagattataaggatactgtaccctgattagcgccggcgggcctaagccagtataaaaggcgccggtggcagtctgagggaggtcttcggatcatttttccaccggatacagagttaaacacactggacgtagggtattatctcactctgagggcctaaaccaggataaacttatgtgtcaccatctcttcttatctagcgcaccccataaaatatattgccgatccaagaaatcgatagttggcgtgccaggtagggggcgcttgattattttcaaggcggagatggcatccaccggcgttgagatcaccaacaccaccacttccctgccaccacccaaatctcctttggcgcattcgacttcatcgccgacagcttcggcaaggtctgtcaggtgagcctcggcgtcatcgggccggttacagcctaccgctaccctccaggaatcaagctctctccttcggcagtctcgacttcttcgccaccaactccggcgtcctcaagctggcttcgtgggaactcacgccatcgacaactacaccgccagcacctctcggtatcagcaacttcgttgcttcctctgccaaggcatttcaagtcggcaacctcgacaccagccgcccgatcacgtccaaacccccgcggtgcccgggacaccacggccgctccgcgtcaccgtcctcgactgccgcgggagctcagatccctgctgggttggtttccttgatgagtctgtacgtctctccgactcggaactcgggaagctccaacaacacccggacttcaagccatcactcccgcgaggtcttcatcgtctttcaagagacggacgaggagaaaagggagtacgaagaggagaagcgccgtatccagtagcagcaggaggacctcactcggcgtctaatcgagctgcgacagcgcgnccgtctcgcccaaaatgccatcttccaagtcaagttggaagaacatgatgtcttcaccacgctacagaacaacatgatagccgcaaaggccctcctcgacaacatgccgattccaggcgacgcggcagtcaagaccaccatcgctcaggtgaaggccatggtgtatgccgccgctgtccagcactcggaagtaccactgaccgcttccactgccagcgactcctctggcaagagaccatcccggccacaaaataccgggtcaaggcgtgtcgaggcatctcaagcgggaaggtcacacccaagtctgcgcaccagcgacctgcgcgacaagatcgaggtgggacgtcggctaaacgccgacctccgcaacgtcatgaacaagcgtcgccagctccgcgacgcctaacgtctacggatacatgaggacaacatctacgctggccgctgccacgccgacgtccagccggacggctgcattgtgttaacaacgaaatttggttagcccaaagtcatcatcgacttagagtcagtatcgccttcagagttatggaatcagccgatgagagtcgtcaaatcgccagcaaccgtgttctcgatggagtcggatcaactaaagggaatttatccagaagagtccgagttcaagaaggatgcggcatgtcagtttatctattaattaggaatagtttgttagtttccttttatctttaggaaagtttctttcttgtccgagaaggacttgtatcaacctatgggtataaatatgtacacccgaggtctatgtaatttatcttcacgatcaatacaattcggcgcatcgcctccttttaccttttctactttattttatcgtccggcgggacttggcacctgacgcggggctgcaccgatgtttcgccggcccaggcaattatatcgtttacatcggcgtcgttcaaggctgcatcagtacattcgaccttttggattgctctggtttggatgatatatttgcctacctatttatcatatgtctctgttaatctagtattagcatatcaatttagctctatcggctgcttctcgttttagggtttctgccggtatcgggattagcttagacatctaccaccctgaaaacttagtcaacggcttgattgtctagatattatgtttcttttcatacttagtactgcatcagttaagtttgatctactaagtcgggttttgaaacataatctctagcctgcttcttgattgccaataagggtttcatcggggtttcagccggtgagttatctggacgttgcatcggctcataaggattgcatatacatataagttggatttagccgatgacaacaaaggtttcactgtttaatctaaccttgtggatttcatgacatcggatctccagccgatgtatgctttaaccttcagatcagtgcttattctatcatatcaatgctagacgattggtttatactggacaatattattgttatattttattatcagtagttgattgcctatatatcattatttactaaagtgttagaatctacattagacgtatagctgattgctcaaaaccctatcgctatcggctggtatcggcatcggctattatcggctatcggctggaactactccatcggcttgtcagccgatcggctgttttgtctattatttgcatatcttgtcagttgcaggatcaaactgactggcacacccgcatcttaccaatctttggacctgcacaggagctaagcagatctcccaggccggtgtgttcaatttttttcgtcaacacattgtcgtccatcgaccataccatgactaccgcaaccacttgcccgaccccctcccacaccgcgacgacggcaccgagggcataccagctttcaccgtcaacctacgtcgagtcagatggccggccaacttcaagcccatgggcatcaacaagtatacgacggcaagaccgaccccagcgcatggctttccgtctactctaccaccatccaagctgccgggggcgaccaactagtcatggcaaactgcctgctagtcatgctgaccacagccgcccaggcatgggtgacggggctaccgaggtacaccatcaacagttggttcgaactgaaggggcagttcatcgtcaacttccagggcacctttccccacccgggcactcagtgggatctataccagatcgttcaaggcaacgacgaacgcttctccaattacattcgccgcttcacggaacgtcgcaacaccattctgcatgtcactaacacggaggtgatggcagctttccaacaaggctgcaagaacgatccaattactcataccaaattctagaattgggtcactcatgttaagcagcatgttttaggtacgattcataagcgagttgtcaaaccacattagcttatgtcccctaaacatagccatcgggagataatcaatacctccaacaatattcactataaaaccattatgttcagacatatccacaaaaatagtggggtgtgtcgatgcaatcatcgttggcacaacgagctcaacttatgcaacacgacgaatctttgcatggcttgcacacgtccacacgtgaaaaacgccagcgtgcgacaagcatggtcatcaaccgatggctgatcaaccaacacaaccagggagtagtcaccgactacaagaacacgataaaacacaatagtgcatagccaacatttgtctgaaatacagttacaccgaattgtgttagtagttgtaactccttggatcatacactaattgttcttctaaactaaagcattttgtcaattccagcatgaagataagctttagaatagaataggaaagaccaagaactttatctatctagaaaatatcgatctaatgcaaagttccaaactaagcaaaagataaactgcttggcaacagacaacagtatagccgaccaatgttctcctaggacatgctcgaaactagccatacaactcccattgtcaaaacaactttattagacaaacactaccaaccattggtcatcaaccaaaggtggccatttagcgctagatccacgcgaggatcgagattgggtcaacacccaagtttagctgttggtgctatagtgaagtgggaatcatgcatattcacagtatctaccctcgggcttattctgctagatttggctccaattttccggtgtccttgcaagacatcaggttcaaaataatattgagaagatatgtgcacaataggggcaaccatatgaacaatgtcattccaccacatggaaaacactttacatctttcaccggaccgagtgaaaaatatctcaaattattgaacctcgcaactccaagttgctagaaaattgaggtataatcatttatctccaaatcagaaaagtgtgctctcaaccattgggaaagcaaaatgtcgaccgtagtccgactgtactctaattgagatgttaagccactaggggaaaggcacagagaatcccaagcccataatctaatttcacacatttcaacgactcagaatcctattcttgagtgtgatcatagggatagagtgatctacattaatgcccaaagctatagtcattgaaggcctttacgtgaaatcacccacactatctgtccaaatcatttcatgcagttctcagagaacccaagacgcaaacggacaatatgcgtgatgaattcggcaaaagcatggatctcgtacaacaagaatacgtgtctccatcttgtagacacattaatatcaccatttatgtatgaaggagtttatcagtaaagagcggtcttatccatagccatggatattcaatttcccagaattttcatgcattaggtgattttctgttatttacttggtcttatttagcattgtattcccaatatttatgtcacacagaaaaccatcacatattgatgcaggaaaataaacccatcataatgcttccaaggggagattcaacactatgtgaacacaatttatggaagcatcataacctagaaatccgtatctaaattattttattggaattgcatcaactttaaaagcattagaatgtttaaaagcaccattacatgattatttacgagtccgaggacccacacgcaaaaccaaactatacaaggcctaagcaacaagaaaattagatgcatatactgatgcatgcatgcttgcaacatgctttttgccgatcgatctcaagcatccaaggacgcaagatgcatccatacatgcgcgttacaaggccaaccctaggtcgtgccggcgtgaagtcgtgcatgaagagatgcagacgacactgcgctatattagatagcaaatccaccggtacatgcaagccaagaacaaccgagcaaatcaatctgtcgttaaaaaaaatcaatctaatagcaatagattggaacgacaaaccggtgaacgaagagctgctgataacgtgttgtaaaccaacacgcctattagcggatcaccggatcctttccctgtccctcctacaacaatagagacgtgatatcatgtcgaacacccgcgcccattcctttgccctcaagaacattgcagaagtagacaatgaacacaaatatagggtggagttctctcttcattatagatctcatctggagtacaagccaaccttaaatattacaccctgcccctgtatatctaggagtcttaggaggagatagaacttatctctactctgatttagattggcccacaagaaacttatctcctagagatttgtttcacaacaccaataactcgtctagatttatgtgcggccgataagcccatctgatttgaacggtgccaagtctcatttttgtcatgtatggtgtttactgattacttttgtttattccctcagttaaacataatatagattgtgtgtctaattttaacatttggttactattttaagatggagatcagtgtaaccttcatacttcattcatgctggtttaacagaatgatcttaataacgtgacgtgactcttacagtatgtaacgttacgcgaggtcgtgagtcttacacagaatgcagcctaacgagtactaacaaggttttcaaaaaaacgagtactaacaactacttcctccgttttatattgtaagattttctaacattgccaatatttatatatatgttaatgaatctaaacatatagttttatattgtaagattttctaacattgccaatatttatatatatgttaatgaatctaaacatatatatatatatgtgccgagctctcttgcagtgacagcctgtcctggacagttggttctacgcttcgcactcacgtgccacatggaccgtgtgcgccaatcgtcggcaagcttagcttcaatatgcatggacagcttggagtacttatatacttacttacacagagatccatctcctagctgaaatcctgaaacacttcagcatcagtaaaaatcaaccaggtgctcgatcgatcggatcatccgagttgcagaaagatagcaagaatcccgtcaccaacaatgtccgtggagatactgatggatcttaaccttatcaatggccaacctccgagcgccagtgccgacgacgccgccggcgatcaggcgatgccggccacggggaaccccgtgcaagtcctgatatctcccatcgttcccgtcccggcgttgacggggacgcagcggctttgccgccggcgtacacgggcgtgctgtacctgcaccaccacaagaaggaggaggaggcggcggccgcggcggcgctggggcagttgaacgaggcgaagaagaagcgggagaagtggctcaaggagatgagcggctggctgatggtgctcgccgtgctcgccgcctccgtcacctaccatgccggactcaacccttccggcggcttctggcagcacaacgacggtgagagtcacgtcgccggcacgccggtgctccagtccaacttcccacaaaggtaacaacgacgaactaatttttgcctccgaccacggcgagacccctccattaatctttcttttcaatgtttgatgtgcatgtgataaggtacaccgtgttcttctacttcaacgcgacagcgttcgtgacgtcggtggtgatcatcatcctgctgatgaacgagtcgttctaccactcggaggcgaaggtggtggcgctggagatcatcgcggtgctcgacatggtgtgcctcatgggtgcctacatcgccggcagcacgcacgcggcgccctgctccatctacgtcaccgtcctcaccgtcgtcgtcttcctctacgtcgtgtacgcggcggagctcctgcgcaagatctggtggctcatcatccacgcgcccgtgcacgacaccgccgccaccggcggcggcaagctgcccgccgtgccacaacacatcgtcgagcaggcctcgccgcaccaccgctgccacgccgacgacgttgatagctccatgtcggcgccgccacggtagtccgtcaacgtcgcctatatacttcctccgtctcgccgttgacttttttaaacatatttagccgttcattttattcaaaaaatttaagtaattattaattcttttcctatcatttgattcatagttaaatatacttttatgtatatatataattttacatattttataaaattttttgaataagacgaacggttaaacatgcttaaaaaaaataaatgccgtcaaatatttagggacggatggagtatttaggagcagagacgagagtacatgtgttgtgtaccatgtgtctgtgagtgtaatttcaatttccttgtgtatttcgcaacttttcagcttatgaatcctgtgatgtttggagctaaaaatcagtgatcctttcagaagttgcatgcagaagttctgcactcctttttctttcatgcatgtcggagtgaggaatctttatttcgtctacttggatcactgaagatacacagaattgaccagccaaggaaatgtaaaaatcgatccattaataaatgaaaaacaaatgagtaaaaacatgagaggggtaagagagagagagagagagagagaccaatgatcctttcagttacatgcagaagttctgcactcctttctttcatgcatgtggagtgaagaatcttgattgtctacttcgatcacagaagatacacggaattgaccagccaatgaacagattgtcccactctagtgggtgttatcgtttattataatcttgtcatatttcaaagtcttattgatagccttaggtgctaccaaataactagcaaaatacctgtgctttgcaacggataaaaaaaactttaattttacgtatgtagtcatgatgggtaaaaccctgccaacttatagacaggaagctgaataatacatataaacaaaacgaacaaattaagtgccagtaaaataaaagacgcaagtcatatagtaggaaaagataaaacacccgcgctaacggataagcaaacaaagacaacaacacctcaacaattggtggagagagccaaaggagcaaatagtgagtgcgtaaggagttgacggccactatggtattcaagcaataattaatttaggagagcatattgagataccatattcaagaggtgaaattttgatactagacactttttgatatagctccagagatgcaagattttttagagctgagtattttcagctccacaaatctatggatatggatctacggttacgctgatagcatttagataaatcattttgttcacattttaaataaaattttaaattttaaaccactatagtttaacatacaaactttatatctatcataggtattagatttggagttatgccaaacatgacctactaattaagtcacaagttctaggcgagctcttacatttcgttgacctcacagcatgcatgcggatgcggataaatttcagtgatctcataaaataacatgaattaacagggcttgtactacgcgagcagcttaaacgggaataggagttccatgttcataaataatgatactaactaagaaataaccacaagcccacacgtatagatgtttgatcagcatttgaattggacctagattacatttctgcggatttgtagttatatcgttcaatttctcaatatgtgaaatcctggtatcaattaattgttctgttttagttattgaaccatcgactaaactcaaacagtacaagccggaccgaaccgttcctttttccttttctagaaaacctctcgaatatgtacatgagcgtcctgcatccaggcccacattgtgtagcccattcatcacgcagtggcggagctagccccgggcaggtcgggcgtcgtccaggctcctccgctaacgtcttcactgtaaattaatagccattcatgtctaaaaaaattagtcgaatattactggaaaatgttagtactcattcgggcttcacgatatcaatggctccaccaccgcattcatgtgtgtccgcgtctgtcccttccaagttccacaccacacgcatatattcagcttccatgttgtagaaaaaacattagatttttcttttcccagttaaaaacctgggacactactggagaaatgattttgctggatcgcttaaaaatcacattagtcccggtttgaaaacacacaataattttttttttatatttagtcccggttggtgttaccaatcaggactaagtattatttttactcccggttcaaagacatgtcagagtcctattattttttagtcccggttggtaacataaaaaaacgatgaaaatcctgcctcgagccgcgcgccgtgccttgatctccccgctcgtccttatcccctgcttctgtgctcctcctgccctgtctcatgctcttcttctcctactcccctccttttctccacctcctccccctctcccggcctctcctccccttcgtcccccttcccctctcctccccctctcctctccctggcggaggcagccaggcgaaggcggccgggcgatagcggctgaacagcggcggccgggcggcggaggccgggaggcggcacacggctgggtggccaacggcggcttgttttgtgattttcttttatttttggaatgatttgtaaatttcggtgtaaattattttagatttggggatgatttggtggatgattttgtgaatgacttgtggattgtggatgattttgtggatgggctgagaattgtggatgatttgttgtgcatgatttggggatgatttgtgtggatttgaaggtgacaataaatgcaagaagcaaaaaaataaaggaaaaaaaagcgcctaaccaaccagactaaaatggcgctgggaactttattcccggttggtgttaccaacggtgactaaagattcatttttactcccgtttatatctttagtcccggattggtcgtcctgatttgcaacccaggactaaaaggggttgtaaaccgggaataaagagcccttccccagtagtggtaacgtcaaccagtcaacgggtttggataagatcgatccccttaggacctgtttagttcacgaaaagaaaatttttgggtatcacatccgatgtttgaccggatgtcggaagggttttcggatacgaatgaagaaactaatttcataactcgcctgaaaactacgagacgaatcttttgagcctaattaattcgtcattagcacatatgggttactttagtatttatggctaattatggactaataggctcaaaaggttcgtctcgtgatttcccccctaaatgtgcatttagttttttaatctatatttaatgctccatgcatgtgtccaaagattcgatgtgatgtttttgggaaaaaagtttggggaaccaaaccaggctttgagcttaggtggtgtttggatgcagggagccagggactaaactttagtctctatcatatatgatgtttggacattaatttgaaggactaaacatagactacttacaaaactagttatataaatgagagctaattcgcgtgacatttttttaagcctaattaatccataaatgagagcacatgttttctgtagcatcactgttggcggctgttaaatgtcaattctataccgccaacatctacataaagttcagataatagagcatatattccacagtgttggtgtatatttgtatgcagatgataaaacctgatgttgggaggaaatctggactaaagtgaggagaattacgtatccatacaaggaggggttgtgaacttcatcaaaacattagtaaatcaacccaaaactccgaagaatggatagaggaggactaggagaggagccaggccaaaggccaggccaggagggaacttcatcaaaacatcagtaaatcaacccaaaactctgaagaatggatagatgaggaccaggagaggagccaggccaaaggccaggctaggggggcccagcccaggttcggccgaaccctggtgatcaccgttgatcccaggttttggcatggacgctccagatgcattcctgatggcggttagggggcacttcggataattccccttcctataaccgtcatacctgtcctataaatagacctcacttcattcactctcacacacacttccaagcttgagctgaattataagaggctctattgtactatattgtgtactagaataggaagagagtagaatagaagaagtcggaagaattccggagttgtcggtaatcttctcctatttcttttattctgtttattactctgagttcaatataatattcttcttgagtaatttagatttatctcatgagaattatctcttggttagttcctaaatagcatacaggattattgttcactataaccaactaaaatatagtgattgctttagtgagttataaaaactaaagtagatattaattgcttagacgtggtgtttaggtagttgttatccagtaattactgcgtatcccacagtacgtttgaggtgggtgtagaggtggtgacagccctcgagatcacttaagtcctccctatccgggtacgtagtagagcgatatctgggaacaacgggtttccagtgcctgaagtattgcgttacgattaaaattaagctttccctagatgtttctcactactaaatcctctctatcctagcctatcatctgcttggtgtccttggatgaactgaaggaagatctgatcacacacgttcccttggattcaatacccttggaatactccatagggaaagtactgcatcggtatatccgtgcgcttgcggattttatctgtgatcgtaagaactaccaacaagcatttctggcgccgtcaccggggaacggttgctgatcatttccgaacctagttcatcctcgtatcatttttaagttttttattatacctttacccctgctatcctagagaagtattcctgtcaaactcttctcgaccatggagcaacctcttttttagctgtctgctcctcggggcgaattctatgagccaccttcttcatcggagcccatttatacaactggctatgaaattcgtcccgaactaattagtatggttagggaaaaatcttttttctggctttgatctagaaaatccctaccatcatctgcgagactttgaacaagtctgctcgtgccttaagatgcgtggcatgagacaagaaactgtgcggtggaaattgttcatgttctctcttcaagagagagcaaagaaatggtacacctctaccgttggatgtgtaaacggtagctaggaaaagttgcgagacagattctgtcttgccttctttccagttactcgtattactgcccttcgagtagaaattctcagttttaaacagatcaagaacggatcaattggtgcagcatggtccagatttactaatttagtgcaatccggaccaaccctgtccttacccgagtatgtgcttcttcaacatttccatacgggtttggataaggagtctgcattctatctggacataaccgctggaggatcggtcatgcacaaaacaccgtcagaaggaaggacaattttggatcgcattctagaaaatacttccttcatgacgcaatccaatgaaccccagccggaggcatccgtgtccaagatagaggaacctctaacgatcgagccactcactgaaccatccacttctgctagctcgattgatgagaagtttcctgagcagctgtgaatcccgctccctcgctccgaattcctgccgggagacacggcgccgcgtcgctttgcgtcatctgttgttccgtcattgtcccatcccgagttctcgcggatgcgcgtccccttgccatcgtctcgtcgtcttgttgcccatccactccgggaagctgccaagaccgcgtctctccctctctcttgcgtcgtgtcgccaccaccgcgtgacgtcgctcccgtcgcctcgttctgagctctaccgtcccaactcttggctgtagctttcgtcgactgcgcgtcatcgttgtcccgtcgccattccctctctccgcgcgtcacctcgtgtcatgtcaccgtcgtttcgccgtcgcatcgccaccggtgcgtgacgccacgctgtcgcgtcgccatcccctcccggattcccgctgtagtggctagccagctacccacagttctcccgcgcctagacgccagctcaccgccacgtcccgccatgccacgccgcctataaaagggcccgagcccccatgctcaccacgccattcccatctctcctctctcttctctcctgatttgtctgtgccgctgctcaagccgccgcacctcgcctcccagcgccgccgtcgctggcatagctccaccggagttcgctgccgcctccccgaccgccggtcgccgagccgagcctcgctgccacgtcacgcctccgccccagagctgaaccgagcgagaggaggaagaagaaaaccccaccgctgatagccgggccccgtgcctccttctctctttcagtcactgacaggtgggcccctcttgctgtccgcattagcggaatattccctttccgttaataaatagatttccaaatattccaaaaaatccttttaatctttgaaaattcatagaaattcaaccgtaactccgtttgaccccttcaagttcctatatttttctaaaattgagatctacacagtggcatcattgtttctctgatttgagcttgttttattgccttttgttaattagttttgtttttcacgtttagagcctgagtacgaggaagctttggaggccgcttttgagggagaagaccccagccctgtgcaaggcaagcctctttgatcacattgcccctatatttgcaagatatgtttgtttgataagtgcattgcttagtatacacgataaacatgtttaggcctcggattgtttatacaaccgacggactgacatattagttgcagttagtttacatatgttgttgtttctttacctttgatagctccacaaatatttgcgccggtatcgttatgcgactaccgaggtagtttgcttagccatgctaacgttgatttaccgtgtaggaaactaggttattccaattacatgctaaaaaattcagtatgttgtaccgaggtgctgtgaaataaaatgtgctgtgtaaatagtgatgatgcaaagtcatgcctttgtggtttggccacgtattatcgttaaggaccgtttcctttggaaaatccatccaaacacattacagcgcgaccacacgggtgttgatgggatgcctctggctaagtaaattgttatcacataggagtgcggtgtgccaatggttgtgggatgccgagggtgaggagacgaagtttggatctttatagcccttttgggtgtttttattgcctctattgtggcacgcgatattagtaggagacatcctcgatatttcctgagtggatgaaggctgaccttgcctgatactcggctaagagacttagcccaactaggtggcatgctattttcatgggttagctttggaaaagccttatcacgaacttctgttaccgacgagtaaacagtgtcagtttcgtgccgtgtgggtaaatcgtacaacctctgcagagattaatgaactgttcgaacagccgtgcccacggtcaagggcgagtgtaaggtgtttctcatagtgtagattcatttgacaaatgattaaggaatagtggttattgggaaggaaaacatttccagagtccgcctatgtggcagacggctaacctttgtagttaggaatggatctgtgtgacccggggtgtcgtctaacaccgagatgtcgttaggggcgagaaggtgttgatgtgctgagatagctgggtgaactatgttgttgtgaaagtgaacagaaaataacagaggaagcaaattaattattgttagttaatcttgtgacaagttgttgcaaagcaacttgtggaatgggtcgaggcgtgagcctcctcccgacaactaacattttgactcactaggagttttgtgaaataaatcactttgccaaaaaggccgcttccgcaaataaaaccctagtctccttgtttaaaccgaacatgtcattctttcccctagctcgctgagtacgttaagtactcacccttacccttacattaatctatagagtacgaggatgaagatgtcgactcgaccgctgaggagtgtctctaggagcaagccgagtatgaagacttctagatgtttcgtgcctagcccaaagtctcgcctgtggaataagttagttttctaggtgctttgcctagtgcttagttgcttagtcgcttagtgtctccgcgctgttcgcttatatgccgtcgcttttatggttttctgtaatgttgtgttgcttatctatgggcctgtccatgatggcaacgtttgtaaggactactacctagtgatataataaaacagtttactgtgattcaacatttattctgtgtgtactagctagtgtatcctgggactggtactatctcacaggtaatgcataacaccctggtgtaagttgtcttgtgtttatagctaacgaatatcggggcgttacactccacttcctcaccaggcctcctctggttcctcatgaacctgtctcatcggtggggagatgccatcgagcttccgtccctcaccaaagccgtgcactgccgctcggagctcgacactgcaagtcaaagccaccttcatgaaattatgtcagatctcactaattgctatgtgtcttgcttgatttcttattgtagcaattgatatcccgtgcaatccttgttgtatttatggggttgattttatcactttttgagtccaaatcaaatccgtatccgactaccttttgtgttgaacttggtatccgctcagcctgtctttgtttaattttatttgaacacgggtggacgacgtgagcaaatggacgaagcgggcatgagctgcaaaggcgcaagacaacggacgaaaatgcatcggtgccgattagaaagttgccgattttttaagtaggtataagataacattagctgtaccttcgtctgttcaagccaaggccggaatttccactattaaaaaaaaaggaaggaaatgtacagattaaattccctttgttccatcataaacaagcatcgatcacacatgagttcttttcccagctttcaggtaaacctatcatgtatacaatatattcgttagtcagtcttggtcgtatataattctcatggcaccttttaccctcctgggcctcctgggtgctggcagcttcatgatgtacttcaactaattaacaagtccaattaactgatagtacaattcttcagccacctgaatagcctgaaaatccctttcttgtccatgtttcaagtatatatacaggactgcgcatatatgcacccttccgtcatcttcaccaaagataaagcagagcttttaaggttcttgggaggtacccaatgcaaggcacctctcaaactactccatccgtctcataatataagggattttgagtttttgcttgtaacgtttgacaactcgtcttattcaaaattttttgaaattattatttattttatttgtgacttactttattatctacagtattttaaacataactttttgttttttatatttgcaaaaaaaaaatgaataagacgagtggtcaaacgttgcaagaaaaattcaaaatcccttatattgtgggacggagggagtactcagcatcatcggcccttgatttgctaaagggcaacttagagataaaaaagcactacaatggtaatttagtaattgtttcagtcgtaacagcctctaactccttcctggttgtttgctgctacgccctaattaatttttagccggacacgaactggccactggacacaagccccaattcactaattctcatttccacttgttgcttgatcacatcgctatatatgttttcatccactatatcactgccacttacgtaggcttcatccactaaaccaaatctattttcttcttgcctctaatggttgatgtctaaaatttgacttttagtcattcttgtaaacccatttgtgcgaatgcaagatatatatttttctggggaaagcaagatatattctaattttaaccatgctttcttgcacagttacatatggcgttaactactaatcaattaccaatttattgtcatttacacaggttacgattaatggatgactgatcaattacatagctctatcagtatatgcaatcggccttctcttctacctctaaacgcatgtttgtttccctgtaatcgatgattggaacttcataatatgtccggggccatgcatccaccatacataactgctgtcacgtcctgataaattcatcccgaaataaaaatcattttccaaaaggaataatagaattaattaaaattcgaaaagaaattggcaaacactaaaatacgtacaagaaaaagtcgaatgtggcccggagaatttttggtaaattctccttggtctaaaaggagccctcaaattttagtggaattttcagagcacaaataataattattaagaaataaacaaagttaaaatggttttataaaaagaaaaagccctaaaaagtcctttttccccccttcccttcttgggccggctcggcccaactctccctccctctctctcctctccccccccgcggcccatcgggctcctcccccgcgcgcgcgccgctgacaggcgggcccgcccgccaccctcgctgacgggtggggcccacctgtcatcgcctaccttccgccgctcccgccgccgcccgtgccctagcgccgccgccgccgccgaatccgccgcatcccgccatccccgcgcgccataaagagggggaaatcactccccgcgattccctctccgttttcccccgcttttccctctctctctccctcggatccgtttggaatcgcttccgcaaacctcgccggcgccatcaatggcggccggatcctccgcgccggtttccttcccctccggccgctttctccccctcccggcgctatataattgttccccgtgcctctctcctccgtttccgccactcgccgctcactctccccgtcggaatcgtgcccgcaccgtcttcctctctctccgccgtcgccgccgagctccggttcatcgccgttgtcgctccggacttcctcccgactcggcgtcacctccttcggcttcgccgcgtcctcgccaacctcgtccaccccttcgtttcgcccgccgaccgtcggagcgccgccgtcctcgtcgatccgaaccgcgccgccgccttcctccgctccggttgtcgtttccgccgccctcgtcgtcccggggtgagccgtggaccgctccgttcgcttcccccttccctcctctctctcgggtgccgctccgccgcgccgttggtcgccggcggcgaccatcggggcgcgggtgcgccgccttccgtcggccgtgccggcgaggccgccttcgggcgcgccccgcggctgccaggtgggcccggccgtcagccgcccgcgcccgcgggtgcggctgacgcgtgggacccacggcgccggtcggcgtcagccgcgtgcacccggtccaccgtggaccgaggggctgacgcgtgggccccactcccgtggacccggtccgcgcgccctctctctcggctgacgcaataaacccgatttttaattaaaatttaaatgaagaaattcgcaaatatccatttaaagagcatataaatttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagattcgctcttcgtggaagtagaagccgacgtttgggaaagcaagcaaggcaagtcacatcatccttgaacatattgaatcccagtttatcaaattattttgatttaaattattgcattattgctttatttaaattcccgcgttatcactgttttattaagccatgcttatttacctttgttaagacattattattgccattgttattattaccttgttcaccctagaataaacaaaaccccaactagtgggtactctattcgtggttccactagtataaatttaggtagatgcttcgctgattaattaggcaacattaggtggttttataactttagactttgggaattctcatatcatttggacactatggaattgttggattatggtggaattggatatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgagccctcggatatgggcaagcctagcaatgtacccaagttagtggtttaattcttaaaatttgcttaacaactaaaatgtggaaaggttggcctgggttggcttgggacgagctgggacccaggtcgggttgccagttcggtccgaatcatcgtaggccttgggttaaggcaggttcgtgtgggtccacggccttgattaataatattgtgtagctctaagatcgtctttataaaatagctttgggcaactaagtgacttttaaatgctgtttactgcaaaacctaacccctattattatccccttgtaccccccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtggagatggagctgtaggcccgctagtccgctgctgtttatttttgattgtcaggcctgaagcgcctttgtaataatgtaaatattatcgatataataaagatgtgccttttgtatcatgtttgtttggtgcaccccggcttttcctgggacggggattaatgcactagcgttcgggaaaaggcaattttctcggtcgcgacaagctggtatcagagccatctcgactgtaggttaagccaagtggataaaacctaaggacatattttataaatgaaactatttgcgaaagttcctttttcctccttcccccaatgctatttggaaaaggtttattcccttcttcattcttcggatttcaactagtactagatggtcaggtcggcaaagaagaagacatcgtcagttgtctgccgaagctgcagaaggctgttggattcgttagcgaagcgaaggaagcagtgaagccagatgtgaagcaggagtgaagatctcggagaacccgtcgcagaacctaagccaccctctagggtagagtcgttagtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactagtccaacacctgattaaccagaaccgattgcttatagagatactacagcagcaccagacgccaatgctgaacttgagtcaaatacaacctcaagtgcagttggaggcagtccaagcactcacaccacaagtcagcatgccgccaacatcccgaaggacccatgatgacatgccacatgttgacccaaaagaagcaagtatcatctgttttatgtgtgatgagcaagtgcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctaatggaggtagagtatctgatagtgaagattcagatcaagtctcctcagatgatgaagatgaaatggaacgtaaggcatgctctcgttgtggagaaatcggtcatgtcgccagctcgtgtgccactatatgcgttcattgcgaggaagaccatccacccgacaggtgtccaacgagcaggatcacttgtttcttttgtgaaggaactgatcatgtaccaaaagattgtcaattcagttttctgctgacgaagaagatggctaaccaacccgccagttccaatggagagaagcatcaaggaagcaccaatcctcgccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccggcacgtcagtccacgcaaccccccgcaatcagaagcttgctcctcaacgaattgtcatccatgcatcccgaagcagtcctatagcccgcgttgcaacagctccaactccaatgagtgcactaccacaaggtgtcaatgctcaatttcagccccagccaccagctgacaagacagaggtcagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcggcctccacattttcgccaatttacaggaagcaaccatgccaatcaccaagtagtcagtggagcaaatgcagtacctgttaagcctagtgctagtcagaagcaaccataatactcttgtatcggtgttcaagtacttttgttttatagctgttccccgtcaatcatgtaataacagagaaacatgagataatgaatgagattggcaagtttatgtagggtccatattaagattgcaagtgttgtgtgatgggtacatttggttgatgattaaggagacctagggtctcatttccgtaagctcataatctattatgaatcaaataacctagcgattgatggcgaagaaaatcaagtgatcaaccaaagagacatttgtttggactaagagtttccgatgtgtcttcttcggatcaaaggcatgcacccgttgtggaaaaattggacatgttgctagcatgtgtctcatcagctagtcagctccaacagcaacattgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctatgatgaatgattgcaaggtgagtatatgacatactcagcaagccacgcagcaaatatgcaagtgcacaggataacaaaggatggcataatagggtttcatttgcaaaagcagcatttagtaaacatttgagaatttaacaaaacagttaagtaataattaaacaatattaatccaacgctatacaacataccctgttgtataggcccaaccattctgaacaaccaccccggctgcacagttctatctccaaaccaggaatgtcccattccaaaccaggagctaatcaaattattaccagtttaagcatcttttactatgatgagaggtgtgagactaatcacgaaagacattgttagacccgcccataaccgcgggcatggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacaaaaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcaactagggtttgggtggaccggcgcacgggcggcggttcacacgaacggacggccgagattgatccgatccaaatcggacggccaagatcgatcggtctacgaccggctcacgggataggatcccgatgacgtcagcgatgacgtcaccgacgacggcggcgactcggcgaagaagacggctcgggcggcggacactcgccggcgaacggcggcaccacggcaccaacggagggcaccagcacgtagaggacaacgcggcgaacacaccggtgaccaaaacggcggcggaaaaggaacggacggcgacggcgacgagaaggaagcggcggctaccttcgggttgacgacggcgacgatgctccggcgggttccgacggctgcgaaggggcggacgaggacggcggcgacttggcgagcacgacgacggtcttcccgagcggcggcgacagctggagcgacggcggagcacggctgaagcggcggcggcgacggcgaagctagggcacacggcgctagagctcttccgacgacgagaggcgaaggcgagggtggcggcggaaaaagaagggcatggggatccttttaaaggggctcggaggcgacggcgaaggcccacggcgacggcaacggcgaaggaaactcgcggcttggaaagagggaaaaccgatccgaatcgaactcgattccaacgctttccaaagcgatttagccgaagattccaaaggagaaaaggtagaggagatcccggagatcatttcccctctattgattcggccggagaaggaaagaggcggccggatttggaaggaaacagcggcggcggctcggcggcggcgcgctagggtttcggcccgaggaagacgacgggcctgacaggtgggacccacctgtcagcggctgcgagggcgcgcgcgcgcgcgggcggctgcggactgggccggctgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattagaattagattttcttttcaagacttttaaaataaattctagaaattccatttaaacaacaatttatatattttgaattttcagggtgtgacaaacctaccccccttaaacagaatctcgtcctcgagattcggaagaactggcgaacagaagcggatgagctgactttaattcatcttctcgttcccacgttgattcttcttccgagtgattactccattgaactttgcagaaacggataactcgattcctggttcttctctcatttgtttccagtatacggattggtttctcaccataagtcaaatcctcttggacttctatctggtcaatattagcttcttcggtaggtacccttaaacactttttcaattgcgacacatggaacacattatggactcctgccaaggattgaggtaactccaactgataagcaacctctcctcttctgctgacaatcttataaggtcccacaaaacgcggtgccaattttcctttggtctgaaaacgatgaactcctcgaagaggcgtgacacgaagatacacataatctccttcttcaaaactcaaatctctgcggcgattgtcggcataactcttataacgagattgagccactcgcaatctttcttgaatgatctttaccttttcttctgcttcccttaggatatccgtcccgaaaacctgacgttctcccgtttgatcccacaaaagcggagtgcggcacttccgaccatacaatgcttcgtaaggagccatctgtagactagcttgataactgttgttgtacgaaaattctgcatagggtagattcttatcccaacttccaccgaaatctagagcacaagctctcaacatgtcttccaaaatttgattcaccctttcggtttgcccgtctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccagaataggttgtctttaccggaatgaaatgagccactttggtaagtctgtcgactatcacccaaatagagtcatggcctgatgacgttctgggtaaaccagtgataaaatccatacctatttcttcccatttccattcaggaatcttcaaaggttgcaacaaaccggcgggtttctgatgttctgccttgactctctgacaaacatcacatactgctacgtattctgcgatttcacgcttcatacttgccctccaaaacctttccttgagatcctggtacatcttggtactaccagggtgaatggagtataaagtatcatgagcttctttcagaattgcatcctttagatctttgttgtcggggacactgtcgcgactgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaaggggggaaagattgagcaagaatgagtacaaccacagtactcagcaagccacaccggagatgcatgattaatgcaagggggtacaaggggataataatataggggttaagttttgcagtaaacagcatttaaaagtcacttagttgcccaaagctattttataaagacgatcctagagctacacaatattattaatcaaggccgtgaaccctcacgaacctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttgtaaaacctcctaatgttgcctattaatcagcgaagcatctacctaaattcatactagtggaaccatgaatagagtacccactagttggggttttgtttattctagggtgaacaaggtaataataacaatagcaataataatgtcataacaaaggtgaataggcatggctaaataaaacagtgataacgcgggaatttaaataaagcgataatgcaataatttaaatcaacataattttacaaactgggattcaatatgttcaaggatgatgtgacttgccttgctcagagataacggccttccgaaccttcggcgacgaccacgaaccacgcttcgggaacctccggaacgacagaagctacgcgaagcacacaagcaaagctaaaagcctataaagaagcaataacaacacataaaaagaaagcacagggttctttaggttataacaaacattaggagacttgaacgggtcgattcagagttcgtatgaccaagatatgatcatccgaagtttaatgctgttatatggagatttgcgaattattataattaagctttgcaattataaaacatgtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccgataaacggactccactagacaccacccgggttgcacacgtggaaaccacgcggctaccgagcgggcacactaacgcggacactacacggtcaccacccgcacgcgtgaacgactaccgacaccggtacacgggtaccggggtcgacgaccgcacaacgggtacggggcgacaccgaaaggacgagggcggggaagcgagaggaggaaaccttaccaccacgcgacgaggcgtgggaacgacaacgacgaacgggcgcggcggagacagacgggcacaacggagacgaacggcgaggggacggcttcggcggcgatccttgggcgaaggcgagacgcggccggcacgaggcttgacgacgcggagccgaggacgaacacgaggacggggctgcagcgatcttgacgaagcgaggacgacgaacgagaacggcttgacggagggacaaacgccacgacgaccgggaacgacgagaggacgaggacgacgacgaccggggccggcgagaaggcgacgagggcagccggcgaggagacgacgagggcagccggcaacggctgcacggaggcgaggacggcgtggaacacgccgcagcgatgacgatgacggaggcggcgccgcaagacgacgagccgggcgagagggaacggtgaaggcgacgacgggcacccgcggtgttcggtcggaggggaggcgaggccgaggactacgtctcagctgcgatgccgaagatgatgggggtgtggccgaccggtgcacggcgtggagggacgggcggccgaacaactccggcgaggcggatggaggggctcgcggcgatggcgttccggcgaaaccgaggagtggacgaggtggagggctacgtcaccatgccgagggaggggacggcagcgtcggctgatgcacgggcatggcgaaaggggcagccggagcagatgtcgacgagtagaagtgagccgggcggccacggtgttccggcgatgttcgggcgaggaggaggtgatgccggggatgagaccggcatcgtgaacccgagggaggtggtggcgacgtcgaccggcgtgcaggcagggagatgaaggcgactggaggcggccggcgcggaggaaatggatgggcgacggcggaaacgcagctccgggggtcacctcgcgaaacggagggcaggccggcgtggaggaggtggcggcgacgctggaggaggcgacggcgcggccggccggcgcacggtcgaggcggcacaggcggctggaggcggccggcaacgtgggagagagagggcgacggtggggaggtggctagagaccacgggagaccgcgggagggggctaaagcgatagaacggagtgcgggggttgcattttataggatgggggagggagccgggcacgggagagggcggaatgtcacgtcctgataaattcatcccgaaataaaaatcatcttctaacaggaataatagaattaattaaaattcgaaaagaaattggcaaacactaaaatacgtacaagaaaaattcaaatatggcccggagaatttttgttaaattctccttggtctaaaaagagccctcaaattttagtggaattttcagagcacaaataataattgaaaagaaataaacaaagttgaaaaggtttataaaaagaaaaaccctaaaagaagtcctcttttcccccccttccttcttgggccggctcggcccagtccctccctctctctctcttcccccgcggcccatcggctcccccgcgcgcgcgcgccgctgacaggcgggcccgcccgccactctcgctgacgggtgggacccacctgtcatcgccttcctcccgccgcgcccgccgcccgcccgtgccctagcgccgccgccgccgctgaatccgccgcatcccgcctccccccgcgccttaatgaggggggaattactccccgcgtttccctctcccgtttccccctcttttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgctcgctctcgccgtcggtttcgtgcccgcgccgtgctcctctctctccgccgtcgccgccgaccttcggttcgccgccgacgtcgctccggtcctccgcccgactcggcgccacctccttcggcttcgccgagtggttgccgaccccgtccgccgctccgcttcgcccgccgactgccggagcaccgtcgccctcggcatcccgaaccgcgccgtcgccttcctccgctccggttcgccgccgccgtcgctccggtcttcctcccggctcggcgccacctccctcggcatcgccgcatcgccgtcgacctcgtccgcgccttcgtttcgctcgccgaccgtcggagcgccgccgtcatcgtcatcccgagccgcgccgccgcctttttccgctccggccgccgttctcgtcgtcgtcgttgtcccggggtgagccgtggaccgtcccttccgtttccccctcctctccgctctctcgggcgctgctccgccgcgccgatggtcgccggcggtgaccatcggggcgcgggcgcgttccctcccgtcggccgtgccggcgaggccgccttcgggcgcgccctcgcggctgccatgtggggcccggctgtcagccgcccgcgcccgcgggtgcggctgacgcgtgggacccacggcgccgaccgccgccagccgcgtgcgcccggtccaccgtggaccgagcggctgacgcgtgggcccccacccccgtggacccggtccgcgcgtcccctccctcggctgacgcaataaataggttttttaattaaaatttaaatgaagaaattcgcaaatatccatttaaagagcatataaacttcaaatggccatatcttggccatttgaactcggaattggaccgttcaagtctctaatttttccttaagatgtaaagaacccatttttgtgctttgttcctgctgttatgtggagtttattagagtaaaagcctttttcttttccgttggtcgtgtagacgctgcagcttcggaagatccgctcttcgtggaagttgaagccgtcgtttgggaaaacgagcaaggcaagacacatcatcttgatcatattgaatcccattttataaaattatgttgatttaaattattgcattatcgctttatttaaattcccgcgttgtcactgttttatttagccatgcctatttacctttgttacgaccatattattattgttattgttattgttattaccttgttcaccctagattaaacaaaacctcaactagtggacactctactcatggttccactagtatgaacttaggtagatgcttcgctggttaattaggcaacattaggtggtttttataactttagacttgggaaattctcatatcatttggacactatggaattgttggattatgatggaattggacatacacctctcttcctctttcaaaacccctaaaacctgttttcggtggggtttgggtgcatgccaattgtgggaagtagcaccccggccactataaggactaaagctccggccctctggtgcaaagcactaccgtactttcacatgtctaatgggtaaggcttaatttgtggctcagtctagtcataaacaaaagttccccgatttggaaatggatgaagtccggcgtccatggacattcttccaggccaaatg

SEQ ID NO: 79344 - DNA, 30465 bp, Oryza sativa
tgtttgccaatttcttttcgaattttaattaattctattattccttttagcgaatgatttttaattcgggatgaatttatcaggacgtgacaaagattatccctaataatctagtacgcatatgtagtggtgcctctcaacgattctcagcaatatggagtacctaaccaagctcttataaggttcttaccagcaaagcaaaggataccgggaagacgtaatcagcgattgcagggatcaagaacctgtgctatctagaagttatatgtggagctaggaaggccaaatatatgtatatgagtggtacacaatccaatgacagatagtaatgctgaataaaaatcccaagtcacttgcccttagttgctggtctactcgtgtcctagacagtagtggtaacaattatggctcaaggaaaaatgataggacttgcaggcaagcttcggcgagtttcagcaaaaacagaaaaaccgaactggcagataagctcaacggagcgcatcgtaagctcaatgcactagtggaaatcaacttttcttttttttcttttatttttttgatatttttttctttttccagaacacgaaaataggcacacctccaagttacagctcaatcggagttgatatgtggcctatggaattttctgaaaccactataaacaaggtgcgtgaacttgtgagctcgaatagacaattttgcaaaccaaatttcggaattttggattcgccaaacccaccaaaggggggagaaacggatgtaaaatttttttctcttatccgaaaagttaaaatttgcctgattccgagtccgtacgcaaaagttatggctgtttaaagtttcggcttctggctagtttttccagaggggatataacctagtctattttgcggtggaattgggatatggtggcagcggagttgtagcgtgttctagtgatgcgtggtgatctggatgggtgtttatgatggcggaaacggctctcaaaggatgaaccctaacacacggtgaaaggtagcggctagggttacaaaggaaaaacacacgactagactaaaacacgcactagaccagcaacaggaacttaaactaggactcaaactcaacactacggactctgacaaagaatcatgcaaaggctaaacacggtctaggttaaggtaactaacgactaaaattttttttggcttttctgtagactctaggataaatgcgaaaacaaaaactaatctagggcaaagaaactgagcgaacctgacggtgaacctagagctctgataccacttgatgtgcactagggttcccaatcttccgaaaggttctgataaacaacgatttgggcggagtcgcgacacaaatcgatccggctttttgaacgcgcacgctcttgagccccgcaatcgcagcaccacgtctcctctggttatcacccgtgtctaatcacagatgacctcaccgagaaggctaatccctgtttgccaatcgaagaacacaaataagaacgagatagaaaacaaccaaaattgcatatgaatgattaagctcacgagttggggtcttacaaaccgatctagcggcgaaattgttctctacagattaatctaagtaaaaccaaaaaaacctaaagatggcggcggtactgatatatagagtttagggtcgtgcaaccccctctcgacgcaaccctaatgggttccaacacgatacacgggccaaaagcccaaatacggtgacgcagcaccggaacagattctggacgttaaattattcggtcaattcccattgacttggaaagaatatgtatgtggggccaaaaccattggaaagattatcttcttagctttccatccatataaagaacgccccaatccgagcacgtaggcgacctgggcgcccgttttagtgcagactggtactggactccgaattgcacccgatgtcgacttggtttgggcctccaccttgacttggatgtcctcgatgatcctccatggctctaagtccttctccaagtgtctacttgtcccctccattgttcctaatcataatatgatcgttaggtagcaatctattcttgaattcatacaaagaagaacataggaacgagctcacctctaaatttaattgtcgcacacgagctcttgttatcggtccttgaatgaccgttggaggattgttgtgtgtatccgaggtagtgatgtccgcatcagttatggcctcgggtcatgacaatacaccatcagaaagggatgtttaacaggaattgaattcgatctttactaaccgaaaagaataggaagataggacatcttttgttcttcaccagcggaggaacagcctgaggccatggaataccgcgattaatcaagcaatctatcctacaaccaaatttgcaaacatcaaaacatatagagactacagaagaacctgtgtttagaaattacctgacgacttaagtatccccatccctgttaggaataagtctagctgctcattgtagttagttgtttgctttcctattttcatattaagtctagcgcatgatctggtcttccgggttgtgcagattgtgggcttgacgcacgctgcgttcgtgcggagtctgttggagccgtgcgcggtatgctccagttcgtgggatggcgcgaagtggcaaggggtgtgacgcgtgcatttaggaggccactatggccacatttttgttctttcttgtaatctgctatttaagcttgagtcttaatccagaaaagctgctagttaacgcagcgccaaaatactctgtgtttgctctgcttccgctttgccggactagctacagttttcgttttgccgctaacaattggtatcagagcctgcggcgatcgccggggttcctgatgtcgctaccaacgccgcgcgtctcccactcaccgccgtgtcatcgctggcgtttgccgtctccgcgccgtggccgtcatggcggccgcggccaagtcgtggtgcatcgcgtcgtccgtgaggtgaccacgagcagcgtcgtctacccgacactcacccgcacaaattaccaagactgggtgctggtaatgcgggtgaacatgcaggcccaaggtctgtggggagcggtggagccggagggtgatgatcttgttgactaccggcaggaccggcaggcgctcaccgcgatacttcgcgccgtgcccgccgagatgctcgccacgctcgctgtcaaggagacggtgcaggaggcatgggaagcgatcaagactcgccgtatcggtgtgcagcacgtgcgtgaggcgaatgcacaacagctgcgccgagaattcggtgatatcatcttcaaggacggtgaaaccgtcgacgacttctcgatgcggatcggcgtcctcgccaacaaccttcgcaccttaggtgataatatcactgatgctgaggtcgttcagaaattgttgcaggttgtcccagaacatctccagcaaatagccatctcgattgagaccttgctcgacgtcaatgagctgtctctcgaggaagttactgggagtctgcgctccgtcgagcaacgcaagcagcgcaaggctgtggctgcatcgagtcgggtcgatgcatacggctgtctcctcttcaccgaggaagaatggctggcgaaattccgtaaggcagcctctctccaagacgccgctcactcctcctccggcggcaacagcgaccgccagggtcaagggcgtgggaataaggacgatggagcctcgaaggagacccagcccaagccagccaacctgggaggccgtaacccgggaaattgcaagaattgtggcaagaggggacattgggctaaagactgtcgcagcaagcccaaggctcagcaggcttacgtggcccaggaggaggacgacgagcctgctctgctcctggccaaggtggagctggatccaccgcgtcctcgtgtcgtcgcaccggcaaaccccgtctcgccaccgagcgcgccaagaacgccgtcgccgacaagcgagctcgctgtagttaaggcaaaagtcttcacgcagctcgacgatggtggcgagcactatccggcgacgtggatcctggataccggcgcaaccaactatatgaccgggtcccgctccgctttcgccgagctcgacacggcggtctccggcacagtcaagtttggcgacggctcggtggttcacattgagggccacggcaccgtcctgttctcctgcaggtctagggaacaccgcggcatcaccgggatctactacatcccgtggctcacggtgaacattgtcagccttggacagctggatcattctggcagcaacgtactgattcaccacggcgtcctacgcgtgtgggatccctgagggcacctgctcgtccgcgtcggacgctccgacaactgcctctacaccatcaagctggacatcgaccgtccggtctgcctcgcggcaaggagcgccgagccggcgtggcggtggcatgctaggtacggccacctcaactttcctgctctccgcaagctcgtgcaacaggaaatggttcgtgggctgccgctgctgcaacaagtaactcaagtctgcgacggctgtctgctcgggaagcagcggcgagcggcgttcccggcgcagtccaagtactgcaccaacgaacacctcgtgctcgtccacggcgatctctgtaggccgatcgaacctgcaacgccggctggtaatcgctattttttgttgcttgttgatgacatgagccgctatatgtggctaaccttgatcaggagcaaggatgaggccgcgaacgccatcaagcactttcaggcccgtgcagtggtggagaccgggcgcaaactccatgcgctgcgcacggatcgtggcggcgaatttacctcaatcgaattcggggaatactacgccaatcttggagttggccggaagttgacggtgccctactctccgcagcagaacggagtagtggagcgtcgaaaccaaaccatcgtcgccactgcccgcagcatgatgaaggcgaagggtgttcctgggcggttctggggtgaggccatgtccacaacggtctttctcttgaatcgttctccaaagaaaagcttggacaaccagacgccctatgaggcatggtatggccaacggcctgctgtgcatttcctgcgcactttcgggtgcatggggcatgtcaagatcaccaagcctgggctaaagaaactcaacgaccggagtgtgccaatggtgctcctcggctatgaggaaggctcgaaggcctaccggctctatgatccggtgagcgagcgcgtccatgtgtccagggacgtggtgtttgatgaagacgccgcctgggactggggatcagcgacgcccgacggtgcttcctagctcgagccattcaccgtcgaacaggtggtgaccaccaccattgggacggcacccgcttcgttgccgactctgccctcgccaccatcgccggccccgccagaccccacaacgctagcacctctgtcgcctccgtcgccaccgccggaggcggttgagtttgtcacgccgcctacctaggattccatcctggacgccgacacagatgacgacgtcgtgcctcgctaccgcctggtggataacctgctgggggatgcctcgctgcccagacagactccgcaggtgctggaacagctcgagctctatgctgtgagcgccgacgaacctgcctcgctggctgaggcagaggcagatccaaattggcgtggcgccatgcaagacgagcttgacgcaatcgtcgacaatgacacttggtcgctgactgacctaccccatggccaccgtgcaatcgggctaaaatgggtctacaagctgaaacgcgacgaacagggggcgatcgtgcgctacaaggcgcgcctcgccgctaaggggtacgtccagcgacaagggggtggacttcgacgaggtcttcacacctgtcgcccggctggaatcggtgtgcctccttctcgccgtcgccgcgcaccaagattggcaagtccaccacatggacgtcaagtcagcattcctcaatggcaagctgctcgaggaagtttatgtctcacagccgccgggtttcgtcgacgacaaccacaagaacaaggtgtatcgtctgcacaaagctctttacggcttgcgccaggcgcctcgcgcgtggaatgccaaacttgatagctccttgctgtcatttggctttcaccgcagcagctccgagcatggtgtgtacacacgcaccaggggaggaagacgactgaccgtgggcgtctacgtcaacgacctcatcatcaccggcgatcacgacgacgagattcgtagcttcaagggagagatgatgaaactcttcaagatgagtgatttggggcactcagatactacctcggcatcaaggttaccctggacagtgatgggatcacgctggggcaagctgcatatgccggcaagattcttgagagggcaggactcaaggactacaatccctgtcagactcccatggaggtacgtttgaaattgggaaagaattcagattttcctctcgtggatgctacactctatcgcagcttggttggaagtctgtggtatctcgtcaacacacggcccgatctggcattctctgtggggtatgtcagtcgcttcatggagtcacccagggcggatcatctcgctgctgttcggcgcatactgcactatgtggcaggcactcgctgctgggggattcgttttggcccaggtgcacagggcacttcaagaaagctgttgtctattctgacagtgatttggctggtgatctagatgagcaaaagagtacatcaggccagattttcttcgtcaatggcgggccggtcacttggcaatcttccaagcagaaggtggtggcattgtcctcttgtgaggcagagtacatcgccgtagctgccgcgacatgtcaaagcgtatggctcgcgtggctgttagcggaggtgatgggcgacgaggtcgccgcaccgctgctgaaggtggacaatcagtccacaatctcattgatcaaaaacccagtgcatcacgaccggagtaagcatatcgatgtcaaataccattatatccgggagtgtgcagaaaagaagctgattgaggtgatgtccgtgggaactgcggagcagcttggggatatattcaccaaatctctgggcagaaccaggtttcaggagcttcgctcgaagatcggtatgtgttctcttgaatcgggcagtcagacttaagggggtgatttgttaggaataagtctagctgctcattgtagttagttgtttgctttcctattttcatattcagtctagcgcatgatctggtctttcgggttgtgcggattgtgggcttgacgcacgctgcgttcgtgcagagtctgttggagtcgtgcgctgtatgctccagtgtcgcgaccgggaaaatttccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggcagatgcatgattaatgcagggggggtacaaggggttaataataggggttatgttttgcagtaaacagcatttaaaagtcacttagttgcccaaagccattttagaaagacgatcctagagctacacagtattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccacctacggccggaacctccgggacaggtaggcaggattgagcccctagcagcaggacaccagccctgtgccatgacatctcgactaccgggccgcagctcgtgtagccttcatttgccctggagaatgtccatcgacccccgacttcatccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttaggggattttaaatagagggggcggtgtgaatccaattccacaatactccaacaattccacagtgtccaggtgatatgaatattcccaaagtctagagttgtaaaaccgcctaatgttacctaattaaaagcgaagcatctacctaaaatcatactagtggtaccatgagtagagtgtccactagttggggttttgtttattctagggtgaacaaggaaatagtaacaataacaataataatatggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatatcacaagcagaaacaaagcacaaaaatgggttcttgactttttaaggaaaaattagagacttgaatggtccaatttcgagttcaaatggccaagttatggccatttgaagtttatatgctctttaaatggatatttacgaatttcttgatttaaattttaatttaaaatcggatttattgcgtcagccgaggggaggggcgcgcggaccgggtccacgggagtggggcccacgcggcagcctcacggtccacggtggaccgggcgcacgcggcttgcgctggccggcgccgtgggtcccacgcgtcagccgcaccgagggcgcgggcggctgacggccgggccccacatggcagccgcggggcgcgcccaaaggcggcctcgccggcacggccgacgggaggcggcgcgcccgcgcccctatggtcgccggcggcggccataggcacggcggagcggcggccgagagaggggagggaagggggaaacgaaatggcggtcctcggctcacaccgggtcgacggcgacgacgggaacggcgaccgaagcggagagaggcggcggcgcggctcgggtcgacgaggacggcggtgctccggcggtcggcgggcgaaacggaggagtggacgaggtcgacggggacgcggcgaagccgaaggaggcgatgccgaagcgggaggaggtccggggcgacgacggcggcgaaccgaagctcggcggcgacggcggagagagaggacgacggcgcgagctcgattccgacggggagagagagcgacgagtggcggaaacggaggagggaggcacggggagcgtttaaatagagccggggcgagggagggtggccggggaagggaggaaaccgcggcgcgggaggtcggccgccatcaatggcgccggcgagattaggggagcggtttccaaccgaatccgagggagagagggagggaaaaatggggggaaagagagagggaatcacggggagtgatttccccctctttattgcgcgcggggacggcgggaggcggcgggattcgcggcggcggcggcgctagggcacgggcgaggcggcgggagcggcgggaggatagggatgacaggtgggccccacccgtcagcgagggtggcgggcgggcccgcccgtcagcggcgcgcgcgcggggagaggctgagtgggccgcggggaggaggagagagagggagggagatgggccgagccggcccaagagggggaagggggggggaaaaggacttttagggtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttaatgtttgccaaattcttttcgaattgtaattaattctattattccttttagagaatgatttttaattcgggatgaatttatcaggacgtgacatccagttcgtgggatggcacgaagcggcaaggggtgtgacgtgtgcatttaggaggccactatggccatgttttcgttctttcttgtaatctgctatttaagcttgagtcttaatccagaaaagctgccaattaacgcagcgccaaaatactccgtgtttgctccgcttccgctttgccggattagctacagttttcgttttgccgctaacaatccccaagtggctttgctcttcgccagccttgccacagaaaccctgattgcttctatccttccatgatacatcttcctaccatccattatgcttatgacaaggactgtgcaaggaaaggaggtggagaggagagcggagagcactcgtgtctgttgcaaccagtgtccacatccaccgggatggacgcgccgcgatggtgcaccagctgcgggtacaagtcaccgtacctgacgaggtagctcatctttatcacgttgatgcccagcacataatcagcctagcaaaaacaaaactctgattagtgatcacatctaatatttacacataagacaaggcattagagttgagcgcatgacagaagcctgaagcctctaccccgtgtcacgcccgaaaattcactagtaatttccgaacttatttgtgcataaaatcctcgtccaggaatcagccgaggtacacaaactgacaatttaatatacagattcatccaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaattgcacaaggataccaaaggatggcataatatagtctcatttgcgaaagcagcatttagcaaagagttaagagtagtaaaacaatagagtaattaatcagaaattttaatcaacactgaacagcacacccatgctgcacaggcccaaccatcctgaacaaccatacccggctgtacagatctaactccaaaccaggagctaagcaaattattaccaggtataacatccataaatattgtgagaggtgtgagactaatcacgaaaaacattgctcaacccgcccataaccgcgggcacggctatttgaatagttttactctggccagaggtgtaccactgtacccacaagacacagccccacaacatgtcaccatgtgcctcaataccaccacggtacctcggaaaggagctgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttatggttggcacggttaatgtttcacaatagtagctcgcgaaccggtccttaattgtcatgagcacgactctcaaaaccatgtgctcacaacccaccattatcaagttttagttggcaagtaattaatttaccaatcacgattgaccatcgtgaactatcattaagccatcattaaataatagtgagtcataagttatcccagtaatgtgctaatgtttctaaacatggctaagcaatcatatctaatatctagctgaaccaatatatatagctcaactagtcaagttataataacccaaggtatcaagggataaagtaatcaatgcaaacaggccataacaaaggaatagattcacaccacctagtgacattcgaaaataaatgcacagttgaaataaatagagaatttaaacataggatcaacatgctcaaaggattgtgtttaggatctgtgtgacttgccttgcaataatcggtcttcaattaatcttcttgaatacttccggcgcactcgcgaacctttgcaacgacggaaacgacaagctaacatgcaaaacgaagaaaaagactaataaaaaccaaataaacaatacataaaaagtaaacaaacatgtagatcataattttagatgaattatgagacttgaacggcctcattctgacttcaaatgaatttattatgaattttactagattaaatctaattaaagcccatttaaaaagaattaaataaatttaattcaatttatggataattttaatatgtagatctttattttatacaacttttgcaacttgaaccacataaaactgagttacaatgaattagttatgaatttttaaagattaaatcggattaaaacacttatatggattttaattgaattatgacgcaataatgaattatttttgaaaatgaaaagggaattattgcgtcagtggctagggtttgcggtggaccgggtgcacggcggcggctcacgggaacgaacggccgagatcgaacctatcccaaacgaacggccgagatcaaccgatccacgaccgggccacgacggacggtcccgatgacgtcagcggtgacgtcaccactggcggcggctcgggcttgcaaactcgccggcgaacgacggcgcggcgacgcgaacggagggcacctgcacgtagagggcgacgcggcgaactcaccggtgaccaaagaagcggcggaggagcaacggacggcgacggcgtcgaggaaaaggcggcggcactcttcggcttgacgacggcgacggtgctccagcggtcttcagcgacggcgaaggggcggacgaggacggcgacgcgatggcgaccacgatggcaaccttcccgagcgacggcgacgactggagcgacggcgaagcacggctggagcgacggcgacgactgcggtacaaggtctcacggtgctagggcgcttccgacgacaagagacgaaggcgagggtggcggcgggtagcggcgacaccgggggtccttttaaaggggctagcgagcggcgacggaggcccacggcaaccggcgacgagaaggaaaggttagggttcggaggaaagagaccgatccgattcgacctcgaatccacgaacttccaaagcgaaaaagacgatgattccaaaagaccgaggacggttttccgtgaagaaggggaggatgatgtgaccatggctaccacagatgcaaccattgctcacatcatggatgaacaagaagatatcaagatcaaatcctccaagtgctggaatccgattcggccacctactacactgctgacttcaaacggctgccgaatctgctacgacctccgttttcggcccgtgagtacttgatggaaagctcttggagtcctctttccaatggatccagcctcattgcgaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgaccctaggcacccctaggtcgtcctcccacccctatttatatagttaggtaccccttcagggtttcttgggttttgatagattaaagtttagccattgctacttgcttgcagcgcgcgtgtcggctagaccgtccgtctgcttgttctttggaaccccaacttatcattcgtatttaactcctatttgcaattcagattgcttttatcttgttcttgcttgtttcttcgatttgcttgcaggaataaggttgatttgcaccggcaagatcaacaacccacggagatgtgtatcgatcgctaaggcgcaacacaacgtctcgtacggttgtagtcggatcgtcaacgtttctcccaaatcgtagttatcacaactcaccgaaagatcgggccaacaacagccttgagtgtcgaaaggaactcagggttcatcaaaactgaccatcattttctgtcacaacccgaccatatgcaaataccattaatataattatcattaaggtacaccactttcttttatactccctctgtcccctaatataagggattttaatattttgcttgcactgtttcatcactcgtcttattaaaaaaatcgtgcaaatataaaaaacgataagttgtgcttaaagtactttggataataaagtaagtcacaaataaaataaataataatttcaaatttttttcaataagacgaatagtcaaagagtgcaagcaaaatgtcaaaatcccttatattaggggacggaggaattacataattaaccaatcaactctagacgggggcagatccagaacaagatttaagggcggaatcatctccttcttccttcttcagtccccctactcttcattttctctgatgaagacataactagctcggatataaccatgactaccttatatattaatcaaccaaaggtgcatatgttctatattagatttacttgttatatatttgaaaaaacgttgctacacaatgagttttatgtgatttcatttgcagaggtacttgcttgggcgaaagaaaagaggccgagcgtaaggaatgcacgcatgattaaataagttgattagggaccaaaccaagaccttctctaagtctacttctaccttaccacgtcacttttggtccatagaagataaatggtcaagtttcacacgttttggattcggattcgggcctcctgatagcatcaacttcaaacagacctagccgctgatctagaaggaatttcggggcccataaatacttgttggaaaggttatggagtctaatttcagatggtttttgtcccacatcaaaattcctaccgagctgccgggaatctgcaaaacaagccacgtatcttatccagtccgaatctggtttgggttttgagccttgtaattgtatcgtgggcttagcccaaaagggtgtgcgcccaagggcaacctaggatgtccctaatcatatttattcagtagccgtcatcgtttagagtcgggttttgcttagattaatctgtcaagaacagtttcgccgctagatcggtttgtagatccccaaatttgagtgcttaatcattcatatgcaattgtatcgcaatctatcttgttcttgcttgtgttcttcgattcatatgcagggattagccttctcgacgaggtcaaccaggtttcggcatggttgataaccaaaggagacgtggtgctgcgattgcggggctcagtagcgtgttcgttcagaacggatcgagttgtgtcgcgactccgtccaaatcgactgtttatcaaaacctatcggaagatcgggacctaacattccttattattctccctatacattcttcccattcatctccccttctatcaatgaggatctagcggagtaggggggactcgagtccccccagcacccacactggatcgttacaatacaatactgggcgcatatgatacttacaagtaaggagattacattgaccatgctaattaaagaaataaataccttcggttaatcccaggacaatcattgtattcccatcccatgaatcaggtgacggtgctcgggatcggtggcttcgtgatgatgatggggattgggtgaaggagtgagggcgatgtagatcttcatggcgtcgaccctcgggattggaggcaatggggaccgggaagacatagagttgggcggcgcgacgggcggagggtaccacaaggaggcatgatggttggctcgagcagcgcgacggcgacgtggcggtggtgaatcggcaacggcgttcgggatcggcagggccacgaggatgccttcccgagcagtgcttgacggagtccttcacgacggaggaacaacggcgactcttgagacggctgggtggcggcccttgtggctgtagtgattagggtttgcccgggggagtgggcggcgcttgtggtggcaggggatggaggaagaggtggcagcggcgattagggtttgcttggggagtgcgtacgacggcgccctaaaggttgggcgaaggagggggcaagcaggcgatggaagggatagcggcaccgcgggctggagccttgggggtggggccaaggaggggtccaattaaaatatttgctacttttactgtaagataccgaaattttaggattaaggaatttccatcaaaactagttaaaaggaaagttcttcaattttgtgaaccataaaatttcatttttaacctaggtgtagtcaacctaacttgaactaaaataaaatttgggaaaaaattaaaacctttacatttctaacctaggacaaaaatgcaaacccgattgaaagaatgcatactcactagggacattgtataacttgagtcatttttgtgcattttattttttgttggcattgcataataggtctcatgaacatgaataaaagctaacttctctaagcaaaacctaaatgaaaataaatacacttggttgtatgtgcattttagtatcttaggtttgtttttggatatttttggtgcatctcatgataggtttcatattcatgtcatgcctaaagaaaattcctaaaaagcaattaagcaacaataaaattcaccgaaattctcataaatactacacaacatcctaagttcatagtaattttagcttgaatttatcacatcaaatgttggctcaaataattccttcaactcagctagaaatctggaaaacagcatatcacttagactactttgcgccttcaccaaaatttaatcataactcatctagctaaaccacttggtcagaatgttaaacctgttgtactctaccatcagttgcaatggcttaattgaattcgaagagaaaccacatggaatatgtactacaagatgtataaacagtattcctgactgcagtcaatagtgtaactagtcaactttactaaattaccatggtaaatcaaaaagtaataaaactttagaacttggaacattgaactatcaaatccttgtacaccttgtagcaaccttatctctccaaaattctaaaattaaatggattagagaaagagagtaatatagtatagtgtaatagtgccaacactatcttacttatgggaccaagtccttgtggagcccactcatcaaacaaccacagccacacatcatctacacctctcttatttaatttttttttcatttttctaaaggtgagagagatggagataaaatacaaatcacacctaagctactactctacctctctcattcacctagaatgtatctacatggacccacttgacattcactcatcagccatacacccttggcgaatcacctctttgatcctaaattctacttaaaaaaaaaaagaaagagagagagagagagttatgtccaaattacacccaaaacttcaccatacctcttcaatcttctggaaacatctacatgaggccactaggcagcctctcttgctaaacatggatggagtacaagttaggacatagcctcattagtttctaactcataaaaatcgtgtccatgccatatcatgccacctatctctcccttgccagcacaacaatcactatttggtcaaccatttcaccagcaaactcaactcttcttcctcatcatgtttcactaagaattagaccaagaactttattgtagagccaagaacatcctcctcaatcctttcaaccgaagatgtttaatccattgcttgatttctctggtgagcttcgctgcatttcaaccatggcaacgtaatctacacaccatacctaatattttcatattcaatattcttcattttccatggatcgaacacctgcgtcgagctcgtcgtcgctcccggtgtccagtgcgcagccgcgggttcgcgtcgccgttcccgtcgacccaggccatctcagactaagccactgcgccatgattgtcaccaagaccctaggagcaagaccaccgaaggaaacgagctgaggcaccgtcgttaaagagatcgagcctttcttcttcaactccggccgccggcgtcaatcttcaattcccgctgctctggtgagcctcgtgtcgattcctcacatatacaccatccttgagacctctctaaccacctgtacaccttctcttagctctccatctaccggaccgtgctgtcaccgtgaagccgacatcatcctccgccttcaagccgttccgcgagctgctgctgccgtccaagcctcgccaacaccgtgcttctgaccggtgagcaccctaaacctcccaaagatcgaatgcatgcattcctttagcccaaaatcaagttccaccgcaacatgcaaagccatctgaaaaccttctccactattctgcaacatacgggcgctatggttgaccatttacagcatattcaccttctctaggattgcattgacgtgggacacactttttatttttattccgacaccatccgagcctccgtttgccgccggcgagcttgagatcgagctcggccatagcttgtcctgcttcagctcgaaccagggacctccttacaagaatttaatttaatgtagggtcctttctgcaaaagcacaggacacacagcactgttgcaggacctactcatatttattgaaaacaggaaggactcttaatgaaaacagctattcaacatgtgctgaattgttcaaatctactttaaacttcaaaattgcatactcctaactaattcatctaaactctttttaggtgaaaccaatttctatagattcacaaaatttagcactataatgttataaaataagaagtgacacataaagtacaaaaatctatctctaaaattcatctaagaaaaatcagacataaaatatgcacaggattataaaatgcatagaaaactcattacaactcattttagagcaaacttagcttcaacagatccaccaacatgttctctaaaatcaaagtaaaataaaacatatacacaatttacatcaaatgcctctaaaactattacttccaagttaagctgaaatttagaaattgatataaaattcatcttaggtcctttttgagtaaacacaagttctgtagaatcaccaaaacatataattccaagttataaaataaaattatatacttactatatgataaaagcctataaaaaattatgtaagtaataaccaacatagagcagcctttaaattctaaaatttgtagaaattcatttttatttcaaatggaatgaaccaagtttctatagaaccagcaaacagtgagcttcatcatagtaaaataaaatatgacaccttctgtacagattatagctctaatctttaaatagataacctaggagttaatcacctagtaatgattaagcaaaatatatgtgtaaaggtatttaaaatgcactctagctatgaataaaccaaaataaaacttgttagaccagagaggtcatagttccagccttaattcccaaagacttagcaaacttaactcatataacaatttctaggttggtatgttaagtaactaacatagaccatccctatttataaaatgtgtagtaaaataatataaactctaaaattatgaactaagattagattagttaactaaaatactcattttatacatcactggctagatgaggcaagttctggacctaaacctctaaagccatgaacctatataacactatacacctataacatgttataacttgtaaaatacataaagaattcatattaactctaaaaattatgaaaccaaatatgttagtcctagaaaacacatatcttcaccccagcaaatataaacttaataagaatcaccttacaatagcatttcataatagtacctaagtaaatcctatattataccacgcaaatttctaaaattcataactcccaaataaaaagagataaaatagaaattctttcacctaaattcatcttagaccaatacctatccactgtgcacaaatcatgcattttaaagcattttggatttttcgcatatttcggtgtttaattgcataacatgtactttgtatagatgattgcttagacggtgaagaagtgatttaggtgctgacattttccagttgcaaggcaagtcccacctccctctctttaatcactttgaacctatgttttggaggttattgaaaatgtttgcaaatcttgcatgtcaattgtacagtaataaattaaaattttgttaaacttgttagacaaactcctattatttgcattatcaccttaaccccacatatatccatatccatcattcctaaacttaggaacaatatgactatactgtcgacgtttgatgtcgcgattccggtatttgatgtcgtgattccggtatttgcatagtatagggatcgttggtactaggatatatgcgaaattgtaataaaagaaatggggatgaggatttttatacagattcaggcccctgaattgttaggtaataaccctactcttgtcggtcgaagccagtcgttgctcttattcaccatgatcacaccagtacaatatttggggtagcctatctaactgttgccgacttgacagccataaaaccatcccgtagtcgataacagagtagtcttcctcctcgaatccgtgcccggcgagatcaaagacagcgctatgtctctcctgacagcatctgtagacaccgtaggggactagccatgcttatctctaaagtcgatatccggcggcatgtcttggcgtatgttggcttgtatgttgatctattgctccgtgtcctctctcctcctagggggccttgtatttatacccataggtgtctccttgtccaagtagaactagggaaactaatatggatacaatccgagtagtccttgtcgtttccatgtagaactctattcatccttccttacgcggaactcttcctatatccgaaggttgtttccatataagacatggtatgtggtgggtcctaccgagatttagtcaactactattaggtatgtggtatccataaccctgacatataccactttatatatacgagttttgatgtcactaggttacaataatgcttagccatgcttagaatggtgttccttgtcattatgggctcattacaaacatgaaaattgtttctgaaataatctagacagaacttgaatacttatgattttgataaataaaatggagcaaaatatggattttaggtttgggcctcaagtggtgcacatatggtgatttgttgtgtaccgataggggtagagtgcgtccaaaccgacctaaggacttcactcaatgtcagttcatttcgtatacagtgcaaccacatccacatgtgctagtacgggatagcccaagcttagaaaattatttatgatttagccttacattctggtaggccggtgtatatgagttcgtataattcagaagagcttcctatttaccccgacgtgatacaacagtattgtgcctcgtggtgggttgccgttgtgtccgccaccacggcgttaagtttaaggcgtgggcccgccacttaacggttctaggtcatataacgtgtatggcttaagatggagtaacacgtatcgtgctggtgtaaggctaaatcatgaattttggaacagctttgttgcgggtaataaatcgggtacttatgtatcgcgtatcgtgctggtgtaaggctaaatcatgaattttggaacagctttgttgcgggtaataaatcgggtacttatgtatcacgtgccatgctcttgcatgattattatttcgcatcttgtggggaaagtgtacaaactctgcagacttatgtttattcttctaaatgctgaaatttaacttcaaaatgtgatgagatttgagaatgatctccttgctgccatggatagcaatgagctgcatacttatacatgattaatgtgcccatatgctaagtactagcttgctgaaatttatttgaaagcaaaatctgatttgaatgtgttttatgcaaataaaacttgctttatgataaaaagagacatattatgccttccttgattatatgtcttgcaaatagggtgttaggcttgtgttggtgcttgccagtacattatttttaataatgtactgactcttgctattaaattaatcttttgcttgcatgttttagatttagttttttagtgatgctggtagtacattatttctaataatgtactgactcttgctgttgaattaaccttttgcttgcatattttagatttagtctttgagtgatgcgggtaatcgactgcttcttctaggacttgaacttaatggggtaaatccctagtcggtgtgcttgaggattgggtagtcaagcttccgctattctatatatttatttggctggtcggcctatgtaactatgaagtagttgtaatttagaatcactttcgtcttaagtgtatttttctatgtatttccatgcttgagatgaaagtgtgaatctagtgtacatcctgggaactagattcacatgagtatgagttaagaatatttgagatgttgtagatctttagccatttttgtcaagtctcctgaatgtgtaacacaactggtcgccgccttcgagtggtttgacgggcacatctcaggctaaagttgactggcaggctataggcccagcaatatctccaatattcctctctcgaggcgtcagatatttcattatgcttgttgttgacttgaattatttatttcatctctcaattataatggaaggtccggagagcctacgacatttacgtttggtaattatccgaatgcccctcttaggttcggagttaattttttgctcttctaaagaggtaggcatggactccccagcgacccccacgaacttctcgctgcttctcagtctggcaccccgcaatgaatcatgctatacaaaaggtaaagccattgtccacgctggcttgtggttggtacggttaatgtttcacaacagtagctcacgaactggtcctttaattgccatgagcacgaccatcaaaatcacatgctcacaacccaccattaatcaggttttatttatcaattaattatcataacacgattaaccatcgtgagctaccattaaccataagtaataatgtaatatgattcatcccataaataagctaatgtttctaagcatggctaagcaattatatatatagcatttaggtgaaccaaaccaatatataaggttcaagctaatcaatttattactcataggaaaataaagtcattgttggccataattaaatgggaaaggctcaccacccgataacattcgaaaataatgcataagttaaaataaaacattagctttaaacgggttcaacatgctcaaagagttgtttgggatctgtgtgacttgccttgagcttcctcaaacgcttctgaaccttcctcaacgtaaacgctctcctccggaacgttagaaactaaagcaaataaacacaatcaataaaacagtacaaaaacaagcataaacagtacatgtggatatttttaacatgtagatctcgattttagatgaatttagaaacttgaaccacttaaatccgagttacgatattttagttatgaatttccgaagttttaatcatatttcatctaatacagaaaaactaataaaaggatttatgacgtcatcgatgacatcatcgccggccatggctctgaaccatgagatcgccggccatggctctgaaccatgatgtcgccggagctagaggacatggccgggtcttccgaggacacccatgcgaagaggacgacgacgcgaactcaccggtgcgaaaaacaacgacggacgacgacgaacgaaggccggcgacgaactccaacggcggcttggctcgggtcaacctcggcgacggcgctccgacggtcttcggcggctgaaaaggggcggccgaggtgctcctccaccgcgcgaacccgacggcgacgacggtaagcggcgacggcgaccacaaccccagcgcgacgcggttggaacgacgacaacgaaggcggcggctagggctacgcggtggcggcgctacgggcaacggtagagctcggaacttgaggcaaacggaagaggacgacttagggatgctttatataggcacgggtgagagagatcgaactcaaaacgagaggattttaaccggaaaatccgagggttagtttggagaggtaaactcaaaaacgagtttgactcggataaaatacaaggaattaggttccgattcttaaggaaaacgagagaggaagataaaggaaatatttcccctcaactaattttcggaatacacgagagataaggccggatttggatgggaaaaacctagcccactcggtctcagttcggctgtccagaggttgaagatgaacagtgcaaaggacgaaaattagacttttcggctgggcttctacttcttggcccgattgaaagagggacacaaagcagacttcgacagagggagggagagggctgcaggctgagaggagattgggccaagaaagagagaggacttttcctgtttcggcccgaaaaggaaaagaggaattttaattacttttccaattaaattaatcactgaaatgatctttgaattgttaaaaatacttccaatgctcaaataatttcaagaaaaatcctgaaaatacttggacactcaaagtacttaacaagattataattagaccatttaatgattaatttaatatgtggataattactgaaatgttgtttgtattattaaaattagaaattgagctccggaaaatctgagaaaattccagagagtataattaaccatggagaatttaataaaaataaatccagccatgctttatatttagaaaattttatttcccacatttagcttcacttgtaaattaatgaacatttaatataaattctaataataatttattaaataatttataaatcctaaaacgaaaattaggatgtgacagtggactcttaattattagccacttttgcttatgtagcatgccaaagtggcaacccagggtgagaaattgcgtagggaccacacgtcagtctctccctccccttcatttcgacagtcccgtcgacgccggcgacgccccctgctacaccgcacgcaaccgtcgacgccggcactgctacgctgctccatcgcgcgcatctcttgcaccacgtcgatgtcggcgctcgtgctcctcgtcgccacccacagtgccgtcgcggtgtacaacctagtgcaacgagctcggtgcgcagcggcagtgttcatgccagcggcgttgcggaggggcagcggcgttgcggaggggcagcggcgcggcagtgctcctccagctcatctttctcgtcgtcctcgactcccactctcctactcacatgcggcggcgttgaggaggggcggcggcgtggcggtgctcctccggctcttcttcctcgccaacctccactcccgccggcggtggcggcgccgagctagctgtggcatgctgtacaccccggcggcgctgtgggtggcgatgaggagcacgagagccgatgtcgatggggtgcaggagatgcgtcgacagggctggagagatgaagaggagggagagactgacgagtggtccccatgccatttttcccctcgggttgccactttggcatatgacacttaggcaaaagtggcaaatagttaggcaaaaatggcaaatagttaagagaccacctctataaaagggcaaaaaaattaactccaaacctaagaagggtatttggataattgccgaatctaaaagtggcaaatagttaaattccccggcaaaggagagtgcgttgggaaggaggagcgatatgagccgttgggttcgatgattttgggtcgttggattggtgaattaagatgatccaatatatatacaattcaaatcaggcttttcaaacaccattttagggtgttggacacggaataagacgaatattcaaaagttggacacggaaacccacaactacacttaaaatgagacggagggagtatatagttttttttccatctgatttagcaagtcaaactcatagctaactccagcaacctctcaatctaccctctttattctgagtatacgacactaagatccgtatgtcaatctctaccatcctcctaactacgctacctttgatcctctatcctccttcctcccgtagcaacaacagtgacaagaaggggagaagtcggcaatggtggcatgcggtaagagggatggatagccgatggcagcggctggtggcaagaggacaagaagatggcggcaacaacaacactagttgtgatggcggtggattcacgtgatgggggaggtggatctgcatcagccaacggtggaaggagcaatgacctcagccacggcagaggtacgctcgcacgacggggaggcggaggcacgatggccgttgatgtcggagctacagagggcgccactaagctatcttgcaggtggcaccctccctccctcgccatgtctcaccctcgcttgccctttttgtcgccggtgttctcgatcctccctcactgcaccgccatctcaccctctcgccctcaccccatcccctccaaccgcgggcagaggccaacgtagtggaggcctagcgcaatggagccccgtcggtgaccgcctatcacctcgtctagagagggaggggggggggatagagttgtgggacccacgattgggaagtgatgttgggtggctaaatttggctaggagtgaagagatttgggcagccagatgccttggccatcctattagagagactattagagcactttttttttaatagagtagccaaattttagtttggagaggatgtcgcagttgctctttaggatgcatgaaataagggatgggtaaaggcatgggagcgcctctgtttctttcggcagacgaggacgaagtgtactatgaatataccttgatggcagcatggttacatcatggtaaccagggaaaattgccaatatctaaatatgtacgtatgtattggaaatctagacattcaatgtagacaaatctcgctatcaagactaaaaatttctcccggattcaaccatgagtaaaaattttactcacatgaaaaattttacttcggtgacgtggattaatcacaagcctccatttttttatacaacagtagttttcagatttttcactgcatatctagtttacagtacatattttctctcgtaaccacgataaattcacatcctaaattttgtccaaatttttaaactccgcacggtaaacgatggtattaacggtgtgctgaagataaaaagaaaaaaatacaaagaacagcaataattctaaaaaatccaaaaaaaaattgaaagtctcaggactacatactacttttttttgcagaacatttcttatgtcttactactccatccaaaaaagagagaaaccctagctacgaacctgagagaaaccctagctacgaacctggatatatgtgtgtccaggttcgtagctaggattggtttttttaagaacagatagggtatacaattaaacaaagtagcaatcaaattccaacctctctctcgttttgtaacatcttttcaatttctatggagctacagaatataaagtaaactctaccattttcacaaactttgttcatacttgtagatatatttttatttttttccaaaattgaattcaaacaaaattcattgaaccctaccgacggtttcacctaccatgtccccacaataaactcaattaccacgcagtaaccgccggtaggcgacacccttatcacaaccagaaacgggtgcatatacaaatggtacaagggtatagggcatttccgaataaggataatgtacatgatctcttagcttattctcaatatacctatcatttaaggtacaaataagcccgattacgattcccattacactgataaccgatcaagcgtgatcaaaaagtgctgaaatgtctacaaggaagactgcaaactatcataatgtaactaaacgatgttcatcaacgtacatgggacttgcataattcacttattagtacctactgaccaacacaaaatcatcgtcgtcaagaacccgtgcctcgttctcacccacaaagttttcccgtccaatagattcaacgattcggacaaactctaccctcttttcaagaggaagaggtacatatggtaatctgaaaacaggccttaccactccaagctgagccagggcagtgttgagagcaattggatttggctggcaaaacaaccatttcatcaggggaaagagcttctcatttagcgtcttattctccccttcatacatgagatcgtgcatgagaccaggaataaggttgctagccacagaaataactccagtggcaccatatttccacctagaatcatggcattcatcatcattaccactccatatggttatacctttgtcagtgtagcacttaaccctctcatgtccaacacattctttcacacctgccaagtttgtgaaacttgaaacagcctcaataactgcaggaggaatatcctggccagtcctagatggaacattgtaaataatggttggacccattgggaggacagcctcaaaatgagatatcaacccttcgatagaggtcttcccatagtaaggattgatatggagagccgcatgcatacctacagcaaatccctgctctgttgcatgaatagcctctcttgttgagttactacctgtgttgcctaccactttaactttagcaccaaagcagttaacagtatgtccaataagcatgatgtgttcatcccagctcataaggtggccctctcctgttgttcctccaactattacaccttcagcaccaccatctatctgcatatttatcagtgaatcatatgcttcaagatcaaatcttccatcaggcagatatggggttttgaccgctgtaattactctgagactagtgatatcagctgttgatgtcctgcggatcagaaaaaggaagatcatatctcagcagcagataggtatcaagcactgaaatacccatgtgcaaaaaagggatcacatgattattaagttacaaatttaccaagcacaaaattgggttaccatttaccaaaagattatacaggattatttcatttcacaaaattggaaatagcaagaacatcttatttctctttaacgcgtgaatgattattcctgataagacctgaacttgatacacatgaagcatgtcctcagtaagtcagtatccaacttataccgttacacatcacccgagtgaacagcacacaagcaaacgtatggctctaagtagcaatttcggattttggtacaaggtatgaagagatttggtgctggcatggtacacattgaattcagcaggggaataaatgatttcggaacatgataaagtaaaattggttacaaaaattcaattagaacgggatgtggacatgtgaagttctgactgaaaagtggcaattgaaagtagtttacgggacatcttaatgttcagctaagcttatggaaacataaataaaacaaggaaccaattctttccttccaaactgagaagattaccgatttttcacttcagtacttcgcattggaagataatcatcaagggtgatggcctgcaatgcaaactttcctctgctaatcctgtatgaaagtacttcttgtgttagtgtgttgcatatgaaagtagaaaatgaatatgggggagttgatgagctaaatatccttcatcactccttaaaatgacagaaaagaagttgcacaaatcgtcagaagtacaaaatcctaaataattgagatggtagcatatatatttggttgg

SEQ ID NO: 79345 - DNA, 16857 bp, Oryza sativa
  unsure (1)..(16857): unsure at all n locations
ccgttgcttcccgcgcgcgcgtgccgagtgaccgaccgcctggtcgccgccgccgtcaccctctgccgcgccagcccgcgcctgtcgcccgtgtcgacgcgccgctccaaaccatcccaccgtcatcgccgtcgtcatcccccggcccccgccactccgcgcgcaagccgccaagaggcggaggccgagctctcccttccctctgccgcgtcgccccgctccctcctccttttcccgattcggcaaaggggcaagcccctttctctccttccttttcccctttccttcctttttcccctctcgccggtgtcacctcctgtcgccgctttggacgctagccggagcgccagctcgctggcttgaccgcccatgtcggttcccctctctcaaaccgacattgccgcccatttaaacccgtcttccccctcccttcctttcctctcccattcgcctcctcaccgttgccgccgctcccgtgctctgcctcgcctccgccgtccatcgccaagcgccgggagagccggtgcgttcgtggacgtggaaggggactccgggcgcgccctcttcttcctcttcctcagcccgaggccagagagattactcccgcgccgctggccttgcgtcacagcgcccctcctcttctcggtgatgtctctctccgttcttcctcctcgctccatctcctccccctagccttcggtagtagcttgagtagcctccccgtagttagccggcgccggcctgaccggtgccgtcgctcgccgtgtgttcgccaccgtcgccgcccgagctccgtagcacccgctcgtcgccggcctcgctcggcgtagttccgcccaatccgacgctagcgtcgagttcccgaagccgagtagatgctctcaccgncgggaatcgacctctcgtgacctcgtcgccgtttccttcttctnccgccgncggttgccaccgncgcaatccgncgncgtcgagcaacctncgcgaatccgagccgtggcntcgttncccctgtcacgtgcaaccgggggtgtgcacgcttttgcctgtatcgccgtggttcgctccgccgctgggggcgttgtcccgcgttcattcgaggccgggtcgtcgtctacctcccgccggcccgcgtggcagccacgtaggcgccacgtcggcgccagctcagccagaccgggtcgggccgaccccggtcggtccctccgcgtgcgcgtgatccaccgcgagccgtgaggctgcacgtgggcccgccgcacctgcgtccaccgcggaccacgcgcatgcaccgcgtcccgaccccgcccgcgcgcgtgcgtcgcatgctccctccgcacggtgagccgagccgctgacaagcgggtcccacccgggaccgcgcgtggtgagcccggtccaccggctctctctctcctccctcccgcacgcgcgcgagtttgggccgtcttgggccggccggcccacttagctcggccggaccgctccatttctcttgggctgcgccctaaccgtccgagaaaagtctatattccctccctcccttcttttctttttccttttcaaaaaggatttaaataaatctttttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattctcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatgttatgcattgataggatcacacttaatctgttgtcccgcctgcaaggcagattggcagacctacctgattcgttgcatttgatccttcctttgttaattgttataccatgtccccttgtaaccacccagttgcacctcgatattcgtgcactctgtgcgagtatcgacggtcgccttcaaatttaaaatctgagtaacaacttgggtaaaactggagttttacaaaagacttggaaaaaaaccgacatctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgacccgggttggtaatgtcgtgtgggtaaagtgtaccccctctgcagaggtcattgaactgttcgaacagccgtgcccacggtcaagggcggatgtgaggtgattcctagcgtagttttgtttgactactgtttgtgaaattgctgttgtgaaactgggttcgatgtttgaaaaatcagcagctgacgggatcagctaggccgggtggccgtttgaaaagttgttggcccgggtggccgtttgaaaagctgttggccgggtgccaaccctgtttcaagatctaaagactgatacattgcacatactccgaccggacgagacgcactgtcccatccgtgtcgtttgagaagcactcacttagactttttagaaaagagttcaaacaaaatcaattacggaaacaacagcctttccctgaagcctgcattaaacacttattttcccctggcttgctgagtactcccgtactcacccttgctctatataaataattccccccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacagtaaacctgtgtcggctctcgaaatgccttgtcatgaaagcctcaaggtcaccagacgtggctgttctgcacgggctgggtgatccgggttagtaatgtcgtgtgggtaaagtgtaccccctctgcagaggttatcaaactgttcgaacagccgtgcccacggtcatgggcggatgtgaggtgattccttagcgtagttttgtttgactactgctttgtgaaattgctgttgtggaattgggttcgatgtttggaacatctgtggctgacgggatcagctaggcccgggtggccgtttgaaagttgtggtcgggtgccaatcttgaatcaatcaaagactgatacaatgcacatactccgaccggacgagatgcactgtctcatccgtgtcgtttgagaagcactcacttagttgttttaaaaaggagtttaactaaaaatcaattgtaaaaacaatagccttccctttgaagccttcattaaacacgtaattcccatgacttgctgagtactcctgtactcacccttgctctatataaataatcccccctcagttgctgaagaagatgagatggatcccgctgacgaggagttcttccaggagcaagtcggttatgaagagttttagggtttcgatctagtttccatgtcgcgcctgtgatgaatggtccaagtcttggcttccgctttcctcttttgtaatgcagttgtgagctcggggtctgtccgcagcccaacatgactgtaatcctactctataataaagagacctctgttgctgtgatattctgtcttcctatgataccagcactgtttcctgggactggtatcggttaacaggttaatttggagcgtcacgggttggatccgttcggagctagttcagggcgtgataggcggtgacccagtaggtggtggcggcggcggccctaggggttgcgttgacccgggacagcatcagctcctgtcggcgccgacaaccctatgggcagcggcacctcgggacggtggcggtctgagcacctacgcaaggctctcagcgagtaggcagaggtcaacaccggtggcggcaacggctcagacgaagacaacctgagcacaagcacacaaggccctcagtgaggtgcaggaggaggtcgaccccattggtggtggcagccctagggatgacagcgggctgggtccgaaaggcagaagagcatcccccgacgacgacagcatcactatgggcgtggagacctaggatccagcaaagtggaaagcgatcccgtcggctagtgtccggtcggctagttctgactaaacgatgagcgacgatggatgaaagtaggctaattaactggcggcgcactaggggcggcagcgactagacgaattccactagtcaaatctagctgtttcaagagagtatgtcaggaaatagagaagcacgggtgtgccgaggtcgttttgcttttcttttcttttttggttgtgtgttctcctccttgttgaggtgtgcgtctaagtgctcttgtaattttttagctgtgtatatccttcgtggatatagaggccggattaatgaaaatctattatcaaaaaaatgtgttatcatttggtaataaccattaaataggtgtgcctgaatgctctactaagaaaaaactgcacatatcttaatgaagatgagaagcctgcattaaatgatgattaacaacctaaacactagtactccctccattccataatataaggcataaccacttttttttagatgttccataatataaggcatgcatgcatataggccattaactatgacctcttctccattaaactatttctttttaaatcctccactcttatgttctctaattctattggatgcatacattgtatttattaggatgatcctaactataagatgataataattattttcttggtcttcgggttatgggtggttatgtcttatattttggaatggagggagtactccgaaagggcaatttcgtccttgacttaacgaagttttttttttatgaggacttaagagagttaattatcctgtccatttacagagcccgctggtgcgcagttcttcctactcacagtcaatgagacttagtaactgttttatttggttaaaggatatgagattttaggaattaaggagggaggaactccctgttttttaatgcctggattgaggtgggagttgggaggaagttccccccttatattatattatttagacagatatcaaccatcaattttcactcaaggtcaagactatcagacagtgtacgatggcccaaaccttacagaatcaaaagcggatatcagatatagaggagctctcgctgtccaagtcattagggaatatctcttgatttgggacttagtggatgcatgggttgatattacaagatggcattccagatcaacataagatagaagcttacagggtcaggatcatacactaccaaatcaatctatgatacttctttgttagaataatcaaatctgccttgttgtgaaggattttaagagctgggcacaattgaagtgcaagttttttatttggcttgcggtcaataatcgataatcgatattggactgccgatcgccttgcaaaacgaggacgtccacatcctgcagtttgtcccaactgtgattaagccaaagaaacaacccaacacatccttgccatgtgtgttatcccctggcaagtttggtccttagcccttcaaagattgggcatgtcttccatcgtgccaagccaagacgcaagtcgcttttctagcttactttcttaagtaaatttggtccgcctatcttagaccggcctggctagagactatggaagtgaaaacgatgttgccacagcggcaacttcctaaaaggaaaattgggctacagaaggttgttactctcctaaaacattgaaaaccccagcttctttccagttcaccacttcgtctttaattgagccaaaaaggaaccccgttgtttagctctgattctagaatatttgcgcgtttctctccttccaaatcatccaacagacccagcaacactaaggtgtcaaatgcgcttttgtggctggttcgaaaaacttgccgccattccagccaccaatgtccaatgtccaatccggactccgccggaagctataacctggcgtcgatccatcccttgatccttctccagacaaagaggtgcttgcaatcttcgtcgttcgtcatgcagagcgggcaagattgttggtgtggccacccccgcttgctgagattatcggccatgagacacctccctttatcagccaaccacttaaagaatttcactttggaaggcagtctagtgtgccaaatcagactgcagcatctcgcttctgtattcaccatgaagaacaggtcgtaagccgaagcaggggtgaacctcccatttacagcccacttctacattgtctcatcctcctctcccccttgcagctgcacctcctggaccgcatcccaaatctgaaaatactctcccgaagagtttcaattcacttgtcataacgatgacttcggaaatcaggaagcattcgtgttgggtggagtttaaggctagagcttgatttgcatagtaggtcgctattccttatactgcgtaaggtggtttcttttggtagggggtccttacaatatgtaattgcaagactggtttgagtttaggattggggtttctttcccttcatgatgtttttctctttgcttcatgaaataataataagcagttctcttgcccattcatgaaaaaaaaatatttatctacaattcccactaactatacgaaataagagattaaggctaaacatcaaatttccatactaatctcatcatcaatttctctcaactaaactctcgttatttttctcccaagtggccaagcacgtgaacaggattattactgcggatgcacgatgacacaaacgaacgatctttttagaaaaaaaaaggcaaaatcacaagttcacaccaccgtgtttagcactttgaccatccgtcttatttgaaaattttatgaaaaatattttaaaaaatagtcacacataaagtactatttatgttttatcatctaataacaataaaaatactaatcataatctttttttaaatagaacgaacggtcaaacgttgcacatgaacagtgctaaaactgtacttattttgggacggagggagtatgagagacggctcatttatcaacataaaacctacctaacatctgagacatcgtgcacgagcacgagatgcgaagcaaaccaaccattgcgactctagatctgacattaacatacatatataaacaacccgaatggccatatgagagcacctcgtttgactaccagaagcgcactgaccaaaacccctccaatatgaaaccccgtacatgatgaaacgcaaccggagcagcagatggagtcgattcagatcccagcgaaaccaaaaattgagaatcaggaataccaggctgaggcgaggggacggggacggggcatctggtggggcggccagccagggagcgtgtacctacgtacgcacgcacggcaagaccgggacgggcggccgccgccaagcacgggccgttccccacggccacggctggctagtttattactttgcctgtgttcttctgggaaactattttaaaagtttgagtggatgtccacccgtttattacatgtcatctaaatggttataaaaaaatttaaaaaatataaataagatagaatcaatatgtaatgtatcaatccacaaatatgtaagttaaaattcaacgtctacatgctgtaaaaaaataactcaaattactatatgtatatttacagataaatttgttatttttgttacaacttgtagaagttgaattttaacttgcatgtttgtggaatgatatattacatattgatctatcctgtcaatttttttgaaaatttttcgcaaccatctagttgacatgcaataaacgggtggacgtccactcgagctattagaatccatctccctgttcttcacccttcttttctaactcacttccctctttttttcaagggcacattttttaaacagttaaacggtgtgtattttataaaaaaattataggaaaattgttttaaaagatcatattaatctattttttaattttttagctaatacttaattgatcacgcgttaataggtaacaccgtttttcatgcagaactcaacctttgtcaccaaatttggctaaaacaacaaaactaaatactctcaccatccctaaaaaggattatattctatgcacataagtttttcatgtatacttcatgcacatcaactaatcttaccatcttaagtaatttatttactgtgggaaattgaattaaattgaaaatgtatggtaaattgaaaatgaattaaattaccgaccaatgttttgtgtatgagcgtcttctctcttaccgacttcgatcagtcagtttgtagagtcatacactctccctagcccccagccttgtcgtcggagaatcgttctcagagaataaggctcttggacccttgacctgccttggttgaataagcactgatcctagcccccagccgtgaagttggaaagtccatttctgattacacggcttggttaatacgcacggcgagaactcttacacgaccagatcttacatggtcttttgtctctgaaggatccgacaaggccttatcggctctgggcgtccccagccgaagatcccttaggttcctcagaggccttgtcaagacggcgtaaagggacagtaggataggtttcaacgctaggtgtcgtcgtggtaagggatctctggtaaaacacttggcgatattgtgtacctgctatcaactttgttgaaatagaggtattaggagagtcgctataccgctggtcgaagaccaggcagtagtcgtaactcgaccatttaaagtggaaatagtggaagaaacgctacatcgctggtcgaggaccaggcagtagtcgtaactcaaccacttaaagtggaagcagtgggagaaacgctacatcgctggtcgaggaccaggcagtagtcgtaactcaaccacttaaagtggaagcggtgggagagacgctacatcgctggtcgaggaccaggcagtagtcgtaactcgaccacttaaagtggaagcggtgggagaaatgctacatcgctggtcgaggatcaggcagtagtcgtaactcgaccacttaaagtgaaagtagtgggcgaaacgctacattgctggttgaggactaggtagtagtcgtaactcgaccactagaagcaaatgtacgggagatcactatgatcaactggttgagaaccggtgagtaggtgtctctcgatcatttggagtcgtggtacaaggaccgctacgctgtcggtcgaagaccagtcgcagctgttcgtcaaccatctgaagtcatggtgcaaggactgctacgctgccgtagtcgtacctcgaccatctgaagttaaggtgcgagagattgctacgtactagtgcgagaactagtgagcgagtagaattatctctcgaacaccaatggaagttgcggtgcgagagattactacgtcctggtgcgagaaccagcgagtgagtagaattatctctcggacaccaatggaagttgtggtgcgagagattactgcgtcctggtgcgagaaccagcgagcgagtagaattatctctcggacaccaatggaggtgctagagttagtttattacatgtgcgtctcatgtggccagcatgacttacacacccaacttgtagcatattcggatatccgatcacaatcatgtcgggtgatcaagccgacggcgttcgcgaggaattatctgttaacaaccttttctcgagtagtccagccatggccggtgctatgagataggtcgtcggtcttcgttggtaggttgggtacgataactctgcatttgtcgagaatgttttcgataatggagtgtactcgaccacaacctactcgagtgctcaattgttcctaaaagatattttctagaaggcaagacatatagcagagaatatcgagtatgtaatcaaaaaactgcatgtagcttctagtattatcaggatataacgagcagatgtaattatcaggcattatgtaaaccgtaaacaagcatgatttatacagaagaaaatagagcgagcccccagcgttagaccgtagtcgatttaacatcggggacactcgtgcaaaagatattgtataaaaaacatgctctaggtaaacataataaatcatggatctgacaatgctgtatgatctgaatgataggtacggtaaattgtatataaaatattgtgtacctgtgtagatatatgccggatatatctacggaattagtagattaattgaattaattaatctactaattaccttgattagccttggtagctggtctggattgttttttctggacgcataatacaggcacgtacaggtggcccactgacatacgtacatatgtacctaaggtaaaatagccttcggtacattgtaagtgttactgtatgtgcatgggtcccacggtatgcatgtataatatacatgtagatggcaatgcagtcggccggctgcttggttggcaggtctgacgacgggtaattgactccgatctgatgtaggccgatgtatctgaatctgatgaggacacctcgtcgattctcagaataggctaatcgtcagactgatctcggatgtcgtcaatgcccgatgatgataattcgtctaactttttggcggcggatgtcggttcaaaggtagttgattcgggcaaggcctcacggttgacaactttgaaccgataccctccacggcgatgacgtcttgaaggttggtcgatctcgagagatcgaattgttgacgacgatggtcccgatctcgtcgggggacgtactctggcggggttggagctcccgggtccgaagtcgtcaagtagcttgttattggagaatccatcttttgaaacccatctcgtcgaaattctggtatttgcatagtatggggaccgtcggtgctaggatatacgcgagactgaggtaaaagagatggggacgaggatttttatacaggttcgggcccctgagttgtcaggtaataaccctacatcctgttggccggagctggagttgcttttattcaccataatcacaccagtacaatatgtggggtagcctatctaactgttgtcgacatgacggtctgaaggtctgactcgtagtcgacaacagggtagccttgctcctcgaatccgtgtccggcgagatcagaaatagcgctttcgtctctcctgacggcatccggagaaaccgtaggggaatagccatgcctatccctgaagtcgatatccggcggcttgtcttggcgtatgttggcttgtatgttgtcccatatattgtgttggttgttgattgaggtggtcgtcgattgtctcgtgtcaatcgtgttgatcatgttgatcgtctctggattcccccctctcctcctagggggtcttgtatttatacccataggtgtccccttgtccaagtagaactagggaaaccaatatagatacaatccgagtagtccttgtcgtttccatgtagaactctgattgtctttccttatccggaactccctccatattcgaagtcagtttccgtataagacatggtatgtggtgggtcctgccgagatgtagtcgactatcattagatatgtggtatccataaccctgacagtattatcctaataaagtagtaatttatttactaaaagaagggctaagaacaacgtaagagtaattcatttcactacaagagaattgaactatcgccaccaatttattacaacaaaaaataattcgtggcaatatattatactatcacaatgatattttttctgtggcaaataactatactttgttgcaacgatttacaatcattgttttgttcagtatttttgttgcaataggaaatgagctatcgccacaaaaaaacattactattgcaaaaaaacatgttctatcgccacacatttaatttttgtggcaatttgcacagtacatggtacttttcactattttctattgccatgatcaataaattcgttgcaataaaaaatttatcatctcataatttgacttattcttttcatatggacacggattaggacaaattttatatgaaatttatagctctcgatgagatctacaacttaaatttttcatttgaaatattttaaatactcaaatacatgattcaaatctcagttaggtagtctcaaatgaaattgtatgtatttttaaacaaaattgatgcgtatgtgagttggtcatggagagcgtgcatgagggagagatcttgggtttgaatcctggacatgacaagatatcaaaagaagacaagatatcaaaagaaaataattaggatgataagttaatatgaaaacatttagtttgctacgtataactaatgccacacatggaatggtagcaatagttatttattgcaaccatgtgaagtgttgcaatatatattttttgccacatccattttatggcaatatcaaattttattacaactaaataaaaatcgttgcaataacctattaccacgctatttattaccacagctagcaacgattttaagattgtggcaacattgatctattgccacaattttagtattgatgctactatttttttcgtggcgataaattatttttctagtagtgtttattgcgagaacgaacatgggagtaatatttttacttatagtgtactatgtcacatataaatagttagtaatcattttactggacatttattttgaaaaggtgcgggatgagtacaagatccgatttctacgcatagtaattttattacttatagtgttctgtgtcatataaaaaggcttagtaatcattttgctagatgattattttgtaaattgccccattttggaggcatttgtaaatttgccactggtttttttaatattgcaagaataccactcgaataaaagttctagtggtatttttacaatattctagtgatagttttgcaataacgattcaaagtagtggtaaattttgtaattgccccattttgaaaaggtgtggaggtggggggagggagcgtgggtggggggtggggatggactgtatgtgaggggagcgttttagttatagtgcatcctggttgcggtttaacgcattcctatatatagagagatatattagcctcacccttaaatcctttcttttttattcttttttttttttgctttggttacgtatagtatcttcgggttataagctgttgctgtaaagttatctttcaagcaggccccaaaggatagcccttttttagtaaatttataatgccacttcaataaagtaattttagaaaattaattaaaagaaagacatgaaaaaatccttttttttctttttcatcattgcttgaatggttgattagagactgtatatctcatcgaccaatgtgaaatagagtatatttttatcacgattggaatctggatgaagttggggcggttaaaataatattaggtcttctactatgcaacttaggtatctgttccacactgttttgaaagatcgacagaaaagaattagttatgttaggactgagcacatgtcgacccactagtttaaatgactgatcaagtcttctttcaaaaccaatttgttaggacttgggtacatatttatgtacatccctgtcaagtcttgataaagattgtcagcttgctttgtcttgcagctgagctcctccttttaatccctcgttggcttccggatcagcaccagctattcattgtagcacacccacaaacccaggagaggtagcaatggaagcaacggtggtgagcgtggggaagtcggtgctggacggagcgctaagctatgccaaatccgccatcgcggaggaggtaactctgcagctcggcgtccagcaagaccagggcttcatcaaggacgagcttgagatgatgctgtctttcctgcgtgctgcagacaaagagcagggacacaatgaggtgttccagacttgggtgaagcaggtccgtgacgtcgcctacgacgtcgaggactgcctccaagactacgttgtccggttggagaaaccgtcctggtggcgaaggcgcctctcctgcacgacactgcgggagaggcatcgcatcgccaccgtgatgaaggagatgagaggcaaggttgaggatgtcagcctgagaaactcgcggtacaaactgcttggtggccctgcagctgcctcagagccttctccccttacggctgctgagctgcagtccaccaccttcgatgacattgaggctacgcgtgtcgccaagcagcaagaaaaggtggacctcgtggatctcattactaaggacggcgatggccttcaagaaattgcagtgtggggaacaagtggtgctactggagtggcttccgtcgtatgggtggcttatcaaaaggtgaaggacagatttccggaatgccatgcttgggtaaaagtgatgcatcccttcgatgccaaggagttcattgggagcttggtgaggcagtttaaagcaaactcccatgaggggactagcaacacaccacaaggaacaccttctggggtgtcggctctgaacgagatggaagcaaaagattataacttgcttgacgacttctgtaaatatgtggctaacaagaaatatttgattgcccttaatggcctgtgtaacatagaagagtgggactggataaaaacctatcttccaaacaaacataatggcagccgaatcctggtgtgcacgccgcaagctgaagttgcaatctgttggaaaaacaaggatgggtacaaggtgtctgaaattcgacaggaagggtcattcgtcacacctctttacgtcttctacgaggaagtaaaggttagtattactatctatatttatattgtcatgtatagttttcactataaaatgttattttttagaaaccagctgctagttcactgtattacccaacgaggtttttttttttcaaaatgactacgaatcagatgctcaaattttccccaaaaatcggtcattgtttcaccccttatagaagaatgtttcaacgcttagtaaaagaatgtttcaactcttaaaaggagtgaaacacaattgaattaccaaatgaaacaatttgcttcagcataagaaacaaatgatattaagccaaagcatttccgggttttttttcttgtgctttccccgtgaccgtgcccgaggcactccctcgaacgagcctacatgtggcttatcccacacaaagagtctgctaacagggccacacactagctggcgtggctaggccacacacttgctaatcagtttgggctagtgtaatgtccttgaaaacggttttaggcccaactcgtttagttagaccacacctagactttaactctcccccgcatcacgcaaaaagttcgaattgagagttaggaccagatggaggtagatatgtactaagggcaggtacaatagcacaaacatattttaaagagataaataaggagagagaagagcagcgggctacatatttgtagccatctgtagcacggactccaagacacagtgtttgtgtgacaggtgggaccaggtattaatagtgtagtatgcaactattgtatgaattagctattagattggctatagattaattggagctagtagttggctatactattaaacttgctctgattggatgcatatctataatatttcatattttctaacatgtatatcatttgaacacgcccgctggcaaacctgttaatttccttttgtgtctctggctctgtgctaattgtatctgttcatcatggttatacacaattacacattagaacatggtactaatgctcatcactgcaaattaagataaatgcattgttcacagaaacaacagttttacctaattgttgcttgtatatattcaggactctccaaccgaacaaactgacaagacaaagtccagctcaaacgccactgctagtacagagggtcgaaaaagcccacctgtgcctaacgaacgcaaggatccagagtcccaagttattgatctaatatccaaaggtgggcaggtgatcgctgtttggggaatggaaaatgatggtgtcagaaggactgctcttgtgaggaaagtgtatgagcgctctgttgacagatttctgaggcatgcttggtttggcatgacgtctcaattcaatcatgatgagctcgttatggagttggctcgccagttgaatccagataactgcgaagacacttgcctcaaaaaaaaagaagacagtcaagacacagaaggctctactcatcgtaagcagcaagaagatggacagaacagttgttataaatcaaaaaggggaaccaccgagtcgacaag

SEQ ID NO: 79346 - DNA, 3952 bp, Oryza sativa
aatgcacaatcatataaaaatcccctattttcagtattgcacaataactcttgaatctatactactcagcggtccaggtttagaattagccctatgtagttgatatttaactcatggataatctctgggaaacttagtcgcaatccgcgcatcaacgaaaataactgcacattccgtaagaaccatacagactctcaagctccaacatctgtattgcgcagctgaagcaatctatatcaaatcaaccaaaaatggtattccataagtccccaatcaacactaccaagcacatcccatccgctggcatccccagcagtttgccgtgatggctttcaaatagaagccgggtctccggaccttccctcaaaaaaaaaaaaaaaagcacatcccatccatccaggtctcacccggtcgatcattccgcgcagcagtgaggaatggataaaaatcaaaagggaaggggcagcagtagccaagagagatgaaaacgacctgagcagcggcgccggtgcagccacggcggcgggccaaggtcgcgccagccgcggagcgggtcccagggcggcggcgtccttccacgcgaggcggtgggcgccccccgtgctggcgatcagcagcgacgccatcctcgcctccgtggagaaagaacggactagggttttggcgtctcgctgtggggagaggggagagtgcagaggggatgggggatgggggatgcgccgcggcggcaataagcggtgcgcaagatttgtttagcagtttaggtcggacttgtgatcgtactggactactggtggtggtaaggtggaactggaatttgcaaaccgcggtcgtcggtcggttccggtgggtctcggactctcggtagggaaattccacgggaagcgagcggtgcagaagcgagtttctattttttttctttaacctttttaatttttaaatttagaaataaatccctgcaaaacttaatggacgcgactccggctcgggcacccgatggaaggaggctaaaattggacactgacgttagcatgacgttagcacccgatttacatgcaaaactattttaaaaactgatttttctctttaattacttatccaaattatgatctgattgcaccataaattcgttgcaattaaatcttcaaaacaagaccacacatggatatattccgacgaaaaaaattagcttattattgaattatttttaaatgttgcacgatgttccaccgggtatatcggaattgtttcactaagtagatcaagaatgttttactcgttttaatcaggtgttgtttcaccttatataaaaacaatgtttcagtaaatagcaaaaaaatgtttcagttcactgcaacatttgatccatacatagtgaaatattataagtacactaggtgaaacatttttcggtggaacaacaaatgaaacgaattcccttaatacagggcgtttccaaaatatgtgggttttttttgttacaatggaatatttcagttcactgcagcattagatctatatatagtgaaatattgtgagtacactaggtgaaacatttttcgtggaacaaaaataaaaccaatttccccttaaaaaggggtttccaaaatatgtgggttttttattgccaaaaatatttttattcactgccacattagatctataaataatgaaacattgtaaatacactagatgaaatattttttgtggaacaaggggagacaactgggtgggtccaatggaggtacgcacgtgggggggcggggagcgaccgatttgttaagaaactttaggcttcgcccatgaaggcctggcccaaatacacttattgggcccatcaccgaactttctatatattggattgcactatataaagagaggaggaggctactcattgtacaattgattggaggattgaatagaaaagagaatctcatccctaaactttgtgtctccacttttatacgattacgggaccctcttggactacttcgtgtagctggagggttgtgtaatacgttatcagcacgaagctctaccggagaccaaggttgaaaaagggtaagaactcaacaatcctctttgcatctcgtagattaaattgcaaaaatgaaatccttgcatcttgctcgttccgtttttgtgactcccgacgaaaaccgccatcgccgacatggtgtacaataaagtgggccccactttattgtacaccatgttttggctcaaaatgattgctcatttctgagttcttggcccatccatccataagtctcattctcacagtgtctatttgattgatcgattgttgtgctgtcgattctcctccattttgatagcttctcctgcatgattagttttccaagcacatagtggaatagaatgttttatttgtgaaataatgcattgcaaacacagctagtctttatatattgggtagtattcatggttgaaactggtcgataacgaccgtcaacaaaaccccctaagcttgaacctttactcgtcccgagtaaaggacgaaaggaataaagacttgattgttgataggagttgttgcaacgctgtatatcttaaagatacagatgcaaggtatgtatactctctctaaaatcaaataagtttgacacggtggcttacccttacccctgattcccatgagacactgcctctccttgtcttgagcggttgtgagacagaacatcaattagagcactaatcacccaatctttattcaactatcattccggaagttttcaaatgattttgcaaaagaaagccaagttcctcaaatgattctctcgatcactcaaagtgtatgaatatggattcctcaccaaatttgcctttttgattcctactctaaggttgatatatggagctcggtagggatcaaacatggcatacttgtattcacatttattactaagttaaaaactttgactaaaatagatgataaatcatactcaagatcaagatcgtgcaaagtgtgtgtgaataatatggtggaaaactatgatggaaaataaaatgtggataaagaaaatgcttctcctttctcctttgtgcttatgcttttcctccaaaatatgaatttattatttttctcatagccatacatttccctctttttttttctttttttttgcaaaggatttttctttggaaaggaaacatggatggagagcttattcgtggataatgataacatggatatggtggatgatacggatgctatcttctagtgtagaagcttagcatatgtgggtgtatgatcttgatcacagagcatgaaaagtatctacacaagtcacaaggatttgacaaagtttaatggaattacaagaaaccagaatgtatatggtttaatcaatatgaatatttttggctttggtaggaatttatatcaaatgaggaactttcaaatttatcattttggaaaataaaacatacggaactcaagtcaaacttagaacatgatcatagcaactcttattttactatctcatatctcgcaacaacctagactcagatcagcaaagtgcagctcacttacctcaggttcccggataatttttggcttctctgattcaaattttgagacaatacttaaccatgaatccatatatgagagatatcaaacagagcaactattcatcatttcaatatgaagaactaagcatgtcttacctagcatattaaatctaacctatctttttggtatttttggttttgcaaatttttatgttgtttttaggtttataaatgcaatgcaaaaatttaaacatgcagtttgaaaaggaaatatgcaatgtgatacaagttaacttagtggggggagagacatctccccccaagcttgcttcttgctatagctcatggcggggatcaaatccctggtagcggtgaaacgcttgccagtcagcttgctgctgttgcactattgtgttgaagt

SEQ ID NO: 79347 - DNA, 11581 bp, Oryza sativa
acggcgcgagcacgattccgacggcgagagtgagcggcgagcggcggaaacgaaagagcggagctcgggaagggtttaaatagcgccgggggaaggaaagagcggccggagagggaggaatcgcgcgcggaagattcggctccattgattgcgccggcgacgattacgggcttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggagatgacaggtgggtcccacctgtcagcgagagtggcgggcgggcccgcctgtcatcggcgcgcgcgcgcgcggggagccgatgggccgcgggagaggagagagagagagggagtgttgggccgagccggcccaagagaggaaggggggggaaagaagacttcttttagggtttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagttcagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccagtgctaggtacttctgctattcgatgccagggtcaaccactctaactataagttatgcttcccaagagaaccatcttatcccacttgatatacttttgacgtcttcccaaataggtttactgctggacttcttattgtctgatcgttatccggccaaatttgaagcttcgttgttaggtgtgattttactctgacctctgtagactaccttcgaacatatcacttggttcataactgggaatagctcccacgaacaagcaactccgattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgggtagcatctgataccgagtggaagatttcactctttgccttcatagaaacacttttacctaggtcatcttgcttacttaatgacaaggtgactgttgcgggggggggcaattactatcaggggtcttccttgagcgatgcagagcatgtttctgtttatcaatcacctttcggcctacttctttcatgctagagagcatctttgccaatcccttttatcaatcttctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccaggtaaactaattaccaaccatcgactattatgttctcaaatattgatgtctcctggatctccttaactgttggcaggtatatccgatcttatcaatgtagaggcatgacgggtacccttaggggtttcctccaacactccttatcttgatctgtgaaaggcgtatccaaactcctatcctcaactactgtctcgttggctttttaacccaacacagtttaattgtttttcttttccattcacaggttggttattaactcgaggttagaatatagttcctctgacatgagaccctaggtctcctttgtcagtaaacaattatacacatgatcacatatccgcatctttcaaacgaatcctcatggaacttgtctgtattacacatttctcccttattacatgaatacgaggcactgccttaaccaaaaagggacggtgcttaacatcggtacattgtatcctcaacatgaatcatctctaaacatagcgagctcactgtttacagacatgattatatttatgaattacatgattgctgcaaactttcgattacaccatgataagtagcgaactgaaaaccacaaacatggctgctcattttgattctggagagatatagctggcattgttctagtgactgcatccttgattggttctgtgatgatgtgataggactgcataatgctatcattcacaggagaagcttccttctgattgctggttgaagcggatgacggtcttctgcttggtatcgccctccggaggttgattgcccttggctcggcctggagtaggtcggggagagacacaacttcttccatctacgacaattctttgctgaggctgtcgatgcagagagtggttgctatgatttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaacttccaaaggtacaacacagatactggcctctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgaccgatttctccacaacgagagcatgccttaagttctattttattctggttaaaaccttggggagacttctcatcttcatcatctgaggagacttgatctgaatcttcactatcagacactctacctccattagctaaaagatgctctgtcaactgtggtgcacctcggaaggtatttcttctctgacgtcttgtcattcctggtgtaggccattctgtgctggtaatgatcatcttacggacttcatcttcggttcgcattggtgcttttcttttctgctgaggacagttccttgcatagtgcccttgctcatcacacataaaacagatgatacttgcttcttttgggtcaacatgtggtatggcatgaggggccttctgggatgttggcggtgcgctgacttgtggtgtgaatgcttggactgcctccaactgcacttgaggttgcatctgactcgggttcaaaattggcatccgatgctgctgtagtatctctataagcaatttgttctggttaatcaggtgttggaccactgccgcacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagccggcttcactgcttcctccacttcactcgcagatcctgcagtcttctggaacttcggcaaacaactgacgatgtcctcttcttcactgacctgaccatctagtactagttgaaaatccgaagaaggaagaacggagtaaaccttttgcaaaaagcattgggggaaggagaaaagaggaactttcgcaaataatttttatttataaaatatgtccttaggttttatccacttggcttttcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgaccatcaaaaataaacagcagcggactagcgggcctacggctccatcttcacaggcgctcaactggggtataagccaggactccacctaagacatctcctccaaagcttctcttactgaaggggggaaaagattgagcaagaatgagtacaaccacagtactcagcaagtcacaccggcagaatgcatggttaatgcaagggggtacaaggagataataattaggggttaggttttgcagtaaacagcatttaaaagtcacttagttgcccaaagccgttttgtaaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccatattttagtcgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcctacctacggccgggatacccgggacaggcaggtagaactgagcccctagcattgggcaccaaccctccgccgtatgacatctcgactaccgggccgcagctcgtgtagccttcatttgccctggagaatgtccatcgacgcccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaacataagccaaccattccatggtgtccaaatgatatgagaatttcccaagtctaaagttatgaaatccaactaatgttgtcctattaaattgcgaagcatctacctaaatttaaactagggataccacgagtagagtgtccactagttgaggttttgtttactctagggtgaacaaggtaataatcataacaataacaataataaggtcataacaaaggtaaataggcatggctaaataaaacagtgataacgcgggaatttaaataaagcggtaatgcaataatttaaatcaacataattttacaaactgggattcaatatgttcaaggatgatgtgacttgccttgctcgctttcccaaacgacggcttcgacttccacgaagagcggatcttccgaaactgcagcgtctacacgaccaacggaaaagaaaaaggcttttactctaataaactccaaataacaagcaggaacaaagcacaaaaatgggttctttacttcttaaggaaaaattagagacttgaacggtccaattccgagttcaaatggccaagatatggccatttgaagtttatatgctctttaaatggatacttgcgaattcttcatttaaattttaattaaaaaaaaacggattattgcgtcagccgagggaggggacgcgcggaccgggtccacggggagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcgacgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggagggagacggcggcgcggctcgggatgacgatgacgacggtgctccgacggtcggcgagcgaaacggaggcgcggacgaggtcgacggcgatgcggcgatgccgagggaggtgtcgccgagtcgggaggaggaccggagcgacgtcggcggcgaaccggagcggagggagacgacggcgcggttcgggatgacgacgacgacggtgctccggcggtcggcgggcgaaacggagacgcggacgaggtcgacggcgatgcggcgatgccgagggaggtggcgccgagccgggaggaagaccggagcgacggcggcggcgaaccggagctcgtcggcgacggcggagagaagatgcgacggcgcgagcgcgattccgacggcgagagcaagcggcgaacggcggaaacggaagagaagggcacgggggacgattttatagcgccaagagggaaagagggcggccggggaggaaggaaaccgcgcgcggaggtctcgggcgccattgaagacgccggcgaacttcgcgggatgaatccggacgaatccgagggagagagagagggaaaagagggggaatcgggagagggaaacgcggggaataattcccccctcattaaggcgcgcgggaaaggcgggatgcggcggattcggcggcggcggcggcgctagggcacgggcggcgacggacgcggcgggaggaggaagatgacaggtgggccccacccgtcagcgagagtggcgggcgggcccgcctgtcagcggcgcgcgcgcgcggggaggccgatgggccgcgggggaggagagagagggagggagaagtgggccgagccggcccaagagggaaggagggggagaaaaagaacttcttttaggatttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttagtgtttgccaatttcttttcgaattttaattaattctattattccttttagaagatgatttttattttcgggatgaatttatcaggacgtgacagcggcctgggccgagcaggccgggagggaagaggggggggaaaggcagcccgggagagagagggaggagggagtgggccgagggaaaggggagcccaagagaaggagggagagaaggagagggagagaaaaagagggaggaaagggagatttttgggctgggcttggcccaaaggaggaagagagattatttttaggttttctttttttaaataaactttgataattgtttttgttgcttaataattatttccggtgctctgaaaattcaagtaaaatttgagggctccttttagaccaaggagaatttaacaaaaattctccgggccacatttgaatttttcttgcacgtattttagtgtttgccaatttctttttcgaattttaattaattctattattccttttagcgaatgaattttaattttgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttcttcactctggactgcttggctcgatctcctgttgcagatggaatcttctcttcacctgacttgtccctggttgaacctttagctgactttgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttgcacattcagccctgacgtattctttttagatttctcttatcaatcacctttcgacctacttctttgttcgataataaacacctttgctggtatcttctatcaatcacctcttaaactttgtcaaccaagtactcttcactccgagagttgtggatgcttctggtgacgatgaggtcctttggcttgctgcctttccgtgaaaccttgaagtgtttcgccaaaagctatactaactgtcgttgcctttgatccgaaaaggacgcatctgtaactcttagtccaaacaaatgtctctttggttaatcacttgatttttcttttccatcctcaggttggttattagctcgaggttagaatatagttcctctggcacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttctactatgggttagaattaacatgaggcctcacaggtacggcgtttgctccagtgaccacaaggcgagtgacttgtcttcttcttgcataatggccggagtgatgacgcaggttacgcttcggctgtggacaatctctggagaaatgacctggttctttgctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccgcctaagacatcttctccaaagcttctcttactgaaggggggaaagattgagcaagaatgagtacaaccacagtactcagcaagtcacaccggcagatgcatggttaatgcaagggggtacaaggagtaataatataggggttaagttttgcagaaaagcagcatttataagtcacttagttgcccaaagctattttataaagacgatcctagagctacacagtattattaaacaaggccgggaaccctcacgaacctggcttaacccaaggcctacgatgattcaaaccgaactggcaacccgaccctgggtcccaagctcgtccaaggcaacccagggcaaccattccatattttagttgttgagcaaattttaagaattaaaacactgacttgggtacattggtcggcttgcccatatccgagggcgcggctattcgaatagattatactctgatcagaggtgtacatctttacccacaagacacatctccctcacgtgttgccacgtgccacataccaccacggtatacggacgaaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatggtgtccaaatgatatgagaatttcccaagtctaaagttataaaaccacctaatgttgcctaattaatcagcgaagcatctacctaaattcatacttgtggaaccatgaatagagtgtccactagttgaggttttgtttaatctagggtgaacaaggtaataataataacaataacaataataatatggtcataacaaaggtaaataggcatggctaaataaaacagtgacaacgcgggaatttaaataaagcgataatgcaataatttaaatcaacataattttataaaatgggattcaatatgatcaagatgatgtgtcttgccttgctcgttttcccactcgacggcttcgacttccacgaagagcggatcttccgaagctgcagcgtctactcgaccaacggaaaagaaaaaggcttt

SEQ ID NO: 79348 - DNA, 26848 bp, Oryza sativa
  unsure (1)..(26848): unsure at all n locations
attcctgcacccctttgggatttggatccaaccgaggcatccgtggtcgggtcccaactgtccctgtacatctgctggtggtgaagaggaagacgcctcctgaggtgcttctctcgccatccgtcatgttaccctgcgtgagacatcacgaggcaactccgcttggagtggaatggttagttctcggcaattatacaaatgaaactccgggttaggtaacagaatctcatttgtatagccgggaaacaaaaatataagataatcatttggaccatgtttgagtatgtggcattgaaccaaataggtctcatcaacataagagcgggtaataggaatacttgcatataaagcagagtcccaactcttcatgctaaacgagtcaccaaagaaatacactaaacaggaccagacaacttcacattttctaaccattgcttgatcatgggttgaacgggtgaaactttgtttttttttaaccatggcatacaagaggactagttcgcactatccggataacagctctatgaaacaacgtgaaaccaagcaacttatgcaacagccttaaggtaggattatggatgtcattagttctaggctttctataggatgagagacccgaaatactttgccaaaacatgcgcttgttaaaatcaagaaatgtgtccctgaaattaactttgcatgttttgtcaaagcctagatgcaagctaaggtctttccaagaaaggtgatattccttgcggaataaccggaaagtaacaccatcgcctacctctagcaaggcacataaaaactgcatggtaagcaaacgggaacccggctcatctacacatgcaaatttatcccatcctaaagcacgccaaatagtatgaaactcagcatccatccctatccttttcagaaggtcgagtcgtatgatcaggtctgagtacacgctcggtctttcagcatatgataggcttgcatttcccggtcgcccacgaggtcgagattgaagttgtcgtactgccttggtggaacgtaagcctcctccatggatgcatccgcggaagaaggtgcactcggcttatcgtgtcggcttgtccgtgagcttgaccgtctcttgaatatgcccgaaagtcgtttcttcatagctacaacaaagagcaagaatacaagattactcggacgggggttaagcaagtacccgccgattaaccttgcaccgaactaaagcaaacttgtatatgcaaagtgtctaaactaaatgcagcgaattgtgtgaatttgaggtaagcctgcaaaactttgaatgaattttggagcaagatttttgagagggagtgaaaatgagttaaaatggtgtgacttccctctcctagccgagctgcatatatagtgcatggataactgctagtaatggcatgtggaccccactagccgctaccctgcagaaatttgcagccagccggtgccaggccggttggttcggccgaacccccggtggacccaattgtccccatattttgctgttggattccaacgactagtgtggtggtggccgtgcaaacttttgccaaaaaatttattttattttgctcacaaaaattcatttgaagaatttgcctcaaattcgaacctcaatgcatgctttgagaattcaaacattctttgatgcaatgggaaataaatatgagatagctaccaatttacctgttggcaagggcgacgtcgttttaggtctgacgagcacgaccgtacctccgatgcatttagctcgatgaggcaccctgttccggaagtacaggaacaggtgtcttctccttaatccgccacaccttctttgccttaggtgcaggcagcggcctcttcataactgggaacgcaggttgaccgacatgtattcccggcttctaggatgccggcttaaggtactgacggttcctcgttttcttcccgctccaagaagttcatcatgaaagttttgaggctatccgtccttcagtgttttactttgacctccttgtgggttcggtccattcctgatctaccccatgaagcaatgctccatccttggtctccttgtggatgatacccgttgttgttgttcgtgagctttgacattctcacaggtttttggacaattcgtcccaaagtggccgtcattgccacagacctcacatgccatgtgagagcccagggccttaatggtaccctgcttggcgtccttctcattgttgtccagtctcttcataaggagatccaactgggcggcaagcatttccgtctcattgacggtgtgcataccgcattgacgggtttatgttgtttctcgctccaacccatatttgagagcctcttctcaatcagatcagtggtatctctgaccatctttgagaagggtgctcctccagcagcagcgtccagttgatcccaggacgagagtgttaatcnnnnnnnnnnnnnnnnnnnnnnnnnnncaggatgagccactcgtccatcccatgatgaggacgggcggtgacgcattcctgcagcctttcccaagcttcaagaatggtttcatccctcgttcgctgcaaaccaaatattcttccatgaagagcgttggtcttgcccatcgggaagaatcatgagaggaatgccgttgagtgcttattccgggttttcaccgttgcacggttgatgtagaaccactattttgctctcccgaggagggagaacgacaacagttggagtctgagtcctttgacggtatacgtgctacaacttaacaggaattgctgcaaataagcatttgcatcctccttaggcttgccacagaacaggcaagcctgcgccatcgttaatttagctggtcttcaaattaaagtcaccatctcccctgctgacttgggttccaactggcatgttaccagcagagggagcagcgaacttgcaaagggtcttctcagccatatcgtgcaattctggtggcgcgaaattggctggtctagttgccgatagagtaaccttgaggatgaacgataggggtcagcttcacttcatcagtgactccagatatgaaattggtcggcagatcagaaccaatcctgtactaccctattttcacataaaagagaaaacaaacaaggtttgcctacaaaggacaatgacttatacagaggtaaatataaaattattagaaagtagtaaactcttaatcatttatcttccccgggcaacggcgccagaaatgcttgttggtatttcttagcgacactactggaaatataattcccagcagtagcactagaaataatcctggtatattatagttacagatgtgatccgcaagcgcacggatatactattatagcatttcaaccggtgttggcggttgttaaatgccgattctataccgccaacggctacataaagatcagataataaaacatccaacatagtgataggtgtttaatctcacgtattccacaagtgtatttgtatgcaggtgataaaccccgaagttgggaggaaatctagactaaagtgaggagaattctgtatccatacaaggatacgttgtgaacttcatcgaggtatcagtaaatcagcccaaaataccaagaattggatagaggaggaccaggggaggacatgggccaaaggccaggccaggagggcccagcccaggttcgcccgaaccctggtaaacgcggttggatccaggttttggcgtggacggtcctgatcatctcctgatggcggttgcggggcatttccgacaattcgcagagtacaaccgtcatacctacctctatataaagacctcacttcactcacgtcaacacacacttccaagcttgagctaaattataagaggctctattgtactatattttatactagaataggaagagagtagagtagaaggagtcggaagaattccggagttgtcggtaatcttctcctatttcttttattttgtttattactctgaattcaatataacattcttcttgagtaatttagatttatcttgtgagaattatctcttggttagttcgtaattagcatacgagattattgttcactataatcaaccaaaatatagtgattgctttggtgagttataaacactaaagtagatattaattgcttagacgtggtgtttaggtaattattatccagtaattgctgcgtatcccacagtacgtttgaggtgggtgtagaggtggtgacagccctcgagatcacttaagtcctccctgtccgggtacataatagagagacatctgggaacagcgggttgccagtgcctgaagtattgcgttaggattaaaattaagctttccctagacactatttctcactagtgaatcctctctatcctagtctatcattagcttcgtgtccttggatgaaccagaagaagatctgaccacacacgttcccttggattcgatacccttagaatactccgtaggggaagtactacatcggtatatccgtgcgcttgcgaattttatctgtaaccgtatcaaataccaacacccgggagtattccaaggtatcgtatttattttatcccaagggaagatatgataagagagtactatgctaacaattcatatattacttatatacgtcaaagtctacgtatgggttagttcagttcaaagggtaggttgacacacaaaagaaagaactaagaactactctcactaaaatatagtctaagctaactggagaaagaataagaaaagtatcattcatgtacttctagtatacatacatctttagtctatacttgctattatactgtcatgtaaccaatactccgtacccagtgtcctcctggtgttttgagaagccaccccttactgccgagttccttacgacagcctgtcatgaccatacaaccggggctaaatacggaggagtaccctccccaggaaattaacttaggactatatacacacgcggaggaatacccgtactgagctgtcaccatcagcggcccacctctcatctgcagcatataaccccaattaatggtatataataatctaagcaccgcgcttacattactaaatactactctacatcctttcaaccgacgtacaacaaccgaataatcggacactaaacccacaccaatacacctatctggaaagctagttacatgactatattgattcaagtataaagtaaagtcggcactcaagtaatatgaatggaataaattaccgaacttgtataaagaagaatattctattaattcagtaagtcttacaaaagaagaaaggaaagctattaaagccataaccgaaatctcctgaagactcgaggacttatgaagactattctatttcctactccactagcactagaactactaaacagtacttgagagagctcttgatcttcttcttgaggtgtgtgagggaatgaatgagaagaggggtatttataggccatgaggtgccttgggagagtggaaatgctccaagcatcctatgagcatctttgctctcatcatgacaagtggcatggtcaagcatcctatgggcatctttgctctcctcatgacaagtggcatggtcaagcatccaaagagcatctttcacccttctcttaacaagtgtccactttcatgacggtttctaccggtagaattgctcccaactgtcataggatacgtgtagataactgccggtggaaaatgggctggattgggccagctaatggttcggccaaaccaccaggggttcgaccgaaccctggctggctcccctggcccatagccttctttaggatgctgacatgtgggccccactttattttacaccatgttttggctcagaatgattgctcatttctgagttcttggcccatccatccataagtctcattctcgacagtgtctatttgattgatcgattgttgtgctgtcgattctcctccgttttgttagcttctcctacatgattagtttccaagcacatagtggaatagaatgttttatttgtgaaataatgcattgcaagcatagctagtcttcatatattgggtagtattgacggtcgaaactggtagataacgaccgtcaacaagcctgtcgcgccacaccgccgcgactggccgagccgccgcgccacccgcaggccgccgcgtcctgccgagcccgccgcgccgcgctgcctgcaggccgcagtgccgcacgaaggccaccgcgtgccgcgagcccatcgccagcagccatacgccatcaacggaaaaaaaaggaaagagaagaaagatggaaagagattggcgattttgcaaaagggcccctggcttttctgaaaattatgcgcatatctctcagcatggagattccttgggcacagacccttgaatttcataaatttccattttcatccctccaccgcatggaaacttagtaaagggccccctgtatttgcacatttcgcatgcatttcttatttaagcattttgtttatgtcttataaattttgaaattgaatttcatgaaacattaattaatgttaattgatattttgaatttttgttttcagtatttatatgaatatatgcaacctttgcacctttttttatgaatatttgtatgcattttaatatgaaatctagtatttctttatgaaaattgcatttactatgaataacattcatttctttgaataattagcaattcctttgcataagaaatattggaaaatcatgaaaaaagttgcattcatatttgcaaccatgttactagtagtaacttatgaatattttgttacttttgcaacagaacgtcagggatcacgtaccaggagtttgccgaactggcccagcatggccagaaccatggccagaactacctgacctaggcatctgacgtccagatcgtccttggagccaagaaactccgccagacgatcgggatgggcaccccgcaggaccgtgcgcctacccctgatgagaacgatcaggcgctgcacttcctgcgacaccacctctacgccacgctcaagaatgagtacatgggattgcggagcccaatcactctctggaccgcactcaagaagcggttcgagaagttgaagtacaccatcctaccccaagcagagcaggactgggctcgcctgaggttcgccgacttcaagagcgtcgccgagtacaactccgcactgcatcagatctgtaccaacctctccctctgtggcaaggttgtcacggacgaggagatgattgagaagacgctctccaccttccaccctagcgccatgcaaagcgctcgtaactacaggcaggcgtcatacaaggagtatgacgagatgatcgatatcatgcaggtgtctgagtctcatgaagaggttctccgcaagaactttgtctcccagccacctggcaagagtgttggccttgaagtcaatgctagcagttacaaggtccgcaagcccgtccagaggaagaggggcaagtgtggtgagaagaaggcaaccgagaagtcagagggaaaagctcctcctacccagggagcacagggaggcaagggcaagaaggaagccaagccacctcgcaatgacaagccatatggccagcaggaccagacatgctacaagtgtggcatttggggccactggagttgtatttgcgaggagcccccgcacgtcgtcgacgcataccaggccagcaggaaggccaaggcatccacagaagcacacatggttgatgctcacactacggccactccccaaccactactccacttgacgcccctgcagctgcagtaggcacagcaaatgaaaaggacgtcacacaggagcagatctttgcagagctcgatactctagttgattccatttaagtatttgatgcccctactttatttcatgaactaagttgctttaggaacaatttgaataatggttttgtaagctctatgagagcataacatttatttcgtgattcgccatgcatggctagactttatttccaatattatgttgcattttgctatatgataaagttttacttcttgccttgaagtagtgatgttttactttattcacatagacaatatgcatagcctaaggtgaagaggaacattctggaacaaaggcaccacaaagtgtaatcttgagagacatgagacaagttcagtctatgcaaagacgtgaactaccttcacaaccgcacgcaatgattgtaaaggatattgtttttctcgtagaaaagcgattacacctcaaatctcttgagaattgcaaactctcgcacaaaagttcccttgtaggaactagaagatgagagaagcatactcatcacctaagcatgtgagatcaatgtcctcactaagaaatgtaggctaaagtagactacttcatagtcaatttttcttagaatttagtatcttgcaaatgaatattgcacaaatagtgtcacatcatctgttgtatcgcaacgatgagacatttgtcacgcgcactgcctgagcgcctcgcaccaaacttgcgccagacattggcgtccatcctacagcatcatgatgcgcactaaggccgctactagcgccgcgctctaaatgccgtactatgcaccaaatagcatcctcgctgtactgggggactggacaaatcatgccgcgctagcacgcgccatgcaactcctaccatgcgccacagttgcaccggctgcatacccagtggtcactctggccgcacataccatcgaacatcggatgcgtgcaaaacgtcgaccaccacatgaatttcgagataccttgaaaggtataccggaatgaattcgcacataccacatgaattcacatgcatatttagccctttaaatggatcatccgatacatactgcgcttatgaaaaagttgcaatttgtgtctaatcgacactacgctcttcccaaaccaaccctgcaagatcatgcatgttggcatcagcatattaagaaaaacactaagtactggacgtccacaagaataggactaaaaatgtccactgcatcattattgaaattcccgccactggaacagacttgtagatccaaaggcagcgaattatcaatatttggactattcgaaatgtgttgtccacttaaaagaatactagtgttgacttgacacacgtacatactccacgaccatcagggctcccttagaaaaaattggaaatttttaacagaggtacgaacgtagcctaaattccttgacgataagaagcattatttcaggggagaaataacccttaaaatgataaatgtcaggaaaaatggtcaaatgaaaggatggatgcacatttaatcaagcattaaccgcactaactacaacactgaatgggcaacggcttgatctgtagtgtagcatgtcccagcaagaggtgccatggtatgtagttgataggtggtaatgtcactaaatccataatggctatgtcaataagtccgtattgggagccaagggaacttggctagaggttcggccacatctactagggacttggcgggtgaccattctgttgagcgtgttatacaaaggggtcttgtcacaattccttttcgaggtactgtggtggtattgaggcacatagtgacatgttgtggggttgtgtcttgtggataatttgtacacctcgggctagagtaaaactattcgaataatcatgcccacggttatgaacgggcctacatattttttccgtgattagtcccacactattcattaatgataataattgatggtgataatttgttagctcttgttatgaagtttagatatgtgaaactgggattggttgttcagagatggttgggcctgtgcagcattgatatgttgttaagtgctgattaattactatactattttactactctcaaatatttgctaaatgttgcttttgcaaatgaaccatatattatgacatactttattatccctgtccacttgcatatttgttatgtggcttgctaagttttccatgtactcatcttgtaataatcatcaacttcatttggagaaaaaaaggatccagaagaagaagacctttggcctagatcctagttaagctgcaagtggaagtggagttgaagtttcgctagattttcttttctgctgcagttttcttcattgtgaggactaagtgcctcttcagtaagtatttatcatattagtttatttagtattttatattcaaattgtcgatttgtgtacctcggttgatttctgaacgaggatttaatgcacaaattagtttgaaaattacttgtgaattttcgggtgtgacattcacgaatccaaactcgatgtcacgatgagggacataaaatgaactttttccttccaaaaaataggaaaaagtacacagaaggtccctcatcttgtcaccaaattacaaaatcgcttctcaaacgaaaaaccagatatatagcatcctcaacttacaaaaccggatcactttaggtccttaggcggttttgttctcggtgttgtccaacgtggtagctgagctagcgtagaacccacgtaagcctcacatgtcagcaacaacttcccctcgctcacctcctctcttcaagtgcatggccggcgtcctccccttcgaggagcacaaccgatgggggaggagtgtgggctaaggttggtggcgtggatgagtgagaaggccccgtcgtcgcactgctgaggcaccgcctcgccaccaatgtgaaggcgagctggatattgtaacgccgcgctttttgcgagacgttaaaaactaattcggcaaaaccctatctgtgaaaatttctttctttgagtgggagtctaagtcgtgccatggatatcaattcaaattccattgttccctctccttgacataaaaaaacaacctcatcaaattccctttccaaatcaagcttccgaaatcaaactccgacgtccaatctatcccttcgaatcctcgctaaacaacttgtctcgattccacaaaaatatccaaatttcccccttttgatctcttccaaatgcccaattcaatttcaaattccaaattccaatccaaatcctctccaaaccaaaccccttcggcaaaagtctaaaaatcctccctcttccctgtgggccaaatctcccccggcccattcctccctctgcccgtctccttcccccacctcgcgtgcctcacacttgcgccgctctgagcaagagaatgagcgctcgctctctctctctctctatctcttcctcctctctactctctcgcttcccggggaaatttaactatttgccactcttatgagtgccaactctccatatgccactattagatttggtataacatatctgccactagagagagattacgccctaattttttgccacttttgttgagttggagcaccacatcagcatgccagcatggaccagcctagtgaaatgacaattttacccctccattcgcaagtggttaatagccaacataatacaattaaattaactacacacatgaataaatgataaaacataataacttgagaacaactttgttctcaacacataacatactgcatcattaacacacatgcacaacaaaaatcaatttttatcctagaataacttcttcatcgttagaaatagtactaccaagttcataaccactatcaagttcagagttactgtgaaggccatacataacaagtttcatgccattacgcaaggccatacatcattacaaaagcacaataatagaaatagcaacatcaggccatacacttaagttcgttaggccatacacttaagatattcacaccacatagcaaaatatgccataccaaagtgcacatatcatcgcacatgacttgcaattagtttttccaaaatatcatgccatagtagaccacaaataaccaatttcactagcaggttgacaaatttcaatccaaaagtctaggtggtgttgcacttttcttcttgcttgcgagcttctttctgggtgtaagcttcttgggtggctccactatagctggagctacttgagagctttggtcaagctccaatgcgaacctcctggtgtttgtgatggtgtaaataataaaagaagtttagttcagtgcataataagtaatgaaagctagagaacaatgaaaagagcataatggtgcttacctccttgtgactggtccagggctgctgcttgtttgtgatggctgcacttgagagctttggtcaagctccaatgccaacctcctggtgtttgtgatggtgtaaataataaaagaagtttagttcagtgcataataagtaatgataagtaatgaaagccggagaaaaatgaaaagagcataatggtgcttacctcctagtgactggtccagggctgcttgtttgtgatggctgcacttgtgtttctgcagctccttctctagctgcaactgctcttgttcttggtgtagttacttgttcatcactaacaccctttgatttcttccttcccacctttgttgttgttttcttgttcctcttcctgccaaaagaaaaacagttagcatataacagcaagaaaatgaataataattgagatgaaaatgcagcacacctctttttgtgccagttagttcacatctagcacttcccttccagtgtccaaagacaccacattctgggcacttaatttgccttgtagccttccccttgcccttctcaagagcagatggcatcctattctttctttgcctacccacttttcttttcttggatgtcacacccggaaattcactagtaatttccgaacttatttgtgcataaaaccctcgtccaggaattagccgaggtacacaaactgataatttaatatacaaatccatcataataacatcattacatacttacaaaagaaaagaaaacagcagcggaattaacggtctagcgatggcttcagctccactcccacaggcagctaaactggagtataagccaaacgtcttatccttctggatcctttttcttcaactgaggttgattgattattgcaaggtgagcatatgacatactcaacaagccacacatcaaatatgcaagtgtacaaggataccaaaggatggcataatataggctcatttgcaaaagcagcatttagcaaatatttaagaatagtaaaacagtatagtaattaatcatcaattttaatcaacactgaacagcccacccatgctgctcaggcccaaccattctgaacaaccatacccggctgtacagatctaactccaaaccaggagctaagcaaattattaccagttatagcatcaataattattgtgagaggtgtgagactaatcacgaaaaacattgctcaacccgcctatgaccgcgggcacggctattcgaatagttttactctggccagagatgtaccactgtacccacaagacacagcctcaacatcatgtctaccatgcgtcgcgatactggaaagtacccgaatagaggctgtgacaataccctctgcacaacacaactcaccacagtgcaccatttctggatcataatcaccccctctaaaaatataactagaggcatggactccccagcgacccccacgaacttctcgccgcttctcagtctggtgccccgcaatgaatcatgctatacaaaaggtaaagccgttgcccacgctggcttgtggttggtacggttaatgtctcacaacagtggctcgcgaactggtccttaattgtcatgagcacgaccttcaaaaccatgtgctcacaacccaccattgtcaaattttaattatcaattaattatcataacacgattaaccatcgtgagctaccattaaacataaccataaataacaatgtagtataattcatcccattaatgagctcatgtttctaagcatggctaagcaattatatatatatagcttttagctaaaccaaaccaatatataaggttcaagctaatcaatttattacctaaggtatcaaggaatagggtattcaatgcaaattggccataacaaaggaataagttcacaccacccggtgacattcgaaaataaatgcacagttgaaataaatagagaatttaaataaaggataacatgctcaaaggattgtgtttgggatctgcgtgacttgccttacaataatcggtctttaattattcttcttgaacacttccgacgcactcacgaacctttgcaatgacgaaaacgacaagctaacacgcaaaacgatgaaaaaaactaataaaaaccaaataaacagtacataaaagtaaacgaacatgtagatcatgattttagatgaatttagagacttgaacggcttcattccgagttcatatcaattagttatgaattttacaagattaaattgattttagccttatacagaaaaggattaacgatgtcacgacgacatcactgccggcgatggagagagatggctagcgcggggagaggcggctagggcacgggaactcgagctaggggatggaaacgaaagaggagggcttggggttctatttatagggaaagctggaggagatcggctcggacccgagaggatttggcggcggattggttaaggttcgccggtttgggataaagtttatccggccgatttgaactcgaatcaaaggataaaatccaattccttaggagaaaaggaagaggaagataggaggaatatttcccctcaactaattggacatggggtcgctcaggtgcgacggatttggcggaaaatggcaccggatcgggaagaacaggggctctggacggctggctcgaggttgaagatgccactgtagcgatagggagatcaaacagacttccggctgggcttcttgatggccggattgaaggaaggatagaaactggacttcgggaaagagagggagatgggctgaggatgacagatagacttttctagtttcagcccgaaaaggaaaaggggaatttcaattacttttccaattaaattaatcactgaaatgatctttgaattggtaaaaatacttccaatgctcaaataatttcacgaaaaatcctgaaaatacttggacactcaaagtacttaacaatattataatcagaccatttaatgattaatttaatatgtggataattactaaaaggttgtttgtattattaaaattaagaattgagctccgaaaaatcaaagaaaattccagagagtataattaactatggcgaatgtcatgcccagaaattcacgaactagaatttctacgataaatgtgcattaaatccctgtccaggaccagccaaggtacacaaacgacaattattaacatacagatctacatcttacaaaaatataaaagattacaaatgcagcggaaagatcgaacgagctagacttggacgcttgacttttacagcggggcgactccacaccacaggcaatccttgacggcagcgacgaaaccaacttcgacaagacacctcccactaggaagatcttcagctctggtgtggggggaaagagagtaagactgagtactacccactgtactcagcaagtcataccggaagaggaggtatgatgcaggatataactaaaggaggctaagggttcatttgcataaagcaggcatttaaaagcagaagtggaaagcagtaaaacagttgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccgcataaccctcccctaaccatccacaccatgctaaggtttcacccccacccccaacgggcagtgggcggtcccttcttgcaccgcggtgaatccggcagctggacaatcggacaccctggccgacccaactccatcacgcccaccctccccaccggtgcctaggaaagggtcgagctatacttcagatcaagcagttacccactcccgcttgtggtaagcacgataagtctcccagggttttccgtgaaccggtccttaactgccatgggtgtttcagtgtattttaattaactaacaccattgcggtggtacaaatccaaagctatgctaatagtcaaaatctatgtaataatgtgatccccatttgtgtactagttaaactaagtatggctaagcatttcctaaaccaacatctaatcattttgatacccaagttatcaatggcatacggtaaacaatatatggctgagtaaggggacccctcccacatgacattgtaaaagaatgcaacatttaatagaaatacgggatatttgtaaattgggtacaatatgatcaattgtaatgcatgacttgccttgctctcgcactgatgagacctcagcaaacgtcttcgagaaaccgtggatcgacgaaaccgccgaaatctacgcgacaaacaaagcacacaagcaaaacatgctataagactactgaaacaggaaacaaaaccatttttaatggattctagggatttttatgaatttactgacacttgaatggacttaaacggagctcggatgaattagttatgaattttagaagataaactgtgtttttcctaataaagaaacagtccttaattaatttattgcgcaatattgcccagggctgacatcagcgaaagggggaggaggtggcaccggctagtggtggccccactgggcagtggctcaaggggaggggcagacgcccggtcggcttggctcggcttcaaaccggtcggccggtgaggcgatgcggcggcggcaatcggccaccgacggcggcgaccggcgagaagacgacggcggccggtgacgcggcggtgcgacggcgaagcgccgaacggcgacggcggcgcggctcggcgctaggagggagaggaaggggaaaaacagggaagggggtgcctcaccggggttcggccggcgcgggaggaagtgacgacgaacggcgacggcgagcgaccggagagcgacggcgaatggcgaccgagctccgggacaccctaagagaggaaaagagagaggttagagtgagagagggagtccacggcgagcgaaagcatagccgaaggcggcggtaatggtggaacctcacaagagcgcggggagaagtgggctccggtggcggaactcgacggaggggaggtggacgaggtggacctcggccgcgcgaacccgacggcggcggcactagcggctgctagaggcggccggagtagtggaagaggcggcggcggcgggtgggtgtacggtgcgggagcggtggagagctctggagaggccggcgagtgagggaaacgagagaggggttgtggcgaagctttatactggctcgggaggggcggacacgaccgggaaacccccccgatttggccagtgacatggtggagtggggagagagagttggggacgggattcaaatcgaatcccgcccatttttgggcgcgcgcgagagcgggaagtggtgggggaggggcggcgacatgggcgcaggtcgcggagtggggcggagtgggcgcgggagacacggacggcgacgtgggagcggcggttgccggccaggcgcagtcggctggaggaaggggatgaccccgataggtgggccccacctgtcggcgtccccgagaggaggaagggcggcgcggtttgggccacggcctcgggccggcccagcaaggagggcgcgcgggagggaggttgggccgacggcccaacaaagaaaaagaagggaatgaaatggagaaaaaggaaaaagattttcctgggattaaatattgtggttaatgaattttaattggttaaaattacttatagggctctgaaaattccactaaaaatcctattaatcaattgtgacatgtggaacccaagaaaaatcccacaatgccattttcaattattgaatgcatttattaattagggaattagctctaggttaattaaacaatttcttcgggcaatttgtttaaccattttttcaaaagcaagaaaaagagggaaacttcagggcatggcaaacctaccccccttaaacggaatctcgaccccgagattcggaagagctggcgaagaggtgcggatgggcggccttcaattcatcttctctttcccaagtggcctcttcctctgagtggtggctccactgaactttgcagaatctgattaccttgtttctggtccttatctcgttggtttcaaggatacggtcggcttctccacatacgtcagatcttcctgaatttcgatgtgatccggacttgcctgttcctcaggaactctcaaacatttcttcaactgagagacgtggaacacattatgaatgccaagcatgttggaggggagctcaagctggtaagcaacttcacccctgcgttccgaaatccgatatggtcccacaaagcgtggtgccaactttcctttggtttggaagcgatgtactcccttgagcggagtgacacggagatacacataatcccctgcttcgaaaacgagctcccttcggcggttgtctgcatagcttttctgtcgagattgcgcgattctcaatctttccctgacagctctgactttctcttctacctcatttaaaacttaaataccaaacaactagcgttcccctgtctaatcctagaagagcggagtacgacacctccgtccatacagtgcttcaaacggtgccatttgcagactagcctggtatctgttgttgtaagagaactcggcatatggcaagcttttgtcccatgctccaccaaagtcaagcacataggctctcaacatatcctccaatatttgattaacttgctcagtctggccatcagtttgcggatggaaggctatgctgaagttcagacgggttcccaattcttcttgcaatttctgccagaactttgaagtgaattggctccctcattcagacacgatcttcttaggtaccccatgtagacacataattcttgccaaataaagctccactaacttcttccctgagtaggtagtatgcaccggaatgaagtgagccactttggtgagccgatcaacgactacccaaatagaatcgtgccccgatgacgtcctgggcaaacccgtaatgaaatccattccgatttcttcccatttccattctggaatctgaaggggttgtagcaaacctgctggcctttggtgctctgcctttactcgctgacagacatcacagagtgcgacaaattcagctatttcccttctcatactgacccaccagaatttttctttaaggtcttggtacattttagtactgccgggatgaattgaatattgagtttgatgagcctctgtgagtatcaggtcttttaattccttgttttcaggtacacacaatctttctcccatccagattgttccttgttcgtcctcaacaaaacctcaggcttttccaactctcatgttcttttcgagctctgctatttcaggatcacttgtttgagctatgcgaacctgctccaccagtgtgggttgtgcctctagggcagccacgaatccgtgctcaactataccaaggtttagatgttccaaatcacgttgaacctcacagcatagttcctctacccatgcgacgttgcagtaactcttcctgctcaaggcatttacaaccacattagccttgccgggatggtagtgtattcctatatcataatctttgattagctccaaccatcttcgctgtcggagattcagatcaggttgagtgaatatgtactttagacttttgtggtccgtatatacctcacaatgattaccaatgagatagtgccgccagatctttaaagcatgaacaactgcggccaattccagatcatgggtcgggtagttgccttcatgaggatgcaactaacgtgaagcataagcaaccactttgccatcttgcatcaacacacaccccatcccttggcagaatgcatcccaatatacctggaaatctttcgcctgatctggcaaaattaaaactggtgtagataccaaccgtcgcttgagttcttcaaaacttctattgcattcagcagactagacaaacttttcttccttcttcaatagctgtgtcattggcttcgcaattttagagaagttctcaatgaaccggcggtaatagcccgctagccttagaaaactccgaatctgagtgactgtctttggtggggtccacttggtgactgactccacatttgctggatccacagctaccccttgagcattcacgatgtgaccgagaaactgaacttccttaagccagaagtcacacttgctgaacttggcatatagctggtgctcttttaacttttcaagtaccaaccgaagatgctactcatgttcttcctcggacttggagtaaatcagtatatcgtcgatgaaaaccacgacaaacttgtccagaaatttcataaacaccttgttcatcaaattcatgaagaaggcaggtgcactagtgggtccgaaagacataactgtgcattcgaacaacccataacgagtgatgaatgctatctttggaatatcctcttcacggatcctcaactggtgatagcctgatcgcaggtctatcttatagaacacagtagctcctttcaactgatcaaacagatcatcgatccttggcaaagggtacttgttcttaatagtaacctcattgagtgcgcggtagtcgacacacatcctcttggttttgtctttcttttccacaaaaattaccggagcaccccaaggcgacgtgctcgggcgaatgtatcccttcggtagctgttcatcaacttgcttcttgacttctgccaactcgttggctcccattctgtacggcctcttatggatcggtgcagttcccggtgccaagtcaattcggaactcgatatccctttttggtggcattgtggtcagatcctccggaaaaacctctggatactctctgactatgggaatatcctccaacttcttagtggttttctccactgctacctcttgttcttcacctgtggcctggttcagactgatccctggcttctacggtactggagactagaaggttaccacttctcccttcgcactggtcaacttaatggtgcggctagcgcaatcaatcactcctctgtgccttgtcagccaatccattccaagtatgacatctaggtccttggattcgagaagaatgaggttggctggaaaaatcaccacttgaatttcaactgtcgctgatgggcagtagtgagttgtggtcatgccacctccaggagtatgaactcgcattggtatcttaagcttcactaaagataacccatgtgcaccagcaaaacgcttggaaatgaaggaatgagttacaccagaatcaaacaatattactgccggtgtcgagttgacgggaaatgtgcccaatataacctctggtgctcactgcgcctcctctacagatgcatgattgacacgggcctgaatgaacttgagtccggcatgtcttggcttcgggcacgtaccaaccatgtgtccgggctcgttacaattgaagcagagttcgggcctttctccaaactccttgggctgttctggctgggctggcagagctggctgaactgattgagctggaatcattagtggacttggagtcggattgaggctgtgctgctcactgttgctgtgactgccactgttgttgataccgttgaaatttcccaggtggtaaggacgatgctgccggataatcatggtggaaggtccaccctaatgtcccatcatgaagcgaggcttctgactgatcccctgggaagtactgagctgagctgccttcctcttacggttcattttgttgcactgctcctcttgacggatagccttgtccaccagcttctcaaagtcctcataatccttggagatcagctggttggtcaattcatcatcaagaccaaacaaaaacttctcctgcctctcggcatcagtgcgcacgtcctcaggagcgtagcgcgcgaggcggttgaactcatgcagatactctataactgttctggttccttgttgcagagaacggaactctctcttcttttgtgctatgattccctcgggaacctgtgccttattaaaactctgacaaaactctgaccaagtaacttccgtcctagctggacgggtcaccatgtagttgtcccaccaaacagaagcgggaccttgcagctggtgtgtagcaaaagcaaccttctcctgatcgttgcattgcaaaagattcaacttcttctcaatcgcatggagccaatcgttggcctcgattgggttggtggtgcttgagaaagtgggtggcttgatacggagaaactctagcagtttggactgggatggtggaagaccaaaccgcaggttctgctgctgctgctgctgtgcttgttgctgcacctgttgcaacacctgatggtaccgttgctacatctgttgcatcatcattgtcatcatctgagtctgattgtccaacacctgagtgatcgttgggttctcatgcggtggagatgaattgtcgttagatgtatcgctggcacgtgctaaactgatatgctcttcactgccactgacgttggtgaagtcacgagaaccattccttgtcttcaccatctaaagggggataggtagaaatatgagaaatggaggaaaaacagggggcttagaaactaatctttcttataaattaaagtgcaattatctttatcttcattaaaacactgaaaaggaagcaaacaacttctaattgaggcagccataccactgacatatgatatcgaccgccgactaacccataagcaacaaacctaagcacggaaactagcaagcaaacaaaactaagaagacgataaagctaagggcggcgactctgaagctcggagcagtgcttgcgatcgagggataggactgatatctaaagtaggcaagggataggaatcaatgcatgctcaaatccaaattaaacaaagcaacaaaagactcaaaagaataaccaagcatgatgatttttatgcatagaacatttttcatgaacccagatatagacactaatgcaactgactaaacaataaattaatgcataaaatagatgcatagttaaaatgatgcgcataaaattgccccatcaaacatagacacgacttagtgcatatcacccaatagattcccgactgactatcgaataaactccaaataaaatttcactaaaaccctagactgtccctagtcgagaaatccaattaaagtagcgattaaaatatctcccaaaaatcacagaactaacaccaaaggaataagttcacaccacacggtgacattggaaaataaatgcacagttgaaataaatagagaatttaaatatatgatcaatatgctcaaaggattgtgtttgggatctgcgtgacttggcttgcaataatcggtcttcaattaatcttcttgaacacttccgacgcactcacgaaccttcgcaacgacagaaacgacaagctaacacgcaaaatgatgaaaaaaactaataaaaaccaaataaacagtacataaaagtaaacaaacatgtagatcatgattttagatgaatttagagatttaaacggcctcattccgagttcatatgaattagttatgaattttacaagattaaactgattttagccttatacagaaaaggattatcgatgtcatgacgacatcactgccggcgatggagagagatggctagcgcggggagaggcggctagggcacgggaactcgagctaggggatggaaacgaaagaggagggcttggaggttctatttataggcaaagctggaggaagatcggctcggacccgagaggatttggcggcggattagttaaggttcgccggtttgggataaagtttatccggccgatttgaactcgaatcaaagggataaaatccaattccttaggagaaaagcaagaggaagataggtggaatatttcccctcaactaattggacatggggtcgctcaggtgcgatggacatgcggaaaatggcgccggatcgggaagaacaggggctctggatggctggctggaggttgaagatgccactgtagcgacagggaggacaaacagacttccggctgggcttcttcttgatggccggattgaaggaaggatagaaactggacttcgggaaagagagggagatgggctgaggatgacagatagacttttccagtttcagcccgaaaaggaaaaggggaattttaattaattttccaattaaattaatcactaaaatgatctttgaattgttaaaaatacttccaatgctcaaataatttcaagaaaaatcctgaaaatacttggacactcaaagtacttaacaatattataatcagaccatttaatgattaatttaatatgtggataattactaaaaggttctttgtattattaaaattaagaattgagctccgaaaaatcaaaaaaaaaaatccagagagtataattaactatggcgaatttaataaaaattaaatccagccatactttatatttaggaaattttatttcccacatttaactttacttgtaaattaatgaacatttaatataaattctaataataatttattaaataatttataaatcctaaaacgaaaatcaagatatgacattggacacaggagcaagaagcttgaattctttctcaacttgaggccattgcttcttgtctgtaatgttagggatggttgatgcatatgctgcttgaaatctgagcacagagaaagccttatcaacatatttctccatatttggttgcctcacggttgtgattactgccaatgcatgttggcaaggtttctcagtaacttgccattccctgcaggtgcaagtgcacttgtcaaggtgcaccacatgccttgttagctcctcatcattatgtatctctgtaacctcagcttggtaaggatcacccttagtgacctttagatggcctaacccctttgaggctgcattcaactggtgaatcaccacaggaagaatcactccattgagggctgtagagatcctactcttctaaaaaagaatcaaggttttctccctaattgcatcagcaagagcatcgattggcaagtccttcaaacctttgatccaagcattccatgactctgccatgttattgttgatatattcacacttgctctgacatgaaaacttgtttctagcccacagtaggttgtgatgttcgtcaagccatggcttgacatctgagctatattcaaacacttcatccatccacatttgatgcttctgaagcatgtatgtcctagctgcaggccacatctttttcccatactagtagcatgtccgtggtaacgctacggtaatatttatattaagcaaccaaaagacaatatataaaatgagattaattttaagaaataaaaaaatgccagatcaagagaagtataacaccagcgttcaaatccaagttctctttgctactcttatatacataatgaaaattttcatctcgcagcagtcatggttccttggcgacgcggattgactaaataataagaaaatggatgcacaaagactaaatgaatcctttccaagatcaggtgttggcttatctgaaactgaaatcatgtaaccaagagatgtgaactggaattgtcttctgtatgccattattaaaaaaagaaaagaaaattgttgatgtccagctaaacacatatattgccaacagctgctgaacatccatgaaagctttttcctcagactttgtgtaatatcagtatcacaaagaaaaagatgcatggggttgtagtgttatatggaaaaatacagcatcaaatctattgtagctagatcagccaccctcctacatgaaaatacacttttatattcgcatggatgacttgtacatatttgaaaggttatctaacctgcggagatatttcaggacagtaaagtatagcatttgtagataaacattccatgtattgtgagattagtgtttcagttatctaatgaaatcagagagattcaaacaaaagacctgccaccggtagttgcaaacagatgtaaaaggattatccgtaaaagaaaaggtaggcaagtagtaattacagtcactttatgatattcaaatctacccagaaatctgtaatgacagaactatttcctaaaaatgatcagtaggctgcatctgtacactttgtaagtcaatctcaaattgtcctgagcaatttatacttgttagacaaatggttcatgaggaattgaggcaccaacagcagatgaatcgcaaactcagcatagcaacagcagcagaggaagccaaacagttgtccatcccatgcagtggaatgaaatgcccacatgaacaacgtttccatgttaatctatttttgtatgtcctagtatgatcgatcactgttgtcattctttcaactcctaaccaacaaaaaaaaaatatagaactgtagctaacataaaagatcaggtgatagagaaaataaaagacttccgctctctgcatatatgttacattgtagcatacaccaaaacacaaatcagaaaattcttactaaacagtaagattttcttgtatgcttcacttttctagagtaaaatattagaagtacatcaacaaacatcactaatcccatgcagatttctgtttcaagtaacatggatattt

SEQ ID NO: 79349 - DNA, 2750 bp, Oryza sativa
tgtttttagattttctttttaatagactttgataattgggggtgttgtttaataattatttccagtgctctgaaaattcaagtaaaatttgagggctccttttagaccaaggagaatttaacaaaaaatctccgggccacatttgaatttttcttgcacgtattttagtgtttgccaatttctttccgaattttaattaattctattattccttttagaaaatgaattttatttcgggatgaatttatcaggacgtgacagcaaccgattattttaccaagtgggtagaggctattcctttaaagaaagttgattctggggatgctatacagttcgttcaagagcatataatctatcgatttggtatccctcaaactattacgactgatcaaggttcaatttttgtatccaatgaatttgttcagtttgtcgatagtatgggaattaaaatgttgaattcttcaccgtattatgcacaagttaatgggcaggccgaggcatctaataagagtttgatcaagttgattaagaggaagatttctgattatcctcggcaatggcatactcgactggctgaagcattgtggtcttatcggatgtcttgtcatggatcgatacaggttcctccttatgaacttgtttatggtcatgaggctgttttaccatgggaagttcggatcggctcgaggagaacagagttgcaaaatactttaacagccaatgagtattataaccttatggccgatgaaagggaagatctggttcaatcacggctacgagcccttgcaaaggttactagggataaggagcgagttgcccggcattataataagaaagtagtacctaaggacttttcggaaggtgaacttgtatggaagttgattctgccgattgggactcgggatagcaaattcggcaagtggtcgccgaattgggaaggaccgttccaaattcataaggtggtgtttaagggagcatacatgttgcaaggactagatggagaagtttatggccgagctctaaatggcaaatacttgaagaagtattatcccagtgtttgggttaatgcatgatcggctagtgttgccgatgcatgatagccgatgtgtttgcatcgccttgggatggtcgatattgttatatcgcccttagttgcttttcactattgtaatcggttgtggtttgccgatgtacgaatggccgatattgttatatcgcccttagtcatttctataattttgtcaatgttttcaacattgtaaaattacgggggcacatacatagaaaattgcaaatttttgcaaatttttgtgtcttagccgattacaacagtttcttacagactattacatggaaatcactgagacaagtatcgctggatagccgatatagccctttgcctaatctgatttatttcttcgatggcttgggcgtcttgagcatcggttccaggaatgactttcaaggatttagtcatctcagcaacgttcttgattgccgattttagccttgccttctgctcttcgacagcttgcaggagatcggctaacttcctgtgctctagatccagttcagcattgcattcttgaagttgtgccaagagttcaatcttgcgagcttcaagccgatcaatattggatttgatcaggccttcagataactgatcaagcttggctttctcttcatgaacaagctgtcgattggtttggattgtagcctcgatgtccttgtgttcccggagatcggctaacctctgcctggctttctccagtttgaattgatgctgctcgaggtagacagctggagtaagagcatcgactaattcgtccggaagagaggcttggatatctgcaaatcttgcccggatcgagccacagttggtcaccaggttatctagtgatgctcctagccgatgggagatgtcttcgagtgttttcttcacatcatcagacaggagagctgttgctttactggtggtgtcttcttctgtttcatcgaggtaatctttgatgtcaaaggagaatagatcggctaagacctgcaagagacaatatcatggatgattaaggatcaagatatgattggccgatctcaagtttatgttaataaaacttactggaatagtaggtgcagctaattgttcctcctcttcaacatgatgactacctgcagccgatggagtgcggccgcctgattctacctgcataagaggggaagaaggaggaggaggctgccaaagggataaatgttagatataatcagcccaagtcagttaatgagatgatagaagtatcttactggtggagctggtttaggggttggagtaaccgatttcttcctcacggcaattttctttctctatatttattaaaattgtgaggaatcggctataaagtaaatgactgcaaaagtggacagagaaagttgcttacccttgccaattgagctggagcagaagggaatggaggagcctgcttaggtgaagccgatggtgttttttcagtatcgcttatttcggctgcggcttggtcgatgtcttcctcgatttcttcttcatccagagcttgttcgatggatggatctagggcgggtagatcgtcagctggcttagctttctttgtcttagccttcttcttcggagccggggctgaagtatctgcagccgatgatctggttctccgcttcttgccggcatcggctggttctctgatgagtccttggagaagtgctgaggtctttggggcattgta

SEQ ID NO: 79350 - DNA, 1939 bp, Oryza sativa
caactcaagtctagatacctcaatttctgcaaactgaccaaagagtagctcatctcacctctgagtttgtctccatagaagctgagacagtcgtctgtgttcccacggagtctcagcttgatgacatggccggttctgttgctgcacctgacaccccaccagctgcaacaatcctcgccctgccatgatgcgaggcggctgttcgggtcgaaaaaggttgcctttatggcgagaagtgcggccctctcatcggcgatgcagctccggtccgacgacgtcgatgcagcaaaagggatggatgctgtggctggtgagaacaaggggaggagaaggcacagcaatgctatcttcagagtttcaggaggaggaaacctgggctcagccattctggttttcttctttttctgggggaatgaatggatgcaaatgtaatatgcaaaaatatatatttgctcatgaatgacacttcggatcatgttatatagtgactactgttagaagaaaatactgatcctcttttccttttttctttttggcagtagtattatgttatctctgtcattcgagtcatgatgaagtgtctggtccagttgatttgaatgtgatatttgcgtcctcttcatggaattcccctgcacccggtcatacggcaatgaaatcttactagtcaacaaaagcaacaagtttttgcttgcatttcgacctcacgcctggtattgtaagaactcagatgtgggtgatctgctgctcatttccagtgtgaaagtcagcaggagctactgatagtctgccctactgaagacggtgtgatttgtgcttgcaaattggggcatattttctgtggctgttcctggtcagacgccaagcacaacggctgtagatgggtttccacgcttttaccatgacttgccacatatgatgccatgtctgacagggagcagcaactgagtggcctgaaaggggattctagatcaaccaaagttgaattctgtgaaatcttgtctgttattttgtacacatgtttgatgttattttcctgctggatttaattttcttaccattcatttccaccacttatctatgtagacgagaaatataacaagagggtgcaaaagtttataccttaagtgaaacctacgtgtgtttccaatgtatatcataatatttcatctacaaaaaggtaaatcatatttcacataaaaaaggtacatcatttttaatcctgcttagctgctgcctgttatagcattttatccttaaaattatttcttcatcactgttgtcaaacctataaacaataataaaccgtttatgaaggcacaaaacttgcactgcagaaaacatctgctatggctggtttcctgaattcgataagcaacaaacatcatctgatattacacatggatacagatagaggaagattgatccaacaaaacaatcgcactgaacaaatctgacgatgccgattgtgacgacagttgcatcccccataagcacagttgaattttcatggagctcttcttccatccgtctctttacatcttccttctcttacttgggtttctgccactctcatcagaacttgattctgacttctgttgttgcattgcaggcattggtactctctcagcgtctcagtgataccaccaagaccgatggaggtgaagaaattgatccagaatcttgtgttcttcggatgatccattagaaagattgaatcaaaataatctttcattttaggatcgctcagtctcttattgagttggcgaattccaaggtgatctgataactcatggaacagtatttttatgaaaattcttgaagacgacgtggtatcctcctctgtcaaacggatgtaaaccaaaacatgccatggaagcgcgtcggtggccaacaaatgcgcgaaaaagttggcaacattccccagcttatttgtgtc

SEQ ID NO: 79351 - DNA, 620 bp, Oryza sativa
caagcctaaggaggatgcaaatgcttatttgcagcaattcctgttaagttgtagcacgtataccgtcaaaggactcagactccaactgttgtcgttctccctcctcgggagagcaaaatagtggttctacatcaccgtgcaacggtgaaaacccggaataagcactcaacggcattcctctcatgattcttcccgatgggcaagaccaacgctcttcatggaagaatatttggtttgcagcgaacgagggatgaaaccattcttgaagcttgggaaaggctgcaggaatgcgtcaccgcccgtcctcatcatgggatggacgagtggctcatcctgcagaatttcttcagcggattaacaacggattaacactctcgtcctgggatcaactggacgctgctgctggaggagcacccttctcaaagatggtcagagataccactgatctgattgagaagaggctctcaaatatgggttggagcgagaaacaacataaacccgtcaatgcggtatgcacaccgtcaatgagacggaaatgcttgccgcccagttggatctccttatgaagagactggacaacaatgagaaggacgccaagcggggtaccattaaggccctgg

SEQ ID NO: 79352 - DNA, 1098 bp, Oryza sativa
gcattaaccatgcatctgccggtgtgacttgctgagtactgtggttgtagtcattcttgctcaatcttttccccccttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgtcagccgccttcccctcctctcctcatgggccggccacccggcccaaccctagccgcgcccccgcccgtgcagcgcgcgtgcgcgcgctgacgccgccgcctgaccggtgggtcccacgcgccaggccgggcgtcgtccccttcctcccgcccggccgtcctctctccctctcccgtgaaccctagctcgcttcctcctctaaatccgctcgattcaagcatgggattcccaaattgattagggggaattaatcccctttccctcctctctctttcccccttaattcccccttgaatggcgcccccaatcgccgggaacggacgcgccaagtccggccgccttcctttgccgccggccgccattcccgtcgccgttccgtgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacattttctccaaagcttctcttactgaagaggggaaggattgagcaagaatgagtacaacaaaaagtactcagcaagccacaccggagatgcacaattaatgcaagggagtaccaggggataataacata

SEQ ID NO: 79353 - DNA, 2339 bp, Oryza sativa
ccggcgagcatacgcgcccgagccgcccgagtcgccgccggtgctgacgtcatcgctgacgttgtcgctgacgtcatcgggaccgtccgccgtgagccggtcgtggaccgatcgatctcgaccgtccgttttgcacagggttgatctcgaccgttcgttcccatgaacagataccgtgcacccggtccaccgcgaaaccctagctgctgacgcaataatcctccttttccttttcaagaataattcattattgcgtcatattcaattaaaatccatatagtgttttaatccgatttaatctttaaaaattcataactaattcatttgaactcagtttaatgtggttcaagttgcaaaaattatataaaataaagatctacatattaaaattgtccataaatagaattaaatttatttaattctttttaaatgggctttaattagatttaatcttgtaaaattcataataaattcttatgaagtcagaatgaggccgttcaagtctcataattcatctaaaattatgatctacatgtttgtttactttatatgtactgtttatttggtttttattagtctttttcttcgttttgcgtgttagcttgtcgtttccgtcgttgcgaaggttcgtgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttggattattataacttgacaagttgagctttatatattggttcagctagatattagatatgattgcttagccatgcttagaaacattagcacactattgggataacttatgactcattatttaatgatggcttaatgatagttcacgatggtcaatcgtgattggttaatttatcacttgccaactaagtcttgataatggtgggttgtgagcacatggttttgagagtcgtgctcatgacaattaaggaccggttcgcgaggctactattgtgaagcattaatcgtgccaaccacaagccagcgtgggcaacggcttgacctttcgtatagcatggttcattgcggggcaccagactgagaagtgacggagataagcccacgggggtcgctggggagtccatgccttatttataagggggtgattatgatccaggaatggtgcactgcggtggattgtgttatgcaaggggtaatgtcacagcccctttccgaggtaccgtggtggtactgaggcacatggtgacatgatgtggggctgtgtcttgtgggtacagtggtacacctctggccagagtaaactattcgaatagccgtgcccacggttatgggcgggttgagcaatgtttttcgtgattagtcccacacttctcacaataattatggatgttatatctggtaataatttgcttagctcctggattggagattagatctgtacagccgggtatggttgtttcagaatggttaggcctgagcagcatgggcgtgttgttcagtgttgattaaaatttctgattaattactccactgttttacttctcttaaatgttttgctaaatgctgcttttgcaaatgagcctatattatgccaacctttggtatctttgcgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagatttttttttttccgctgcagttttcttcatggtgaggactaagtgcctctttagtaagtatttatcgttttagatattttgatgaatctgtatattaaattgttagtttgtgtacctcggctgattcctggacgaggattttatgcacaaataagttcggaaattactagtgaattttcgggcgtgacaacttacgccatggagtaatcttaacaaaagataatctgattaaaaggaattggagaggaaacaagtctagttctttctgccacaaagatgaaactattaatcatttgttctttgattgttattttgcccgcgcggtttggtctttaattcagtttgcttcgaatattagttttatctaatagtacaactcatatgtattgggcattggataagaagacaatcacgcaatttgagatctttggtcttattaggtgc

SEQ ID NO: 79354 - DNA, 907 bp, Oryza sativa
ttttagggtttttctttttataaaacctttttaactttgtttatttcttaataattattatttgtgctctgaaaattccactaaaatttgagggctctttttagactaaggagaatttaacaaaaattctccgggtcacatttgaatttttcttgtacgtattttagtgtttgccaatttcttttcgaattttaattaattctattattccttttggaaaatgatttttaattcgggatgaatttatcaggacgtgacaaatccaccccccttacaagaatctcgtccccgagattcgaggaggctagcaagaagataggttgggtggtcttctcttcttgtttgacttcttccgctccgtcttcacaaactttcagcaaaacttcacgactcggaactgcttggcttgacctcctgttgcggatggaatcttctcttcacctgacttgaaccagggtgcaccttttagctgactcagactaggttgcggtagtttaatgatgcttccgttccagaacttctcatgattcatatcttcggagtcaacctcatacaagttacccacttcatgtcatgcgtcgagatcagctcgtcattactaggataccatgcttgtcatcatgagaatatcatgcttgtcatttacttctaacttaccactgaatgctttggactatgatatcacgcttatccagcataccatgtttgacaacttgtcactaactgcatcatattagctttcctgctctccgggtgctagctacttctgctattccatgcgagggtcgataactttgcctttgaattatgtttctcaaccgaaccaacttatcccacttgacatgctttgacgtcttcccaaacggctttactgctggacttcttattgtttgatcgttatcctgcc

SEQ ID NO: 79355 - DNA, 811 bp, Oryza sativa
tgctgctccagtgctctgtgctgcttccccttcctctctccccatacgtgatagcatgcgagtgtggcggcgtttgatcatggtggctgtcagcggcgagccggggcgcgacgtggtggctgtcggcggcggcagtagcgcatgggacgagtccctttctcactatccagatctgactaaagaatagaatgcgaaaatacaaaaatatcccccgcaaaaaatatagaaagacaatatacccttcacaatctattatattattaaagaaatagaaaaatgagcctctacgttcgctggggttttttataaattctcacattaattggagaaaaagaaaaagcagagtccatataaaaatacaatttagaaatagctgaaattcggaattaaaaaataaagaatattagaagaggagactagagttcatatagaaatataattagaaaataatagaaattcggaattaaaaataaggaatattagaagtagagtagagtccatatataaatacaattaagaaaaaaaatagaaattcggaattaaaaaaataaggaatattagaagtagagtataaagtccatactaaaattcggaataaacataataaaattaaaagtagtgcttagagtccgtataaaaatataatttacaaataactaaaattcgaaattaagaaaaacatgggaagaagagtttaaagtcaatataggaatacaatttagaagtaactgaaatttaaaattaagtttagagtccacgtagaaatacaattagaaataatgaaaatttagaaattaaaacaataaatatt

SEQ ID NO: 79356 - DNA, 1169 bp, Oryza sativa
ctccaagcatggcagcctcctcgacccctccgtagcctcggtggcctccatgacccgtccagatcgaggcgccaccgaggagagtgtaaaggtcgtgccaccactcgttattgttgctctaaactacgggcaccggcgaggagaggggagaagggatttggcgccggcgaggagagtagagaagggagatccgcgagccccgggttggatttggccacgccactactctgcctggtgccgtcgctgcttgggtcatcgctccccgtcgcggcgcggtggactgaggagagcacaagcaacaagcaaggcaacaagcaaccaagaagtcacacatggagaaaatatgaggaaaagtcacaaaagcttgctgcaagcaaccaagaagtcacacccacgtggagaatatcaggtactaccgcacagtagcgtgctacatattaccaacctaaaaaaaatacatcaaaaaagtcaaaaacaatatgaaaaaaaattcgagatgtgaaacactatgacatttgccatcacacaaaacatcaactcaaaatacaatgtgcacaatgagaaaaagaaacaattttgttctccaatagtatttaaacaaatcagttttctattccactgagatttgtcattttttctatgtgtatatgttgtattttgagctgatttttttacatgtcataggtggtgtttggatacagggactgatcctgtcatatcagatgtttgaatactaatttaaaagattaaatataaactaataataaaactaattgcataaataagagctaattcgtgagataatttttttaagcctaattaattcataattagcacatgtttactgtggtatcacatggactaatcatggataaattatgctcaatatattcgtctcgcgaattagttcaggttatggattgtgttttttcattaatctacattttctacttctaatgaatcaaacatccgacggtaactaaaatttagtcctcccatctaacagccttgcgcttgcacctctcaaaatttttctattctttttttttttgactttttcggtgtatttttcgataaggggactcatctctcaagtgcactgcttctcttcgtctcttcccccatctccggcgagccgtactggtccaactccggcgggcaacgacccc

SEQ ID NO: 79357 - DNA, 548 bp, Oryza sativa
ttaggttttatccacttggcttaacctacagtcgagatggctctgataccagcttgacgcgaccgggaaaattgccttttcccgaacgctagtgcattaatccccgtcccaggaaaagccggggtacaccaaacaaacatgatacaaaagacacatctttattatatcgataatatttacattattacaaaggcgcttaaggcctgacaatcaaaaataaacagcagcggactagcgggcctacagctccatcttcacaggcgctcaactggggtataagccaggactccacctaagacatcttctccaaagcttctcttactgaaggggggaaaagattgagcaagaatgagtacaaccacagtactcaacaagtcacaccggcagatgcatgattaatgcaggggggtcaaggggataataataggggttaggttttgcagtaacagcatttaaaagtcacttagttgcccaaagctattttataaagacgatcttagagcttcacaatattaataatcaaagccgtggaccacacgaaccttgct

SEQ ID NO: 79358 - DNA, 543 bp, Oryza sativa
atctatccgctctggtttgattcgatgcccaaattaccagtttccgaataggagtcgtaggaggagtaaattttaatttcttcctagtttccgactaggatgggggccatggtgcgatagatatgcgttatactccctccatttcctaatagatggcatcacaacaaaataaattataattacgtaaatttttttataagacgaatggtaaaacgtgtaacaaaaagttaacggtgtaaactatcactacaccagatcctcacacctctgacgggataactgtgataggcaaacgaaatggtcactgatgaccgtcacctttgacgggtcatacgggatgccgtcatcggtgagtcatccggctgcgacccgtcacaggtaactagtcacttgtgacgggtttacctgtgacggatcgcagccggacggcccgtcagaggtaaggtttactcacctcaaacggctttaagtcttagcccgtttgagatgacttctgccactatatatatatatatatatatctcctctcccagcggggcccat

SEQ ID NO: 79359 - DNA, 590 bp, Oryza sativa
gggcataactttttctcccagatcatacgatcaataatacactcggcggatcaatcccggacaggagtagggtattacttctcattgagaggccctgaacctgtataaatctcttgtcttcaaacccatccatttttcctgcttgatagccatcctttttattgccgaaatcttgtttcgacactcgtcatctacatacacagcctaatgctttgctgtaaagattgcaaaggtacaacatttgaagaaattaaagtccaattaagctagacattgccttttgcctccctgtaagaacgaaaacagcttgcttacgttaaaaccggccactaattcgggctagttgtcgtttgtgcgcttgaattgtaccatgagtccatgagcacggccatcactcatcaacatttgctttatctacgaataaagcaaggttaggagttgggaatgcatgggccggtcagcaaattaatttgggttatgacattatttaggcccattttgcaccaggcccactctatccttgccaactttatgttaagctcctagggcttgatcatacgtggtttaaatcatcaccgtgctgccaaaaa

SEQ ID NO: 79360 - DNA, 737 bp, Oryza sativa
cggtgtgttcgccgtgttgtcctctacgtgctggtgccctctgttggtgccgtggtgccgccgttcgccggtgagcgtgcgccgcccgagccgtctgcctcgccgagccgccgccgccgtcggtgacgtcattgctggcgtcatcaaggccgtccgccgtgaaccgccgtggacccgatcgatctcggccgtccgatttggatcggatcaatctcggccgtccgttcgtgtgaaccgccgcccgtgcgcccggtccaccaaaccctagcccgctgacgcaataatccctttttccttttcaaaaataattcattattgcgtcataattcaattttaatcgatttaagtgttttaatccgatttaatctttaaaaattcataactaattcatcttagctccgatttagttggttcaagtctctaaatttttctaaaattaagatctacacattaaaaatatccacatgtactgttcatgcttgtttatgtgctgttttggtgattttgcttctttttgcttagattccgtcgtttccggagagtccgttttcgcgaaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattacctt

SEQ ID NO: 79361 - DNA, 513 bp, Oryza sativa
gggacatctataggtataaatacaaggccccctagaagaagaggggacacaaccaacagacacggacaacatagacgccacaaagccacaagccaatacaagcctacataggccaagacaagctgctagatatcgacatcagagataagcctaggaaaacccgatatggacctacgggaaccaaagagaggaatctagcgctatctctgatctcgctggatgcggatttgaggaggaaggctaccctgttgtcgactacgagtcagatcttcaggccgccacgtcgacaacagttagataggctaccccaaatattgtactggtgtgattatgatgaataagatcaacgaccggcttcggccaacaggatgtagggttattacctgataattcaggggcccgaacctgtataaaaatcctcgtctctatctcttttacctcagtctcacgtatatcttagtaccaacaatcctcatactatgcaaataccggaatcgcgacatcaaatgtcga

SEQ ID NO: 79362 - DNA, 506 bp, Oryza sativa
ccgcgcttttatcgtgaggtatgcactttaggtatctcctgagtgagcctaagcacatcgaaattagtagacacacaaacccagaccttgatagggaagtaggcatctgttcttttgtcattgtagaggtgttgggcgaaagttgtttttccaattcctccagggccaactatgggcaaaaccgatagtgttccactcggaatattgcagttagtcaagtcatgaagagtttgtctaaagattatttccctcccaaacaatttatcctgcgtaatcgttgagctagtgggaggccgctccagggatgtatacaacattctcctcgcagtttggttaatttggagcaatctagatatacacgtacacaagtcatgtatgccctttaccactgacttgattttattggacatgtctactcgattgaatggcaagttgccaacctggtcaatgacgtcaccatgggagttggctgtatcttgcgagtcgtcggcatcatgtcgtgctcg

SEQ ID NO: 79363 - DNA, 699 bp, Oryza sativa
tgcacccccagcaattgtttcagttatattctgaactcagaacatgacatcacagactgatattcaaggagctaaatctaattacaactgatattccaggtttcacaaggcctgttcttcaggtgcattgctatctagaatcagagtttatacgcgaaacaaagagatgtacaccatgttttttatccaatgcaggtttctggagccccaaattaggggctgagcagcatgtacaatgttgattgattactgtcaagctaccaaggacacaaatttctctgcaactccacccaaaaatacagtttcaagatcatttcccgtcagctaaggcacctaaaattctctctcaagctagacgcaatgacgcattgttcgccggagggcatctcggtcgacggcagcgcctggttgttcttccccacccagttatgccgagagcattagcgtccaagtcagctgggggaggaggtggcggcgctggagctggaggtgggcttacctcaacttcctcaacagcgatagccacgcttcttgctcggcgcctccccctggactgcgatccgtttcgacctccccgcttcgatggcgttgaccttccaagggtgtgaagatcctctgacacctcgtgcttcgacagcgaagcgaggtttggtagaatgtccttctggaaatctttcttctggggacgctttcgtgctc

SEQ ID NO: 79364 - DNA, 929 bp, Oryza sativa
agccgcgtgcacccggtccaccgtggaccgtgagaaaaccgagtgggccccactcccgtggacccggtccgcgtgcccctcccctcggctgacgcaataaatccaattttagattaaaatttaaatgaagaaattcgcaaatattcatttaagagcatataaacttcaaatggctataacttggccatttgaactcggaattggaccgttcaagtctctaatttttccttaagaagtcaagaacccatttatgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcatcgctttatttaaattcccgcgttatcactgttttatttagccatgcctatttacctttgttatgaccttattattattgttattgttattattaccttgttcaccctaggataaacaaaacccccaactagtggacactctactcgtggtatcactagtatgattttaggtagatgcttcgctgattaattaggtaacattaggtggttttaaaactctagattgtggtaatattcatatcacttggacacattggatttgttggattgttgtggaattggattcataccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaa

SEQ ID NO: 79365 - DNA, 1021 bp, Oryza sativa
gtatttggtaaaagtacttcggagaccatggcgaagatgattgaagcactcagctttggagtaatctagttcgagagaagattatcttttcgactgtgaaggtctcaggggctactgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagatatataggcagcatcgcatcctgagatcgcaagtggcaattcctctttggtgcgaaagaacaatggcatcgcattctgcaaaactgttcacagcacaaatggcagcctacctttctctctctatctatgtgctgtctggactgcaaaatatttttacaaagaaaaaatcagacaagaagagaacaaacgctgggcatcgcatgcagcagcggcctctcgtcgcgtaacacagggtccacgtaggctgtccaggaaagacgcgagatctatctccaaaatcggaataaagctaactcggattcttggcatttcaccctctcttttcttttcccttttttttcttccatggcaatatggcatcgccgcatcggccgtcaaatatcaatacgacgaaaggggaaagggctctcgaattcagctggagaagcaccaaacattgtgctgccggatatgccgtttccg

SEQ ID NO: 79366 - DNA, 1195 bp, Oryza sativa
atgcatggtttagagtcggtaactatttggtatttcagtgttgagttttattacacttgctccattgtgcattagctgtacctctatacctgttaccatcaaacttagttctgaaggaactaacatgattagctgatacttaactcacatgaaaataaatttctctctcattttcttggccatgtctgtcttagtcctttggactgacctgtgtaatctcaacaggtattttctccttgtggagagattgttgatttgcggataatgaaagatcagaatggcatttcaaaggtctgatactaatgcaacattttgtaagtttcaatatatactttcttattttcgtatattcatcattaacttttctgatatcctttcagggatatggctttgtgcgatttgcggagagggagtgtgcttatattgctaaaaggcaaataaatggttttgaggcaagaatatctaacttcttgttcgatgttatcatttttttcatattgcacataatatatacatatgtccaaaagctttcaaatcccttgttttaatagatttcttatagtagctaggaagtatttgatgccttgtcttttgcaagatttctttctctgaagctatgctggactaagacaacagaaactataaattgccgtgagaagctcttttaatgatctatgcaaaattgtaaacaaattgctcataactacaagttgcaccgctgagttcatctttatgtttggttaatgtctagttaaacctgattcatctttatgtctagtttcttcactgctgaattcactgattctttccttgttttcatcctgtttcggtgcctacagaaaccataattttgcctgtatggctagtttcttcatatctcaatgtagttacaagtgctccctattttgtctttccttgtactattttcctagatatcgtgttcaaagagagaggattgtttgctttctcatttattagggagcaaatgttttgaacagcattactattatgcttcattactgaagttaatgcatgtaatgttattggttctctgccagcttcaaggaaagagacttgctgttgatctttcgttggatcaagatacactcttctttgggaatctttgcaaaggtaaacttaacccatgatggactttttgtatcacaatgtagaaaatttgttacaaaaaacatga

SEQ ID NO: 79367 - DNA, 3095 bp, Oryza sativa
  unsure (1)..(3095): unsure at all n locations
attcctgcagccctaaaggaaatatttggatggactcaaaaggattgtaaaggaaatatgacaacatagtatatcaataggcctaaggagattagtagaattgttgatggcagcagcaagcaaacatagcaaatgtagaagaaaaaagtagatctgttgatggaatacgattagaggctaacaaatcaacactactctttgtgggtaggactgtgagactgagaccctagatgcttcatccaaatcatggcatatcaatggaagagaaccatttcgaactaaaggttgaagatcatctactaatcaagaagccaatttcaattagaaatatcccaagtaatccactggtttatgctattgctgtgttgcagcacatgatagaagcatgatgcgggaggttttagaacttgtgccaactgatcttaggtataaatcaaggagctagcagtgcacaaaatgatgatgagcaatcaagcttatagcatggcaatctgatactagcaaaatataggataggaaacaaaggatgttgatgatagtgcacaaaatggagttccaggacaacaagcagaggctcaaactgaagcctaaatgcaacagatccacttagatttggtgagaatgtagaagaaagcagaggagtttcctcagctgcttgaggatgaaatggatcaagatgacttgctgctgctgacacatgctgctgcaagtctgcaactagctcaatggctgctgcttcttaatgatttgctgcttgaagacgacgaaagcagggctgctgctgttggtttgcttgacgaatactgcgagtggtgatgaaaggacgagaccagtgattgaggcggcgaggctgcgacggccgacgacgacggtttgcccgccggcagaggatacggcggccgcgactagcggtgggatgaggtagtcaatgtctagacgatctgctgctggctgctgctactggctgctacttgaagatgaatgggacgatgacgagaagctaatgcatcttgacagagctgacggcttgatggtgtggctgcctgcggcggcgtccgccgccggcgcaccggggaggacgtcggattgaggctagggttaggatctctgctctgataccatgtcaaaatcagtgagtgaattggggatttaactatttattcattgagttggcccttagggctaatatgagatgaatacaacgtgaaaagacagaaataccccttaacacatacacactaatacatatatattcttaacagtgaaaacatgattgagtccttttgtttccatctttttttaaaagaacaatactgggaattacatggtcagctttacagtgctctttgatctataggcattagaagatgttgtttcggttgaccttgcaatggctcgaaaccatgactcttcagttgggaaaagacgtctaaatcgaggctttgcatttgtgcgattttcttctcatgcagtaagtcttattccttatttttgttaattccatcacccattggattctacgatggaaatgttgaccttatattattgatggttatacttaaacctcctttaatcattcattttctgtttgatttatctttttctttacatttaagtgcagtaattcagctttcctttgtcatattttgttgcgccaaacttagctatgcctttttatcattattttcttaattccaagtttacttatagtttaccaaacccttgccaattggtttatcttgcaggtattgaccaatatatagcctcttgtcttaaaacaatctttattggataaaaccatctgactgaaatatagggatatgtantaaagtagcttctttctcttctcctggattcctgatgaatgattctatccttttgtggtgtgccttaaatctatctgctacaaaagaagcgcattatcaagtaattgcatatctaagtaattttgtctcctttatgagatgaggggccagatgatggtgcattgtcacaatgttaccaacatatccttatcatctactgacaagaaaatcaatccatatcttttactcagtgttggttatgacgtaatggaatgcacttttatcatctgatcttttaaatgactgattggtgttgcaaagggcatcttctatggttagttttcatatggaaatggaaacattgcattgttgatttgtgtaaccatgaaaaagaaaacaaatagttttatacttctgaaggagtcgatcatattcaatatcccctagaatcaattgttgggcacacttgttaagaaaaagaagtatagactggtattatattgcttgccagattttctataattccatctcatgcatattctatctcacatccatccccaatcttcacaaggattctgtccgttactgaaattcatttacaaatcataggataaagctatggtgattattggtgagctttcatttttatgtgaatccataacctcccttattcaatagatggcccatagtgacaatttctatatctggtgaggcaatttcatgggattatagtttaacaagatgagcgaaagaatatctgtctgctctccttttctgatctgcaacattctgaagttttctgttagtaaagaaaatctcaatttatggggtcacagtcaccttggcaattttagtgacaccaagtttgttggctcctggtaccttaagttctgaactatccatttctagtggcctaactccaattcatgctactatagctatactactctttttttatcatatacgcttttctcattagcaatggtatgcaaaactacataacaattttctcctgataccagttctgtaggatttgtcatgtcacttttgtagaggaaggacttaggaatcttatgtttagcatatccagttgaagaggtggtttcaccaaaatccagtaaaactatttaacttcatgaaagtttttttattcttcattttgtccagagatcaaatactttgcctctaagatctgatcattatcttttgacagtatatataaagttcatgggatttgcatcccttgatgaatgtttttactgccttagttgctattgtatttatccagaa

SEQ ID NO: 79368 - DNA, 1928 bp, Oryza sativa
  unsure (1)..(1928): unsure at all n locations
gtgggaaccgtgtaagagaaagaatatttaggctctacattatgatttaaaggcaggggctgacccggccttggtcaaggcctatgctagcccattgcactttgggttaagattgaacttacatgatggaattttgtactacgtagtgagatttcaatccaaatcctagcattgacccgtggcctgggtctgcccctgtccaaaagtatgcatatgcacatgaaagcatcgaggtgatctcaattatatggaatatatatgcacgtacatgcatcactgcacatgcacatacctacgagtacatccttttaacatacaactggagagatgaaagcctgttgatacatccacaatctcagttaagtatccacacatgcataattatgaacatcagaatttagaccttgtgagtgaagtcatgcaccacatctaaggtttttctccattgtaatgattttctagtctggtttctagaatgaaatgccgttataactagcggcggcaatgcgagaaaatctaaaatttatcttgcgactagttaagctaatatgattgaaatgtactcgagctacaataattacaactagcggatattttcgtgtaattttttcgtagagcaagatttcaaaaagttgagttgtattttgagatacaactcttaggtccctcaaatatttggattgcaatcaaaatctataataatataatttgattttgattttgagattattctttgttggtcatatctctttttatgattgctcatacaaataaaattacgagtaaattttataaaactacagtactttgatcgaagtattataaaagtacagatttaaggcgtcgtattataaaactacatatttaacacaaaatttatcacaaaactatagatttaatactagagtatcacaaaactacatattttacagcttaaattcctaccactactgctatgttagagtgataaatgtgtagttttgtacttaacatgatgcaaaacatgaactgttgtgataattttattactaaatttatagtttggtgatcttccaccttaaatatgtagttctttgatgaattcggtcctaaatctgtagttttgtgatacacctttttaaatctatagttttataatagtttgtcaaagtatatgtagttttttgaaatttactcaaaaataccgaataaaatgttcttaccattagaacatttaaaatcccaaaaataatccaaaactcatcaagcgggcacatttgtacgtggtagaatttgggcttttggcccattttgtggttgcatcgaagcattgggccattcttttcgctgtcgttcaaaaggccacttaccacaattgggcccatccagaaacctcttggtcgcagccaccgcctanggttgcgctctctcttttatcccagcgccgncacgccacctttccttcttcctcctcgncgncgacgaactcccggccatctnncgcatggtcgcctcctccctcccttncttccgactcatcgctgttcatctcctcaacctaacaccccttttncgcgtgcgtgtggtgagttgtggtgcagggtcgagaaaagcagtgacccgatcggagatcaaggtgcagaaggggnccttttcgggtttccccccttccccaaaaanccaatttctcccagtncggcgagaagcggcgaccgcctaacccgcgcctccaaggtcaccaacccccctccccccaaaattctcccaaccctcctctcgccaacctccatttcaacccccctctctctccggttcttgcaggtgctggagcagctcagcgggcagaccccggtgttctccaagggtaggttaagctctccgccattgccgtctctctactctagtttactcttagcttcgttgtggtgatgacgagagtttgcgggggg

SEQ ID NO: 79369 - DNA, 7608 bp, Oryza sativa
tcctgcagcccggtagaaatatgatcttttctgattttttttatagttacgccctcttgatatttatcaattcagcatccatttcagatattactgaaagcaactataagtctgacaacaaaactaatctagattcaagaggctacaactgttcatcatacagcattatcatataaacacctactgctaatgttcctgaatttgagagaaaaaaatgttatcttttccttaataaatcattctaaaagctgtggtaacaaatccccaattttcattgggtgtaacagcaagcttatcttaataaatcattctaaactgtggtaacaaatccccaattttcattgggtataagagcaagcttacggtttgccgtgatggctgaagaaacaaggctgtctaatttcatcaagatttggagagagttacgataagttacaatttacatcgacagtaggccaagctaaggttgacttctccttaacagattgtcttgaaatatgatcactgatgacagcctgtaaaacataacttgtctagacatgcttatctaagcatagcaaacaatgaaatgactatgttaaagaagttttgaatgacacgagaatcttttcgacgcaagattatgtatttagtgacattagtttcatcatgaactgaaatttttgttaatttcatgcaggcacagaagcaggaagaactccctgagaatgtcctatgctgtgtaaggctgaacagagtcgatttcgtcgatcatgggcagataccgacgctcttgccttgcgacgacgactgacattttaaccggcatgctaatttaactggatctgatgcttcagtcaagagcagtaggccagtagcaggcgaccacaagttctgtcctgtgaaacttgatgaactcaccttggttttgggagggtgaacatggcatggttgcttcttcgctctggtccatgagatcaacggctctacttcagagttctgtaaaaaccagcgtacatagtcatgcatgttgtttggaaatctggtttgtggatgaattctatgggaaatttgttctgcaaatcaggaattggctggtaccaatcaatctattcattcaattcatctgttctcattccatatgtgatcatttacattcatgtttcgattttgtgtattgtggaagtttaatcctgtcaccaacattactttgtttggatgacaaaaaaaaaacagcaattttttaaacttacaattttcaacatctgataaaatctagtggggttaacaaaaccaggaaaccattaaaaacaaaaagcagcagttttctgatgatcataaactattgttgcagttttctaaaatgtctaattgagtttgtagttattattagttttgacagaatagttgcagttttctgaagttcaaaatctagtgagggtgttttcaacaaaactagaaagcctttgtcacaaaagaaaagtcaaaaggtccaataaaacagacaaaaccaggagcctaaaccagattatctcccatatcaacaacaacagcaacagcaacagtataatcagaaacaggtgccagagcagaaaatgcagcaattgctgtttccagcccataactaatgatggaagaagctaaggcagtgttgcaggtaaactgacagacagcagcattatgagtttgcaaactctatacaatcttttgctatacagaagtgctttggacagcatcattttcatcctggagttgtccatccattaatctttttatcttgttgaagttttttttagcacatcaagtgttactccagataattcagaaaaaattcagagatgctgacagcaacactgcaccaccagtttgtctcccctgatctgatggcatcatgctgctgcaagccatgtcctaacaaaagcttggctgcttgttcatcttcttccttgtgatgacaacaagtacacttgatgatgctcctcttgtgctctttgtgtttgtgtgtggtgtgtgatcatgccatgtctgtcttcctcattgctgctccttcttgctgcctgccaagaacaacaatgcatgagatcctgctccttttcggctactttataaacacacagtaattttatagaattttcttaggaagttcctctaaaattccattgaaatttctccgttccaaataggccccaaacaagtatagtacgattttcccgtgaacttttcatcagcatttcttagaaaattattttatttgttttcgaattttaatatttaattcatttgattgtgttctgaactcgcgaataattttcataaaatcagttccctccatcatatccatcggtcatggcatttcggtttcggatttaaagaggtcagcaatggcatgtgccatgttgtgtggtgtagaaatagatcctctacaatactgttctttgacgttgagtgactgacatgtgaaccctttactcagatggtccacatgtcaggaacttaagtcagagggcagggcagtactgcagaggagactcatcatccgtgtggtgtgtggatcacctttgcggaaccacgagtggcggccagctcgccggatctgctgctcgtggttctggaggagctcctcgatgcgccgcggctgcgacagcaacggcccggagaatcccaccctgtgcaacctcccgccgccgaccttgtgcttctgccaatggcgggaaaatcgtcagtgagatggccggtgaggaaggattacgacaatggtggaagtgatcggagggagacgagaccttgctgctcttgacctccttggtggcggcggcggcgccggcgccggcggtggccgtgggctccttgaaccggttgttgtaggattccgacgaggtgaacgcgtcggcgacctgcgcccactgcttcatcgcctcctgcttctccgcctcgtaggcgccgccattgctgttggttcttggcaccttggaggagctccgcttcgccgccgccgccgccgtcgtggtggagtctggtcgtggcatcttggcccaggcgaagccggtggaggcggtgagctgcaccggcccggagagcgggaggcggtcgccggcgtcgtcctggtagctccgggacatcggcggcggaggcggcggcggcgtcgggtcgtcgtggcgcttgctggcgatcaccggcacgggttgcatgtcgacgaacagcctcgcctcgccgccgttggcgcgggggagcgactcctcggcgtggacgtggccgtggccgtgcctctggctggcgacgacggcggccgcggtggcggcggcggtggtgtcctgcatgctcttgtgcccccgtgacagccgcttcgtcgcctcgccgccgccgacgccgccgtggttcctgccgccgacattgaccctccttctagaatcttctcgaagcttggcgtccatctccttgttgggcgcgtacttgggcaagctcgatggctcgcaggcgtacggctccgtcctgaaatactgagcaaatcgacacgaaaaagaaaattcagccacgaatgcccacggacgaacaccttggcggcatggtcacctacctcggaggcgagggcttcggtggcggtgccacgggcggagggctcgacggagaggagcttggagaggagcgcgaacgcgtcgtcgcccatcatgcccccgaacgtctccctgagccggctctcgtacggctgctgcggccggaacccggcgccgccgccgccgcccgccgccgcgcggcgccagtacgcgtcccccggcgagccgcagagcttgaagatcctgtggatctgctccacctccgtcctcccctgcaggatcggccgccgcgcgtgcatctcggcgaacacgcacccggcgctccacaggtcgacgctggcgtcgtacgccgtggcgcccagcagcagctccggtggccggtaccacagcgtcaccaccctgctcgtcatcgccgccgccgacgacgcgtcgaacacgttggcgagcccgaagtcggcgaccttgagctcgccgccgccgctcaccagcaggttcgcgcacttgatgtcgcggtgcatcacccccctcgcatggcagtgctcgagccccagcagcagctgccgcatgtagcacttgatctgcaccgtccacgtgtcggttagagcccacgtgtcgcgatctcagccgttgaatgtgttgggggggtcgtcgtctacctcgggaagggagaaggagagggaggggtcggaggagaggccggcgaggtcgtggtcggagtagtcgaagacgaggtagaggttgggggaggagcgggaggtgatgaggccgtcgagggagacgacgttggggtggcggtggaggcggcgaaggatgaggatctcgcgcgccatgaaccgcacgctctccggctcgccgctgtcgaaccgcaccttcttcagcgccaccatcctccccgtctccacgttccgcgccctgaacacgctgctgtacgtcccctgcccaatctggatcatggacgcgccgccattgccgccgccattgattgttagcttaattgagaaggagaggtgttcgacggtttgagttcttgcttgccttgtcgagcttctcgtagttggcggccttgagggggacccagccgtggacggcctcggcggcagcggcgctgagccacgacggccacccggcggcgacctgctccgcctcgacgtacctgtggatgttcccgagccgcacgccaccgccgacgacgacgacggacgaacactcaccacccccacgcgccgccgccttcttcttcccgtcgccatcatcctcgtacgcgtcgagccgcaccggccggctccaaatcgacgccacctccgccgccgccgcgcccgtcgacgcgctcctcgacacgctgtacgccgccgacgccgacgacgacgacgtcgtggtcgcctcgtacgccggcgacgccaccgccgcgcccttggacgccgcgcaccccatcgccgccgccgggaacacaggggaggagcaagaaacaggggattgcctcctctgtttcctcctcctccaccaccaccaccacctcctcctcttcttcttccaaagcaatggaaatgtaagctcgagctcctcctaaagatagctaagcttagctgcttctgcttcctttaattggcagaaaaatatatatgttttttttttactttttttttgttgttggcaaaatttgtccttccttttgctttaattcttgtgctggtattgagctagggattgggctggattagattagccaataaaagattagggaggagtgtagtgtaattatgggttatggcttaattgctctccctaatcaccttctaaagatagccaaaaaggttgttgatgtgctctggttaagtgcaatgcaactacctctacataagctgaacaggtgcaactgatccagcaatgatcaggctattttgacgtgttaatttttgggggttttttagttgttgttttgatgtaactttttttagaaatttgggagaaatttaaaatatgttttgaaaaagatttggataggagaatatactattgatgtgtgcattggtcaaagaatatttgtttttggagaaagtacatcagagggaattgatgtgcatgcaagtataggaacatggtgtccgggttttaggcgggaaaaatgttcatgtgattttattatggcgctagaggagtacaagtttgtactagccgttcatatttaaaatccctagccgccttgtgtgtgtgtctctctctctctcatttatccgtatatttgtgctgcattttgaatgctttgatttgtttatggataatgcatgggtttagcagcactgtttgcaatgatgttgttgatgcaaagatgagcagatgaacaatgatggtttgtttgggagaaacatggcaactactataaagttgccagttaattaggaacaagaaagtggtgattaagcactttaactggccttgtgtttttttttcttctcttttttacttttctcatgtctggagaaagggatatatgcccactatgttgcatgctaccccacaaatcaactgcatgagaaagggaaatgtgtgagagagggaatgtttgactattgtaatacctgtggatatttggtgaggggatttaagatagggattgttcattgtttgtccaatgcatagttaatttcagatccagttttgttggtagaatttgctgttttaatgactagcaaatctgtactcccttttattctcttgttctgtttgactctctgttttctaccatacctcctatttatttttgtaaggccacgggttcttttaactcctatttactcataatttcttcgacaactctaacatcgcttcacaaatattgactttaacaagagaaatactatcttcgtctcatgaagactttatttctagttacgaatttgataaatatttgcctagatgtagctctttttgggagggaggtagtaacaatgtgaaaggttgtatgatgttatagggcatgtgaaaatttttgaaattttgaggaatcaaatgcagcaaactccaatttggtgtgatttatgacctgcattgcatgcattgtgctttcatggttggttggctagccaatgcagcagcatgttcattctttctgtagaaaggaatttatgttggtgttgactataccaataaccatgctgtccctattctctgcctcttataaagacagtacaatataaatgggcccattgacatagagaggtgtgcaatggaccacaggatgaccccatggaaattcatcactttctttttgcatccaaggcaaaaaagaaaaaatatggccagagaagaggaaagaaaatactagcataacaaaagtctactcattatatgaagtggttggcagttcttttgaggaggtaagctgttgttgcctctttgctttttgtagtgtatcctatggctggattatattgtgtaaaatcaatctttcactacaattatatgtttcctaaaaaaattcttaaaaagtttattaccactgtaaagtttcatgatggaactccattgcatttatgagattttttttatgtaaagaaggacaaatggttactgcaattgtgttggaatagtgttttcactgttgcactaagcatttcatatttggctaaaattttctcttggtgggacctagttgcacgactgtaaaaacaaaaaagaacttgcctaaagaaaaaactcacaccaatgggcactagtctatgtgcatgcagatccatgggcaaatgcaaggagatagataggatcataagatgatcttttcctgctttttgccttgctttggcactcacatattccttgctacctttgatggaagatatgcttcatcaaccatcatgctgttctgatttctcttgcagcaaattgagctccctatcaataattagccattttaatatccatttgccaggttaaaacattgtactgtaccaagaatcggctagagatcaacagatatcatgtcatcagcatggctgatcagagaccaggtagaagcatctcaattgtttagactgtcactggtctctctggaaagtgttggtactggctgtcatagcacagg

SEQ ID NO: 79370 - DNA, 1191 bp, Oryza sativa
cacttcaagatctcctgagtgagttaaccacatcaaaatgagtagacacgcaaacccagacctttatagagaaatgtgcctctattgttttgtcattgtataggtattgggcgaaagttgtcttcccaattccaccaggaccaactataggaataactgatagtgttctactatgaatagtaaagttagtcatggcatcaagagtctgattaaagatgttttcccgcccatacaatttatcctgtgtaattgttgagctggtaggaggtcgcttcggtggtaatgcccttcctactgcaggatggataattttgagcaaattggatacaggtgtacatgaggcatgtatgccctctataaccaacttgattttattggacatgtctactcgattgaatgtcaacttgctaacatggtcaggaacatcactatgggacttgggtatatcatgtggatcatcggcgtcatctcgtgcagaggaacaacaaaaacatgaaagccagttaccggtggtatgatgaagagcatggcggccatggatgagcacttgaccacgaaggccatcgtctaccatgggagtggcctcatgggtgccgtcgatctggtcctggatgatgaagtactggagctcgtccaaaacatcctcagcctcgtcagcctgcttggtcaggatttctaggagcacccgtaggccatggttgtttctgacatctctctcttcggccgcgtcaagcagtccttgagtgtatgcaagatcggtcttgatttgctccatgttgaggccaagctctgtactggacacgtacgccgccaccatgccatcggacagctgtgtcaccacctttccgaggagccagctcgccgcaccgacggccacatccatggatggatctcctccgcctgcagatcgagaaagatggtgccagctgcagctggggttaattgggtttgagtgtttggtgctggacgtataagttgcagacttcagattggctctgagtccctgatgattctatttgtaccagtaaccaggcttgattgcttggatgaaacaaactactcatgtttgatgtctgcctcatgacgtcatggcattcgtcacatggctatatgttgattctgtgccaaaatcttcttgttcaatactgtccattgcctccaccaatcttttgtggttggtaaggacatgga

SEQ ID NO: 79371 - DNA, 669 bp, Oryza sativa
tcgcagctatgtgcattcactcgatagtttgatccagcatttcaatatctcaccagtgcttctaagctactctcatgaatgagtatgctagacgactaggcgcgtgagcatttagaaggttatggtgcacaccgtacctcttgcagagcaagaagtatcagcaagaatgggtattttcaactatgattgactaagaaaatgaccaagagagtacggtattcggtgcgccgaacttgcaccaggtaccatggacactctcaatgattctacccgagcgtcacaaaagtcgtactcaagcatcactagtgcacatttataggtgacttatgatggttgtatggtggttaaacactcacaatacacattgggagcgaaccaggaatccacgcgtggatggccaacttccatggcgaggatgttggcagcggcgctggatccgacaacaggctcggtgcccctccccgcctcacgcagatcagaggagaccgatgtcgccgttggtgaacctgaagacccagccggtggtgattcacgcgtgttcggcgtcgcctccctcagcccagcatcatgtactcattcacccaggaccgtgcctcccctcctagtcccgtgcctcgcccagcccgctgcacacggggatcaccgaacaggcgagtcgtcaaacggggg

SEQ ID NO: 79372 - DNA, 3609 bp, Oryza sativa
  unsure (1)..(3609): unsure at all n locations
catccgattcaactcgggggaatttgggccatccatgtggcctcccggtgccacctcactatgcccgcccaaagtaatagctcaagtaggctcaaatatgtgctaaatgaatagcaaatgctcaaatcagataatgtaaagttgaaaaatcattcaaagtcagtaccatgttggtcctaggctagaaaatactatacgcgcaagcctagatacaaacggtaccacaagatagcacttgtaggagatgacaataacaagcacacgatagcggcgatgacagtgttagtgaccctatcaaatgtaaaattgacagcgatccacttgtaggagattattaggtagttgtgagggcaataaggttaaaaaagagacgacggagacattctcaaagaatataagcatttctaacaatgaatctggacatatctatatcaagattcatagctagaagttgttatattttggaacgaaggtagtaaacacaaccattacttcatttgaaacgaaaataatctatatagcacatacaagggaaacattacggattaacaattgtcaaccttcctaatataggagaacagctgtattttgttaatcatatgtgtcggacatatatcgcatcagttagtatggctgttgtcggcatttagctttcttttgaacccttgacactaatgaactagagatccaagacttgttcatctgagcaatttcaccagagcgccaacaacacagacgaccatcttcgccacctgtccatccaaaaatgcccctgttttgcccagtatgagtgtttgcggctggatatacggttctaacaacgtctgtatggcctccttcaaggatagcttccgcggaactattgccccttcaagaccagctcttacagggaagtaacctattgtccctgcagttgtgccgccaatcacccataacttgtcgtcgggcagagagtagtgacaatcaacaaaatagtccacctacaaaatatagtaaacagaattagacgttgagaataaattgtctaggtaatttgcctccctggactgctatattgcattgccaaccacgctaattaaacaatgaagcatcatgggcagccacatcgtgtagtttcacattgtggcagcaatccctctgtttcgccacatcaaccaatctagagagcaggaaaagctgagttgacgtttagactaagtaggtggacagcaatggaggcgtagtgagcatagttgaaaaaaccggaccggtggatgacccggtgaacacctcggttcaccggtccagcggtcgaaccgacgggttggacggttgaaccgcggtttaataaggtcatctagtttatatgttttgaacttttgatacttgcacataagggcacgtggtgggatggtcagcgcagccggcttacaacctggtgaccaaaggtcgaatctcctccgtgagcgatttggcattttttcaaaaaaaacaaaaaatcgtcttggtaggctgaagaactaaatgggccttcgtgtggcccatttacactctcgcatgtcttagcccggttcaaccgatagcagtttattgtccgtttcacctcaaaaccagccggttcaagcggtccaaaccggttcgattacatggccggtctttctattgaaccgaaccgagctaacctctggtttcggttatttccggttcaaacgctaggccggtccggtttttcactatggtagtgaggtcccgtaaacgggaatgtaacacttgcaacaacagtgacaaggcatctagaggagatagtcagttcagtaagctgtgaaaaataaagatcaagcaaattttgggttcatatgagaaaatgacaagagggtgcaacataaaatgatgcatgaggatattggattggctccatgattggagagaataggtttctgtagccagcaagaatggtgactggaatggagagttccctatagtgtctccacagtggaactgtgcaaggagtaaagaaagacggtcacgcactctatataccctaaacaagtgcattggagattatgtcaatgtcctaagcaacaagtaaaaaagaatagagggagtatatctaaaatttggctagttctggagttagttgatgaagacgattacagatataaggtgctacaatatcattcatttcgtgaagttctgtaatctttttgtaccatgagccaaatgaagaaagcaatgaactaatgaggtgtgattgtttgaatatcataactctctaatattaatataaaaaaaactgtcaattaccaaataccacactacatgccaacaaatgctgagtagctagaatgtataaaggcaaatattagaaactcacatggtcaaggttccacctatcagttgccaaggaacgagcatcatctatattcagttctctactcccatcattccagtcccaggtactgtgagaattcaacagcaaaaatcacaattagacttttgtccttatttatttattagaagcttggaatataagtcagatgacatggcattgtcaaaccagagaaagcaaaccgaataaactaccttaatgtttcaatgtggctcaagcaccaaatcttctggtatgtgttgccaaaaaatcccacttttgcaacacaagtctccacattcataacctatggaagatcatatatcagagaactatcacccaaaattgacatcttcatacaaataacctcatgcanaaccattaaaattaaaaaaaaaatacttcaaaagggaaatattgtaataccacaattaaatactactaacaaccaaaaaaagaatatgcaaaactacaactgcatccataacatacaataattgtaagctctattgtataagaattaacaaacaactatggagattaacagtagcattgttataagaatctgtgaggaataaaattgtaagctctatcatgtacttcacgaacaaataacagcatattacacacatgcccagttattgaagttacaaaaagggaaaaaaacatcatgcgcatttatcatcgtcatatgaaacaacaaaggaacataacttgaagtactaatgggatacttcagtaaacaacaaacatcaaagtatcaaaccataacctgacatagcaagatatgtaagacaaggcatttgggcacaggaaaccaactaaacatacagatagcaaatgattgtcctcgttcatgtcaccatcagtgtcaaaaacacatattaatccatcaactgctgcagaaatgagtttgctatgctgatgtggtgcaaattttacctgtccaaaaaaggtgacaacataaaaatttataatcacccagaatacagaaatagtatgagaggaacagtagcaaatacaagatattttcacaataaaatgcattcaagtgattcagtaagcacattatcaaaatgtttagagtagtgatgaaagtagttgtctcctgtgatataaaaatagttgtctccatgaagagtagaaaacatacaaaaccatccaagcatcactttgtaaaatataatggtgcatatttgatatctagtccatcaatctaaatgctgataatgcatggtacggagacagcagatcattagatc

SEQ ID NO: 79373 - DNA, 1296 bp, Oryza sativa
gctatttttttcgtaaaaaaagaatgcatctttttcctgtttcactggttaaaagttccattcaagttctgagcataatacactgaagatcttcagaagggagaaaaataaattagttcttcagaaatagatagccagattgttattataacgcaagaagcatcacatggatgtgcaaccaacatctatctaaagactgcaatctaggatacagaatgaatttatcttcatattccggaaagcaggtttgttaattaatctctttggaatttctgtggcttgtagcttcctgaaatctgaagaaaataaattcggttttactaccaccatgggtgcctgcgtgtcttcaagcaaaaaacggagatcacagaaattgtgctgtatataccggcgttaccgcggaaaagttttgagcaatgcacctatagtacgcgccagtgatgcagggagccgtgctgctcctggagaagttgttcatgtggaggctaaatctgatggctcgaatgtaacatttcatctcacacagttgcagtggcatcatagtgagctagactcagaaaatggaaatggtaattggaatttttcttgttacttgcattttttttttgtctcggttatctgagttaaatcctgaatttttgccctactggtctagttgtgtgtcaagaagaagcgggttcaactctctcagtattttaggatctgattctgatgaagatttcagcagtgttaatggaggtttgtattacctttcaaccaatgtgatctgcactgtacatgtgaattgatgcagtatattcaggcttggtcttttcttgcagacctccctgcaatgtcaaattcagcgggtacacaattaatgcactgtgaagatgcttcaagcattgctgatgcaatccagaagtttgagaggatttttgatggttcatgtgttgctcaagccattggacaatacctgaaaagagacgcgaacaaaatggatagaccaaaccaagcagatattcaagaatcggagaagcctaaaattccaagcccagaatcatgtgatgtatctgatgtgaaggttgatgaaacaaagactagaaatgagggtataaaaattctgacaaaactcagaagaggcgaggatgcatgtaatacgttgaaatcttcgaaagaaggagacaaggctcatgaaagtatcttcaaaagtttgacaccagtgtgcacgcctcgccatgctaataaggttcagcctttggccgtagcaagtcctcggggccaaaagaagaaatcaggagttgtcaggctctcttt

SEQ ID NO: 79374 - DNA, 2915 bp, Oryza sativa
aacaatggcagggatatgcaagataattggggatagctgtgctcaacatcgacatcttcgtcgagacacgaggagggatcaacatgaccattataaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatatttatgttcccatgtattatgctgacattttgttcaacaaactgcaatgtttaaaacaagataccagagctgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctgaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaataaaatagaggagcgtgaattgagatcttctttaaatactttgggttatgttcagtttgatgatttttgtgagctcgataatttcaaggagaaattatttgctaagtctgatttgccatatccaaccaatgttatatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgcctagttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacactgctgatttcaaacggccaccgaatctgcatacgacctccgttttcggcccgggagtacttgatggaaagctctcggagccctctttctaacggatccagcctcttctctgaattctatctcgtgtggccagaatcacaggaacaaggtgttgcatcacctataatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatatggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcttggttcatcaaattctgcatggggaagacaatatacacaacatgatagctttacacaatccatcaatacaagaaacaatagaatgaaggaagagtgacctccatggttgcacggctacgcattctccatattgtgtgctaatcagccgttcggaagagacgtccgtaagaacgggtggatagttcggaaagaacgtggaaatggtggcaaagaatgtggaaatggtggcttgggctggcaacaagagcttcggttgctgctggcgcaacttatatgatgattgtaactaatcacgattagcgtgatcttgccatgccgtcaaaagcgaaaaaagaacaaaaaattcgttgcctggttgtttctggcgttggaccgtaacagtcagatgttatgtttctggcattggaccgtaacagtcagatgttatatgggccgattaggcccatagcttgtttccttggctatttctggcgttggaccgtaacagtcagatattatatttctggggaataagttcatctgaggtcccttgactttacaccaaatccgattttcgtccctcgatcggaaaaccagacacaacgggtccctcaactatcacaaccgatgcagatcaggtccctcggcggttttaagggcggttttggctaatgtggcgcatacgtggctaatttgactcagtcttcgttcgacatggcattgacgcgg

SEQ ID NO: 79375 - DNA, 1842 bp, Oryza sativa
acggcggcgcttgcgctagggtttcgggcggcggcggcggcgcgaggaggaagacaggcctgacagacgggccccacctgtcagcggctgagagagaagagtggcggctcggcggactgggccggactgggccgaggagggagagagatagagagagggagggttttgggccggctttcggcccaaagccaaaaaaaaaaaacctttttcaatttaaattattcatgaaatgcaattccatttattaaaaacacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaataattcctttaaacaacaatttataatttaaggattttaaacaagaaaagcacttaacaattataattagatcattattgtcacgaccggaaataacccaacgggcgttccttacgtgcgtgtattattccttgtcctaggaggcaaggtacaccaaaagttgatacaattcagagtttaacaagcgaaagcgtaaatagttatttattacatgggcagcgacggcccagcacactcaaagacaacgaaaaacagcggaagactaaggcgacgaccacaggcgcttgacggcaggcacgagctagacaccaaagccttcatcctccaggggctcctcttctgggtttgggaaaaattgaacaagactgagtacaaccaccgtactcaacaagacacacccacaagtgcagcataattgcaaaggagtacaatggagttataatataggggttagggttttgcaataaacagcatttaaaagacccttagttgctcaaagctaaatttaaaacacgatcctagaactatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacaggcggaagacgtgacatagtttccaacccatcctagccatagacaagagtaccgacccaatcccgcctacggccggaacccccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttaaaaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgaatattcccaaagtctaaaattataaaaccacctaatgttgtcctattaatcagcgaagcatctacctaaattcatactagtggaaccatgaatagagtacccactagttggggttttgtttatc

SEQ ID NO: 79376 - DNA, 785 bp, Oryza sativa
ctgcagccctgatgcaaaatgatgtaacctttcctaagaaaccttcccaaccatgcaaaaatgtcatatgaagggggtagtatgctagtagtggtctactactactagaactctagattctagaagggggagagggactgagggactgaggaagtgaggaattgctcactggagaggcggactggtggagagccgaagaaggagtggccggtagagcactagcgctgggctcttgggcggctgccggctgggcgcgtgctgccaccgacgcacgtcgggcaggaccgcgggagccaggaggccgccggctggtcgcgccgacgcgggacagagagagtgtggccaggcggggcgcgccggcgaggggcggagagggcgcggccgcacgggctccgacgcggcacgaaaaggcagtaggaggagcggcgctgtgagtcgcggcctcgcgggagcgccggccaccggattcacgggctcgcgggagcgccgtggcctgtcgggagtgggaggccaggagagtaagtggagaggggagataagagagttagagttttcttttgttgggccaggctttcttatgggccaagaaaaataaatacctgttcttatctgggccaaattatagggtagtcctgggcctacctagactactctttggtcccgccacttgaaagccggtggtggcggtggcgtagcacggcaacgacaggagccgcggtggctcgtggttggaggacgccggtgggcggcggagctcaagccggcgtgggaagaacgggagagcg

SEQ ID NO: 79377 - DNA, 3049 bp, Oryza sativa
tgtgggtgtgtcttgttgagtacggtggttgtactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgatttgtatcaacttttgctgtaccttgcctcctgggacaaggattaatgcacgcacgtaaggaatgcccgttgggttatttccggtcgtgacacaccatcacctgggacgagttttcatctgtattcaagagatcccatgttcccgcaggaatgatcacactgagaaaacgagagttccgctacctgaagcaagaagatttgaccgtcacagagtacctgcacgagttccatcgtttggctcactatgcaccagaagatgtggaaaatgatgaagacaaacaagagaagtatctccaggggttaaaagatgagatcacagtgcaactactcctagaggaatatgaagattttgagaaacttgtggacaaagccatacaactcgaaagtgagcataatcggatgaagaactgtaagagaaggattgtcagcatcccagtattcccatgtggtaaccaaagacagcgcacggagccacttcagatcaccggatcttctgttgcgcatcaagagtttccgccccaagaagatggacacaatgcagacaacaacattagcaatactaatgatgatgataccaccaacaaccatgcttcttgccccattagtgaccactcaaatcaagcgtgcaatgtcaacatcattcaccaaggtgtcgacgatagtatcaatgatggcacccaaaatgacaaccctagcaattgtgactctgagaaagactccaatggtgatagcaactatggtaccactgatgccaatgttagcaaggatttccaaccaccaattccaactccaagtcagaatgatcgtccccagacggatagctcagcaaagaagacgttgatttgctacaattgcaaaggaccagggcattactcgagggactgcctgcaaccaaggcaaagtcgatctccacattaccgccaatttacacgaagcagacatcccaatcgtattgtggtcactggagcaaacgccgtacccgtgaggcctcgtgttaatcagaacccatagcagaaacaatgtgccgatgctaagcaccttttcttttaggcagtgcttagtattcatgtaatgagggagaaatgtgtaatacagacaagttctatgagggttcttttggaagatgtggatatgtgattatgtgtataattgcttactgataaaggagacctagggtctcatttcagacgaactatgttctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaagcagttaagaagatccaggagacatcaatatttgagaacatagtagtcgatggttggtaattaatctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttttgacgaaccacatcaaggtttcactgaaaggcagcaagccaaaggatctcatcgtccccagaagcgtccgcaatccacattaaagaataccacctgttagaggtaagccgaaagatgattgataaaagagattggcaaagatgttctctagcatgaaagaagtaggccgaaaggtgattgataaacagaaacatgctctgcatcgctcacggaagacccctgattgtaattgccccgcaacagtcaccttgtcattaagtaagcaagatgacctaggtaaaagtgtttctaggaaggcaaatagtgaaatgtgcaactcggtatcagatgctacacggagtgaaaagtgcaagcaccggttaccaggcaatgccatttcttgggagatgatccaatgggaaagaacacatcaaggttaaaggtgtaaaggaatacgttgaatactaactgaggacaacctgaagatgataatgggaagtaaactgaatgtaaagaaagtgaatccgagttgcttgttcgtgagagctattcccagttatgaatcaagtgatatgttcgaagataatctacagaggtcagattaaaatcacatctaacaacgaagcctcagatttgacaggataatgattagacaataacaaatccagcagtaaagccatttgggaagacgtcaaagcatatcaagtgggataagttggttctcttgggaagcataattcaaaggcaaagttatcgacccttgcatcaaatagcagaagtagctatcacccggagaccaggaaagctaatatgaggcagttggtggcgagttagaagtaaatgacaagcatggtattctcatgatgacaagcatggtatcttagtaatgacgagctgatctcgacgcatgacatgaagcgggtaacttgtatgaggttgacgccaaagatatgaatgataagaagttctagaaccgaagccccatcctcaaccaccgcagcctagtctgggtcagttagaagttcaaccagggacaagtcgggtgaagagaagattccatctgcaacaggagatcgagccaagcgttccagagtggagaagtcctgttaggcaagttggttatagaagacggagcggaagaagtcagacaagaagagaagactgcccaacctatcttcatgctagcctgctcgaatctcggggaccagat

SEQ ID NO: 79378 - DNA, 3663 bp, Oryza sativa
aaacccaaacgatacacagatttgaaccatgttttaacagaatgaacacggtctcaaggtttgtaccggattcaaacaagatggacaaaaaaatgaacatgactaatctgtgattctgtggttggagagagagccggtttctcacttcagcagtatgttccatttctgagggtagtgtgatctctgaatttttaagcgtttgttcaacagctcaaaatctcgctacaatcctaacgaaggtaagaaaactaaccccagaacactaacctttcgccgagaacccactcggcttaagcaagaaccctaatcagagcctcctcctccactaccactccccccatcccgagcatataatcacatcctaacgcccccctaaccatcgcttacacgcgcacgcatccatcccaaatcatccaagaaaaccctagcaagcagatcgcaccatccatcgaaaagaatccgattctttcttcctccaaaacgtaaataaaacaagaaaaacgcaaaccgtagaaccgagagatctcacctttgcaccggaagaatcgaatcgcgggggctcaagaaccgctctctcgcattgccgcgctcgattcgagagccttcgcaacgcgctcctctcctctcctctctctctctctctctctcgccttcctttcccctcctccgcttcgatgctgcgggaagaaggcgaaagttgcagatgctgtaattaaattaattgattaattaatcgattaattaaggtggagtaattaagaagctgtgctgattaaatgggattaggggggttaattacgcccgggtgtgggggcctcggatgtccgatgccacgtcaccagagacacatcgcgaccgttggtgtgggagtggacgggctggattggattggatggggacgcgcgttcgctttttgggtgggggtgggattagtttatttgttgcctgattcgggtggcccacctgcagtgggacaagggctgagactgtgagtgggaccttctttctgtagcggcgaagagaacaggatgggcatcttccatttcgacagtgactaagccattttttctttttttaaaaaaaaaaacaacacgcacaaaacagtgtgacatttcgtatgatagagcagaaagttaagccaaaattttcactcaagttacaaattttacgctagtttataaccctagcaatagttgttttgtactccctccgtcctaaaatataataagttttagagttggacacggttattaagaaaataggtacgggtgaatggtgaagggttgtgattggttggaaagagaatgctgatggagaagttgttatattttgggacaaatccttaaggataaaagttgttatattttgggatggttgagtataaaatttcagcgatttcgggtttggtttaaaacgcaccaccaggacgtgtcaaaataactgtcaaggtaagcatgtggctgtgtaccacacggtttaacggctagtggaccattgttaacagcgaaatctggcgagatatatatatactcggatttggagttagatattgaagaaggagattgaatcttgtccatgttttcggtcaacaaccatgtatttcgactaaatataatggtgagggggatattttttaaccgtgcccctaaaactcgctcctgtcaccgagtgctactaaggcattacaaactactaagctaaaccgccattcgcaaaattacataataacgtaatgtcgttttgatcaactcagattcttcagatgacaataaagtaacacatgatattcactaacaaggtttagttgtaacctacacttctagggttttgattacaagcactcctttctaatcaacattacaccagccgctagcgactacagttccatagccacaccgccatgctccccttgtatgcatgtgtcgtattaattgttatcaccatggttacatttatcccttagagtttgtcagttataagcctattgtttaactctcccatgccgctgttaccacatcaattactattaaaatatattcaacgcctattctaacaacgtatatacttgcgatttgtgactatcttgatcggggagttttatactcatattcaaattagaggatatgaaaactaaactttttcctaacacacaaaagtttttgtgtgtcggaatatgtattagacggtagcaagataaaaatatgacgtgcaaactatatatgtgcaggttaaactacaaaatggaaatccaagtgattttaacctctcacaatctttctaatctaatactaagaacttggttcttacctacttcgaaaataagttactgccacccaatagtagtttttaccccatttcaatggccatcccacctgctaatctttcatagataacaaaaaccaatgagaagatatatatagttttctttttcctaaatatgaatattaaattagactatataaaaagaataccatatcaaatcaaatgggtgaacattaaatctgattcttccaaagtataactcacaatctttagcagtaatcagttacaattgaaaagaagaaattcaagataagatctacagaaattaaaccccatgataataaaaaaaatccccacaattccactcccccttccaatcggacggacaccattgcccagcatcaccaccgccttatgatccaacggccgagaaaattcacagccgatggagagaaaataataataataaaaaaactagccgttgctgctccctcctccgctggcgccgccattttttacgttactcttcttctcctctataaattttggttcgattcgtctcggcgaatttcgaatcgaattttcactcgcgaaatcaaaactgaattccgcgttgctcgctcgttcgaaggattttcgattcgattcgatcgtgttcgaaggttttggttggtgagatgatgactacgccggtgatgatgaggagggccagggcgaggcggccgttcgccgtgttggcggcggcggcgccgccgccgccgtcggcggggaggaatcgggagaacgtcgagggcgaggcgatgtcgttctcgcagtgcgttcgtcggttcgggaagccggcggccaagaagggctcggcgaggacgccaagacgtgcgactccggtggcggcggcggcggcggcggcgtacgacgcgccgcgggcgccgctgtgggaccgatcggaggagcgggagaggatcagggccaggctgtcgtctcccgacgacggtggcgaggaggaggaggggtcgtcggggaagaagaggacgaggacgaggacgaggacgaggacgaggaggagcgtggcgctgcgggaggccatggcggggctcccggagcacggcgacggccgcgtgaggtacctggtcgacacgttcgagaggctcctctcgctctccagcgacccgggggagcagagcaggaggaggaggaagaagaagacgccggtggcgaggaagacgggctcctcgtggccgccgccgccgactccgactccgacgacgacgagagcggacgagatcgacgtgtcgtacccctccatcgcctcctcctccgaggtctccttccccatcaacggtgtcgtgctcaggttcttggcttctttgctgataattttcttccccagctgcacccatttct

SEQ ID NO: 79379 - DNA, 1731 bp, Oryza sativa
  unsure (1)..(1731): unsure at all n locations
ttaattgattaaatgaactntgtgatgttaaattagatgttgagctccaaaaattcacagaaaaatcaagagagtatattagggcatagagaatattataaaatatttctggccaatgatttttaaaggaaacttttaatttcctcaataattcacttgattaaattgctttaacttttatttaattgtagaaaatgatttattaattgatttttaatcccgaacgaaaatcggagcgttacattagccaccgccgctgccaccacgggcgctgccgcggctgtctcaggccacatccgtagctgtctcagccgccgccgctgtcacccatcaccagccgcgtggtcggccaccattgtctccgcgacggcggcagggtgcagggagttaggaggtgcaatggaggtggaggaggcagaaagccatggatgaacggtgcggcgagctggtgaccctaacgtggagagcggcgcaagtggcagcactgatgatgtaagagcatttcgaagaaagggctaaacaggttcctaaaaattaatttttgggattttggttaaaactaggtctgttaatcacggttctaaattttatcccctcctataaaatcgataccaatctcatcagaatttgggaaatttgggaagcagaacgccgtcctaatcgcaggaatcacgccaattgttttactgtcggcgccaaaagttttttttccgtccgcttccttttcctcgtcgcgccgttttttttcgagaaattttttttccgcccgcttcctttcccttctcgcgcctttctcctctggcngtttctttttcgcgagaacacaagcgccaacgccgccacncngcaaggatagggtttgggggctcctagcgcangctctgtncgagcgcccgtccgtcaagggctctgccggccgtccgtccagggctccgccgnccgcctatccgggggaccgccggcctgccagccgtccgtccaggggcagcgccgccggccgcccgtccagggcaccaccacttcgccatcgaccgtccatccaggtcaccccgacgacgacgtgtgctgctactgctgattcactttgaggtattttcagagaaactcatttctacctgtgctcgtatggtttatacgcactgtacaagtgcttgtgcctgtcaccaatcgttgctgctcgctgccgttgcctggttgcttatgccgccggcgctgacagaggaacagctctgcgtgcgtctgcagcactgtgtccttcgcaaggttgtctggatcgggatattaggtagtaatgttttgctccaagtattatcgtatcgtaatattggaatactatgagattttctttttttaagtttaattaatattcatattaattacatatatattatgcaaatatagacatttatcatgagaaaccacgttggtttgatatatttaactgatttctatatatacttgagcatattcatttacattatttccaaaccatcttattttaaataatattttgtagtaacgtagggatcgtagaatcgggataccacttaagatttcgtaggatcgtgtagtaatgaatagtaggatcgagatactatgaaaattaggatactaggtgggatcggtatcgtttcggcttggtaggatcgtagtatcataagatactagaatacgaatcaggatactgacaaccggacttcgttcgatatcatatcgctgcgccttatatag

SEQ ID NO: 79380 - DNA, 2776 bp, Oryza sativa
ccgagaggctgacgcgtgggccccactcccgtggacccggtccgcgcgccctctccctcggctgacgcaataaacccgattttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttatcaaattattttgatttaaattactgcattattgctttatttaaattcccgcgttatcactgttttatttagccatgcctatttacctttgttaatacattattattgttattgttattattaccttgttcaccctaggaaaataaaaaccccaactagtgggtactctattcctggttccactagtatgaatttaggtagatgcttcgctgattaattaggcaacattaggtggttttatgactttagactttgggaattctcatatcatttggacactatggaattgtttgattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatccttcccctcttcagtaagagaagctttggagaagatgtcttagggggagtcctggcttataccccagttgagcgcctgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactccgttcttccttcttcggatttcaactagtactagatggtcaggtcagtgaagaagaagacatcgtcagttgttcgccgaagctccggaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgtctaggttgtttgcttaatcaacttgcagatagtgcctaacatacatcataacagcaaaagtacttatatctgttaaggtcctatccttagtttctaatctgtctctcccctttgttttccctctctccctctccaaacctttgcaacagatggctgacaatgagaaaggcaataaggtcagaagtcaggacattggtacctcaagctctcgagtgaatgaagcaccagacaccagttgtgtgacagtggtccaacacctgattaaccagaacaaattgcttatagagatactacagcagcatcagacgccaattgctgaacctgagtcagatacaacctcaagtgcagttgcaggcagtccaagcactcacaccacgagtcagc

SEQ ID NO: 79381 - DNA, 1192 bp, Oryza sativa
tcctccgtgacgtggacaccgtcgcttatcgccgcctcatcacacgagccgtctgcgccattgcggccgacgatctgtccgcgccccccccgccccggtacactccgggcaactccgggcattcgcaggccagggtttgtcctgctgctctcctactctcgatcttgccttacttatgtgctgcttagggtgtgtacatttctcgtcttctattggttatctgaggctgccctttttttttgcctgcatggtgtttgactcacagctcgttcgggagatgatgaagtcgatcgttgcggatcagtctcatggaaccaagaacgtcctctgcaatggtttgcacgaggtaaagttaaaaagtgtataccatgagttgacacttcttattgcatccattatccgtcattctacctgtggtggtggcccttttcatacaaaatgggttactgggattcccgcagactgagatcccgttgaagtgctgccatgccagtatacatggtatggttgttactagtgaaagaataattttcagttaaaacactgtaaaattatcctaacttaatttgttggatatccttgtctccttggtgttggtggtgtgaggcatctctacgagcatgttcaatcttgttggtcaaaaggggtcatttctggcaatgagtgaaaaatgatgagataataaacaaagttcacacttaaactaccaattttattacctgaaccagccatttatagaatcagatcattagatgtggtagttagtaactagccagtaagcattgaaataaaccaattattccattgaaatactgataaactaccatttatttggctcaacgacaactatttggaaaaataggatgtttggattctgttggggctattaacaatgtcgtttaagatgtgctaaagttagctaatattgaataaaggtaaggacgtagggttttgtgaatacttggtcttcggtgccaatgacattggcgcctatcccccttcacataagtggcttagcttccacggggaggctaggggtacggtgccaatgtcattggcgccctcatgttggaccataacaccaatgacgttagccccacaagaaaggtccattcccggaataaatttttctggggtctatttgtaaagtaagttttcaaaaaggaccaaaaagtgaattacaggcttataa

SEQ ID NO: 79382 - DNA, 15469 bp, Oryza sativa
cattgccctttgctcattttaattggttaaaattatttccaaggctctgaaaattccactaaaaatcctgttagcatattttgacatgtagaatccaagaaaaattccacatgtcgattccgattattatttgcatttgttaattagggattcatctctaggttaaattaaacaatttcttcggacgatttattttatgaatttagaacaagggaggggaaccttagggcgtgacactaggtttcctcgttccctgcgcggtatcctcgactgccgtcgtggtgtggggttgaggggagaggaggcagcaacagcgataaagcagcaatagaagctagtgacgggggagagcaaggggaggccaaggccgatggtgggggaactgtagttcgcacacaactcttcccaccgccatggtcatctacgaagctctgtcacggccccctgctcaaaggcaagtggcaacaacagtgatggcactggtgcgtgagtgtagccatggcgaagccaacagcagagggagctcagcagccatgcgagagctgggcttccactggtgcgtgcactacgcggtcaccggtggcgcatggtggcaaagtcaatgccactccaatgtacatgagacggaaggagaccctaggagcgacaatgccggtgtcgacgtgtagaggggctcccccacaagattcagatggtggtggcagtcaatcaatcagcatgccctcttcccactcccagattgtagctgcaaacaagatcaagaacaaaattacaacacaaaatcgaagatcaagaacgaaattacaacacataatcgaaaatgtagacgacctaaaccctaggatttcggttcttttaaggggtccgaaaaaaatggctgctggtcaaatattttagtcaacagggtcaaaatcagtcaaaattcctaatcctccctaggtggtgcgctgctcgctggagtcctcaacagcggctggaacgacgaaagagcgaactcatcgaagaaatcgatggcagacacaacatcttgtctcgcttcaccaacacggcacgtagcagcggagcgggcaatccctgcatcgatgtggcccacggaggttgagcgagtactcaagcaacatcgacaaccacagtctcaggagacgtcgacgacaactgttcttcgttggcatcatgggcgacgacagctcaagttgcaggtgtattgtgttctaggcagttatcctcgttgtgaatcatgcatgcctcttctgttttgtcgccgaagtagctagaaacgacgaatgtcttgccgaatttcctcatttttgttatttttttcaatattttgttcgaaatttccaaaatttcgttgaccccttcccctcagcgaggttacctcgccccaatgccaccgagagaagatgaatcaattcttggtgaaatccgagagtgagtttttgatttttgttcttgattggattaggggattggttgcatttgttcttgattttaattttgtttttgctcatggtgtatgtcatataggttgatgaccaggttaatattttcacgcaggagtcaggtcaattgaaacagccatccactatttgccactctcttagttcctatttggatggttagtccctcccatccaaacaaccccttagatatgacaaatataacttactgttaagtaagggtaaatagtacatgtgcagtctcaaaaggtatgctaggcacaataaacaaattagtagtactagtacgttttcttttatctttttaatcctgacaggaactggttgatcactcaaagtataagtatatatatttactttcggatagctggtattccttggttgtctcggaaaaagagaaatcctctatatttgtggataaactaatggagcaaagtcccctatatttctagatagagggagtacatcttataaatatatgagagctcaactatcattgacacatgcatggtaaatatttgacaaataattaaatacccctccaaagctgatgagtgacttaattctaccctataattcaacaaatggttttactcattcatcattcatcatatcatatatccaatggtccaaaatcaattgatgaagtcgatcggacggctccgatcgataacaaatgacgcccctccctccctccccaccagtattgcgcaagacgcgtccccaccccgctcgcggcgcagatcgcgcaactccccttcaaaaaaaaaaaaaaactgcaaaatctcaatgaatctttcgccgtctccgaggcttgcacaactcttcttcctcatcttccgcggcggcggcggcggcgccggcgacggccatggcggcggtggcggcggcggagcaaagcgcggagcagttcaggggccaggcgaagctcctgttcctccccgtcgccgacgctgtcccccgcctttcctccttccgtccacctgccaccgacgccgccacccctggcagtgactcctcctacccgacgccgacgtcgattcccccgccgccaacgtcactgccatcgacacctactcctgtggcagtgtggaggactgttgcttccgttgataatgcatccccgccatcgcgcctcagatcggggacaccgacggccctcatgccgaccgcgccgctgcgcctccagatcgacgctgccgacgcccatcacacgcaccaccaggtaatcgtcgtgccgcgccgcatcccgcccctccgccgtcgtcgcatcccgcgaccccggcggctactccgctgcaacccctgtgcggcaggcgaccccgatggctcctctcgtcaccaccaccgctgtcttctcccattgtataggtatccaaactgagattgcttgatccagtgattgctagagtgttgattgatgaatggcattttgtttggatgtgtgtattgctgtaattgtgtgctgatgatttcatagggtagattatgaataatgtcgatttatgttggtataacacaaatttttgacttctgaccttgggtaggaacagtaccctgtggatgccattcatcatatttacaactgtctttgaatatgccacgtcttttcttgcatacaaaatcttatagagagttttgtagtgctcaatttttcacttcttttatgtttgtgagaataaatagtttagaggattatgggtcggaattatattattttttatttgtttctctgtttgccactgtaccacctatgcatgattaagtacttatctaatctgttaatgtacagtcaaaatgatgtgtagcgtttatgtaataatcgagtccatatacaggagatcaatatatatttctcggttttggcgatgtatagatagatcctatatttcttggcagcaatcatctgtttgtcttgccttcttcctcacactccacatgtaaatgtcttgattttagtgtgctaggtgctcaatgaaattcccatgtgaacaaatttctgtttttgtctatcaggctatgtgttcatcaaagagaacaaagggaagttagaaattagaaatagtacagttcctatatctagcaggtgtgatcttcatttattatttcattctttgatctctattgtaaagggttgcatcgccacatttgcataaagcgaaatgtgcactgcagtatgtagttaagtgcttttgagcaatttattattatttaggctttactttgaatgccaacaaacctacagctgtatcatggctgatatcaccaacaaattactgctgccaaactacaggagaacaatagatgataagctgttccaaagaaaggttagctagcaagtcaattacatgattaacaatacttattactgatttgcagattaattgatacataggttgtcattatttctttgctgtgtatggaaacagaggaatgcccatacgctccggccatctctactatatctgggatccccatcgcgctcctccattcgtctccacagcttctcgcccctcccaacccaatctctaatcatctgaatgcgcgagggtggaagccaagttggagaaacgggaaagggaggacgatgacagggaagttgtcgttccatgtcgacgagtgacaagctgaccgatgcattccgccagctcggcaaggctttcaatccctaggtaccgcaccgaccatcaatcgctactacatctggtctgggggaattttttctccagtactcgagtatttctttagctttgattctagcaagcacatgcggttgaccggttcgaaagaaggatcccatgtgggtttatgtggcataggaaggcagtcaatatgctgttctgaatatgtttgagatgggattccatcatctctccattttgatacacttttcggcctcttaaatcagggttagactcaataaatacaatgtgttaattatctaccgtgtaatttgaaggtaacaagactaattcacttcttcatacactgatacaattccttttttaccaaacatggtaaacttgttagctcctgatgatatagaaaaatatatagttagtctattgtattttctcatactaggaggtataatagatcaacaagtttaccttaatgatgaaattttccatgtttttgcttcatattattcagtagatgtttaacaactaaatttcattagaaattatgatgtctgaattttggactaatattaggttcctggaggtattatgagaggtttcttcctaatggtgttgtcttcgagaagacatttttcctatgctggatttgagcaacaaccaaagaagttcgtaagtccaaagattcgtttgctaaacattgaacaagaactgaaatatgaaaaagaaaatgcagaaatcaggtatgctagcagaatccaagcactatcagtgttacctttatgtgtagtcatatttaaatgcaccctcggttcttcccctatttctaactgtattcttattttatctaggttgtctgatcctctacaatgccaataaatctttgatgctgaatggaatatgatttatgacaaagttggataaatgtgtgaaaaagtggggcaaaaacagtcctttctcggttggcaattggtggtcttgcaacataggtatgcatccagttgcaactcattcttttatccagtattttttgcagatgacgatattttcgtgctgtttgtattactcttcagacatcaatgaataatggcattgatgaggtaaccatgtttgttttcatgtttttaggttatagattgaactgagtcgtaagtatggtgttgatagctattttggcaacaaataagctcaactatagtgatcctttctgttgaaaaggaacttgttttttttgcgaattttttgaggtaaggcaagtgggcaatgaatggttcaaatattcagtggttgtcctggtcaaacagcaagcatagtcctttgtgacagtggtttgttgttacagagatttgcacttgtccttttgaatgctggagctgcagtctgcaccttcttaaggtgatagctctatgccctggtttcttgagatgtaagaaaatttgttctatagccgtcagttattattgcactgaattgcatttattggagacccacctgattaaagactgtgatgagcaacacacatctttttttcggtcttgtatgattggtcagatgctaattgaagctttgtttttttttcatgagacataattgaagatttgttgtgctgctgcatgtctacaaaacatagaatataaatttataaatgggacgagcaaaatgcctatgctttgctatgggtagaagaaaatattctaatttgtcatagcaaaattttttaatcaaatatgttagtatcacttgattatattagttcatgcttttactccaaatagtagtacattatcttagtattttacattttaatattaattgtataagtttctaaaaaacaccaaactcggttggtatagccgtataggtgactcaaagcaacttaaattgagaattcaatctttatccatgtataaaagaaacaatgtgtcctataaagtataacacacttggtttgtatttctatcctgtcgtaaaaagagacataagttctagctactactccctccgtcccaaaatgtagctatttctagcacagtgtctcgtcccaaaatgaaactatttcttcacctacctcctcctctcaaccaatcacaaccattcttcttcacctactttctcttttcaaccaatcacacacttcctccaatcattctcacatactttcttaatacccgtgccaacctcaaaaatggcttcattttgggacagaggaagtatttttgtttaatcatgaaatagaacctttctgagggccaagcaagccaaatgggactgcaccagtggtaagatgaaagtttttccttattcacatcaactatctgatttgcatttatttttgttcatagagattaaatttgttccaagagagtgcaaaatctgtcatgtagcatttatcgttcgacaacatataagttggatccgaatagatgatttagatcttttctttcactactctgctttggagcaaataaatatttttcgtcatcttgttttgtttgtgctatgacgaagtgtattatcttcttgattttcttacttgcagtgtcctattgttgttaagggcgacaacactcttgcatggatgatggttcaatggaaaaattaggaattgcagcaccgacaaaagttcacctattgcactggtgcaattttgtaattaagatattgtcccatgatgaaatgcatgtttgtactgtgtgacgattttaaattaaatgtattaccatgttaatagtaatgtagtattaagggttgattaattatttttgtttgaaaagtttagcctaggtttggtaaattgaaatttaccatgttactatgacatgtatgagaatttacagattattttttgggccaaatatattacaatatatatcattgtttggtttttcagattttgacattagtttgctaaaatatgtatcttttagcatttggttgtttactttgcattactaaaagattaacaatacgccgttgtgttagcacgggtatattactagtttacactagttttcgaagttaagggtgcatcttatattcatatccagtcctatggttgtcggatgtggtagtgaactttttcctaaggggtgcgcaacatgttgtcgaatttttttcggatttagattttttttttaatatttacagaaataatctatcgaccaaaaaaaattgcagaaatagcccctgccgcccacctctggggcggcaagctgacgtggcaaacgggggaggaacgggcagtgacggagggagggttttttttgcaggaaaacccttgccgccctttggtggggcggcaaggggcccgaatgcaaaaaagccagtcagggccggctattttgcaggcggccccttgccgccctctggccgggcggcaggcctcgctgcctataaaaggcctgctgcccagcccctagccctcattcttctctcctcaattccagtgaaaaaaaaagaagagaggggaggagaagagaagaaggggcgaagccctcccggattcagacgccgatttcaggtaatattcatagatcctatatgtgactattgagttaaatagtgtgtattctttaaaaatttgtttgaataaatgcattatatttttagggttttagttgtagtaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgagagaccggctaagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgagggaccaagtgctgaagtaaacgagacttctgtgaaggaggtcaacgcacgagaggacgggggcgtagtagctctagtgggcattcaaccaggtggagtggctgacgagggggagactgtcggtgccattgtggatgaaatggagagggaggattctgacaacgagcatgtagaggaaggtgattcgtcagatgatgagacggatattaatctagcagaatgggctagtgaggatttttttgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattagacagtgtcagttgttaccaagcatacatgttttctacctggtgttcagaaataccacaggaacattacatgtgcatttgttgcatctgagatgtatgcgcatgtcatcaataatcttacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatacaagatggtattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctagcattctgcgagcgataggagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggaactctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgtgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacgtcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagtttttatgttctatgtcggcatgtggatttgcttgtaattcgtttcgaacttatcgatgtgtttatgtttcgtcgtgtaatgtcatacttcggcatgtcatgtctttaggtctcgtgatgtaacgtcggactaaggcgcctaacgtctttaggtatgctgatgtatgtcggacttcgacatgtaatgttatgttatattattgaactctacatatatgttaaattgcacgtcatcgttatgtaccattagtaacgtttgctatatttaaatagcctgtactcttgttgtacataattaatctcatgattttattactatttcataatttttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgttttactataagttagttgcattgtaacattttttataatgacatattaatttgttattgcaggctacgtgaggccggcctcttaccgatgtgtcggctggtggaggctgcggccggcgacgcggacccggccagacgatggactgtggacaggtccctcgtagcagctttggtcgatagatggaggccagagacgcacacttttcacttgccgtgcggtgaggtagcccctaccctacaggacgtatcgtacttgttggggctaccgctcgcgggagacgctgttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcgtacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgattggccgccctgaggtggaccagcacgtgtacgaggagtcactgtacgaggagcgaccagaggtcgactaacctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgatgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttccgcgtgatgcggcagttcggcttccgtcagccctttccagtaccgtttccgaccaccgtcccagctactgttcaccggtaagatcttgcactacgcttttcgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtactagccacgcacccgtactagggtcaccttcgctcccttggagcagcagccccacgttgcgagcactagagacctctacgccaggcaccgcgaccaggacttcgctcgtgttgtgagtaccctgcatcgcaccattcctttatgttttcatgtctttttcttcatcaaattttacgaatatttatgaacaaattaaccatgcaggtcgacgacatcaaccgggtcgtcgttgacggttcaacgacgatccaacgtttagacgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccacacggaggtaagtatttttattactacttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttccacaatcaatttacatacattttatgtcttagcttacaagggtcccgttgtcgatgtgtaggtttcgcccagtttgctatgacgcaggccgcccacttctcctaggctgcagggtcagcgtcacaggcagccggcacgtcgagtcagggtccaccactggaccatgctgggacctcgtcggaccccttcctgtcttccaccgtgctcttcgacatcactgacttcgacttcgcttcaggctcgacagaggacgtcatcggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcggcgtgaggcagggccagtagagcagtcttctttttgtttacttgcttcactttccaatactgtatgcttgtgtaatgactacgttgttgttatatgtgcacgataccttttggcgcatgcacgatacctttcggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccacacgttcacatgtcaggggtatcactcgattttttgcgcctatataaatcgccttaacgagtgaggcctcacaatctttcagaactcagtcacattcagtactctcttccccacttgcttcattacaaatccgactggctttcgtcaatggctagacgccggggtgttgaggatccaaactggcgtagcgatccttgtgtatacctactaccaccttggtgttagcgtcctctctgcctatgcgatgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactgacgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatgataagaatattttgattacatgattccttattttctcacaacatttacgaactttgcttgctttacatctattctttcctcccaggaaccaccaaggagatgtcaatacagagaatggatagacaccagaagggttctaactccacctagccgtattgtgcagcttgaactaccagagcaatacagggttactaaagcgcggtttgagagaggagagggatcctcacgtaggggttagctattatcggacaacttggcatattgaaatttctactgtcatgcttccttgtcccattattacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacctagactgcgataggcctatataaattatccgagtactaatacgtcgaatatggtacaaaataatacctcacttaacatatgaaattgcacaacaaccaacttcaatacatttttataacaatattaacaagttttaccaataaatacttctttatttattattaacataacatagaaaaatcttttggccgtacttttttcatctgg

SEQ ID NO: 79383 - DNA, 724 bp, Oryza sativa
  unsure (1)..(724): unsure at all n locations
cttttaattaaaccaaactaatggcacatgcacttcataatctcttttaatggttctcattcaaaatttattccagtgttattagtactgtacatctattactgtactaatggctcatttaccagcaaaagttgtacaatactgttttatttaatcttgctgcaataaaataaatttagtatgttgatgttatgactttcttttgaaaccagttattcaaaattacaaaatttgtgacctcgtttccaactgttttaatttatttcgcaaagcttggtttactttatttacttacctctttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgcacgatgtcctttgtcattggatttgggactgcccctttttatgcccagattcctcatgatcgtcatgaagagaagtgccgagtcagagtcaccttgaacagcaatagtgaagaggtcccctcagtgatgtttgaagctggaggaagaaactacatccatgcatgtcaggaggtggcaaggatcgcatangagagctccgtgatcgctacagtgatcaattggccgacactgagtatcgctaccatcctcgccaacctcagggaagtgaccg

SEQ ID NO: 79384 - DNA, 736 bp, Oryza sativa
agccattctgtctgacctatctaacatctgtgcttcatatttcctttgttcacacttcttttccttgtttttcaaagaatgtacgacatgtcgatctattagcactttgcagtcccatgatctcacatgcacatgttgctgctttcattacccctgtctatcccaattccatttcctagttttgttggatcaacattgaggctgagccagagtaccaggataatgtaatttgttccgagtaggagtttgtaaccacattccaatttatattgtgaacagctgttctttgcttaatattttgttagaatattagtttgtcaaaacttccagaccaaaatccacatgttagcattctaaattcttggacttgttctcttttttggtcagactggggcatcgaagaatttgaagaattgattcgcaaggtaagacctgtagcgccttgctttgagaaaaatataaggacctttagcgcctttataggtcattggggaatgctctaccagcgttgatgtgaatgtcaaaatcagtgagtgaattggggatttaactatttattcattgagttggcccttagggctaatatgagatgaatacaacgtgaaaagacagaaataccccttaacacatacacactaatacatatatattcttaacacccctactcaaatgcaatgtatatgcaacattgcatttgaaactaaatactagattaatgacacaggggtgcaggaat

SEQ ID NO: 79385 - DNA, 25906 bp, Oryza sativa
tcggtccaccaagaccaccttcacggcgaccgaacgcgagacgagcacgtagcaccaccgctcgccgtgccgcgaccacgtgtggcgcccgctgcctccgcgacccaacccaaacaagaaacaaaaacgaaaccaaaccaaaccccctcaaaaatctcgacgcgtgagccataagcccaggcgaccaccgagaccgaccgacccatccaaccaacccgagaccgagaggcgagcagcaaaaaaaaaaaaaaaaacaaaaaaaacaagacggccgcagcagcttcctctctcgccatgcccccacacctctcctcctccctcttctcctcctcccctctccccaccgccctcctctcctccctcacccgccgcgcccgcgccctcctccccctccccctccccctccccgccgcctccacccgccgccgcctccctctccgccgcggcccgctgctgacgcgtggcatcatggcctccgccgccgcagaggcaccggccccgtcgccctcgcccaccgccgccgcgaacagccgaccgcggcgggtgctggaggagctctcctgggacgactccttcgtccgcgagcccccggcgacccccgatccgacgccatcccccgcgaggtgcgtgcgtcgctggggtttactccccgcttcgtggctcgtctcgtctagtgcccttcgctttgcttgcttctgcttcacccggtgattttgtgctgcttgggtgacgcaggtgcttcacgcttgttacacaaaggtgtcaccctcagcgcccgtggacaaccctaagctggtggcgtggtcccagtccgtggctgacatcctcgatctggatcacaaagagtgagcccccagaattattctagtagctgttatgcatttatgcttgccgtccctagattattttggttttggggggtatccctgatgtctgtggataaatcagatgagggttggacaggctgcctttgaattagcatagctcgcttttttcagatgcagtaagagatactgttttattcgaaataattagctttccgtgattggcaatgcgttggagcatatacctcgatcgaaaatagtccgttatggatagagatgtaaatgagaagtggaaatttgagtgtgtataacctgcaaaaatattacaaaacctatcatatcacccttggtagcacatgagctcgaactggtccatacagcacctctaacttatgcattcactgttcgaagatttagtgtcattaccttttgcccaccagggactcttatcgctaacattttaatttatgcccacaacactgacaagtaaggtgaaaattttattcatttatgtttttgctgatgtgctgcagtgtgggtgaaagtggtgttgcctagagttaatgttaccgaaactttccaataaaaaatacaccttgtctttaagtttttgaagaaagttagcacagagaaaaggattactaatcagatgttcaaaattcgaacaccagagcgaagtattacatggtacacagacatggcatcatgacactcgtgtcagaatcctaattggagtggtgtgtccgatgcggcataaaaagtgggcacacataatacaactcagaatcggactggagtggtgttggaatacgacttggacctgggtgcctgattcggcaagaaattatttgcccatgcaatattctttttctgtgttgcccaactcaaacttcttgttttttaatttgccacatgataggccaagtgtgctgtctggcatgttatcagcttcttcttttggctactgaccactgaaactgtttatgacaagttggttttgctttttatacagatttttgtactggttgatttgttacaagaatactgtatttcttaagttgcttttgatcttgatatgatctgttaatgaattaagctgagtaatgcatttttacctcctaccaactctcattttctccatttttgtgtagaagcatgttcattgttctcttccctgttactgtcatccattccttttaatcattttgtatccttgttggtctactttcaggtttgaaagacctgattttcctcagctgttctcaggagcaaatcctttggttggaggtgcgtaatactaatgcttaacattctcttcatatgattgcacaagaaaagcaacacaccttctgatgaacaactacctgcagttcaccttatgcccagtgctatggtggacaccagtttggttcatgggctggtcagttgggcgacggacgagcaataactcttggagaggttatcaactctcgaggtgagagatgggagttgcagctcaagggctgtggaaagactccatacagccgatttgcagatggccttgctgtcctccgcagcagcattcgtgaattcctatgcagtgaagctatgcatggcctaggcatccctacaactcgtgctctttgtctagttgaaactggcaaatctgttgttcgagatatgttctatgagtatgtcatgacatctctgttttctgaactacatcatgctcgatctatttttctttctaaatttactttagaaacagatcgttccatatccgaagttgtatatctcattgttatgagatatttcttccttctatctaacatggtcacaaagattaaaaagagaacaatagatgatatgagtctctctatagaaagaatgatagatgatcaataatattattatttaaagctaaatatgaagctgccaataggcaaaaataataatggtagcgtgtttctgaaaacgtggtactattttaaacttttaactgtatgtttatggagaacatatcctatccgcacaagcttcccgtgcacattaacagccaaatatcacggaaaattctagaaaaaatatgacatgtactcttaatagtattacacatatctacaaagtcttatattcaaattcgctatattttagctgtaacaaaaaaaagtgaaaattttgacagttttaagattaaaaatctgtcataatttcgtcttttcgttacgattaaaatataatgatttgaacatgaaatgtcacagataggtgtaatactatttaaagtatgtgttcaattttttctagaaattttttgtgacatttgctagttggtgtgcacgggaagcttgtatgcataggatatgttcccatgtgtatgttgcttgagccacatatatataccagcataagctgcagtgggcctgctactgaacaagtctgttagcttctttggtgatggttgtgctggggatgtagaaattaccctgaatggcacgaatcatgtggtgatggctcattttcgtttttagcacatgtgagtttgagttttttttttccatttctttagtgcatgactgtatgtggaaatcatatttggcatattccagtatcattagtctacataagtaaattgtctggttttcatgatatatataatagcacttgtgagcactaaatgttgaaatgattaccccttgccactatgtcaactatgattcttggctgcaatattacgcaaccgagttactgcagctgctaactgcttttgtccacaagtgtgtgtagttacataacaaagcagcagcgaccactgtaatgcagcatgtagcagctgctctaagattcttcaggtttccttgggccatataacacgtccttcttttaagaaagtgcataattttgcccccccccccccaattttttttatttttattaactttgtattgaatactatcatacaaactccattgtccctttcatttacctactgttgattaacattaccttagcggctttttcataaagaacactggttgccaggacctttccccttttttttttccagaaccttccttttgaaggttttagtaattatgttgtatctattagcatttgtttatgatgataaatctaatggtttgtctttatatatcagtggcaattcaaaggaggaaccaggtgccattgtatgccgtgtagcaccatcctttttgcgttttggttcatatcagatacatgctacaagggacaaagaggaccttgaaattgttcgtcatttggcagactacacaatacgtcatcactacccacatctcgaaaatattaaaaagagtgaaggtttatcttttgaagcagctataggggactctccagcgatagatcttacttcgaacaaatatgcaggtaaatatcattatgtgctattttctttcagtctactcattgatatttaaaaggctaagtattctccccttttaatccttggttacagcctgggcagttgaggttgcagagcgcactgctttcttgatagcaaggtggcaaggtgttggttttacccatggtgtgctcaacacggataatatgagtgtattaggactaactattgactatggaccctttggctttttggatgcttttgatcctagctatactccaaatacaacagacctccctgggaagagatactgttttgcaaatcaacctgatgttggcttgtggaatattgctcagtttacctcaccattgacagctgccgaacttatcagcaaagatgaggcaaattatgtgatggagaggtgcattgttttgtccaatatttactgattattacccatgattatgtccagatgtatcatacattttgatttctgtgtactgcaggtacgggacaaagtttatggatgagtatcaatccataatgaccaggaaacttggtctacccaagtataataagcagctaataggcaagctgcttaacaacctggctgttgataaggtcgattatacaaattttttccgtcttctttcaaatgtcaaagcagaccataacattccagagaaggagctacttgttccacttaaagctgcactcctagatattggaccagaaagaaaggaagcatggattagttgggtacaaacttacattgaagaggtaggctttacttttggtaatcgtttattcagtttgtttctctaattctattttataagtgcactttcaaacccaacataatggtatagcacatcaatatattatcaatgatttttgtcttgcttgttggtgtttgggtatgtgtttgtcaacccctgtcattttgtgaagttggaatagtcatgtgtacaaaagaatgtcacaaggcagaaatgagtggttgtttgctcccgttatatgcttccaaatatttacaatcatttacatattggattatattgttttgaaaattgcatcaactgttggttttggataatatctcattcattgttaatgtatcatcagcatgctaatcaattccctgaattattgacttattctgccaatagccaatatgttggtagatcctctttgcttcattagttcaaacatttatagcgaactacagctttgagaaacgacaagttgtaaagaggctatttggacatccttgatctaatgatatatttttttctttgtgaagttggtttcaagtggcgttcctgacgaagaaaggaaagctgccatgaactctgttaatccaaagtatgttcttcggaactatctctgccagactgcaattgacgcagctgagcaaggtgattatgatgaagttcgtcggttattgaaagttatggaacatccatatgatgagcagccaggaatggagaaatatgcccggttgccaccagcctgggcatacaggccaggagtgtgcatgctgtcctgctcatcatgaaaccaacattccatcacgtcaaatatgcaaacttgttttttttatattatttttttctgtataggaggtttaattttgagctactgctatagtgtctaaagcatcacatgctattttactgccgatgcatatcagaaactggtgttgttaatcttcgagttatcatattgttgacggtagctaagcgttcatagcagttgggaaatagagccaccaaactcatccgattttcttagatatagtgctttgttgttgtgaacagattatattttcgcagatgaacatgatgtgcatttagttttagctgtccatctaattatgtccagcaacatgagaggtgtttatttacttcaaattattgtgttgttggtacacatgcaattaagcgcattgtcgccgtacggacgatctaataccacacaatgtgaaagcaattagttataacataaagattatttattccactgttctttgtgttcatggaacaaaagtaacattttgttcagactgattttgtttatgtagagatacaatcgaattgctccggattttgtttaggatgttcttaaaatctgctttcttggtattgagtttctttggttccactacgtgatcgttttcctagtttctttaattctacacagccgttcggtggcggaggacgactaaacaggaaaggttcagtcactacaaggaaaaaaaaacaaaaaaaacatttttctagtattatagagagactttttaaatgcctttacaatactttcacaatactataaaggtattttaaaaaatacctaataagtgtcttacggtaagaggtattttataaaatatctataagatggtagatgtattttctgaagacattaaattctaccacaatcctatgaaaccaatgtaaaaaaataaaatatttttccttgttttcgccaatccttaactcatgattaattggacaaattattctcatctataaggcactaaccaactcaaccctaagtatcacttgtgtgtatttgccttgagttacttatatttagtcatttagttttttttattctaagaagtgtctttatcgtgtttaaagtgtctcgagaaaatgcctttacaaaccaggcacaatttaaagcgccgtaagaatgcctctataagataaaatctaataaaatgtgctaaaaatatgctaaggttacggtgcactgagttattattcaatcttcaccggtcagctcgtagattctctttcacctcagtatatttcattgcccacaaaaaatggggaacttccttgtcatatttgcagccttcaccggttagctcggagattcccctccaccttagcatatttcgttgcctcaccaagaacggggaacttcctcatcagatttgcagctctgggcccacaatgttgtgtcttgcgcccctccgggaaggaagagagaggaccagagagatgttggcgtcgcggtgacagcaacaggctggtgcttgtgatgaggatgtagcgacgtagggggtaggggagaaattatcgctgccacccctgtcattgtgggaggaggagaggccgctggcagtgaggaagataggaggagctcaaggtcgaggccacgccactgaggtcgatccagagccagcgagcttgatccgtagctcgacagcttctggcccaacgaggtggagccccgcttgaccctaaatgggtgtgcgccgccgcttcgctcatcgccactcgcaaccacgacctcacctgctccgcttgttgagccacttcgatctgccgcctcgaacgccacctcgcctctaccgctctgcgccgcggcagctgcaggaagaggaggaggggaggtgtggcgaccggaggagggggaggcgcagtggagaagagaatggaatggccgacggaggagaggagaaggggactgagagggaagtgacggagaggcagaggagtttgaggtcgaggccgtcatcgatttggagccggcgctggcgccgctcgggctgcccggtactgtcgccgcatggaccaccgcgtcggccgccgccgctcaaccccgacacctcgctttctctggccttggcttcctttgctggtggggaaagaaagagaggagaggcagagatgaaaagtaaaagagattggtattggtagtatccattataagtaacttgcagtgtgaagtataaagcttaacacgttcttagtctaagtggcatgtgaagaacggcaaatatcagggacgcaccgcctaaaaagtaaggtacggattccttaaaattgcttttgcccacaatttgttcattgtggcgagacgctccacggtttagccacactttacatattagttgtgtccgccactgaacacaaagtggattttaaactctcaaagggaaggtttcctcgttgtttacatgacactcaaatagttatggaaaaaattaaaaccatttgagaagatgtattaatatggatatattattccacaaatatgcaagttaaaattcaacttctacatttcgcaaagaaaaaacaaatttgattgtgattatacgttaactagttatagtttaatttattttttcgttgcaagatatagaagttgaatttaaaattgcatatttgtggagtgatatataacatattaatacatcttcttaaatgtttttaaattcttttataatcattagagtgacatacaaacaactagaggacatcccctcgagagtttagaatagttttcccactaaacgaacagcagtgtagcgcaagaaaaatatctacagtggtggaggggggtgtttggttgaacacctcacattaccgtactttttgtgaacgctactaagacaagagttattaaaagtatgagtctacgacgtgtggattcaaagctaaaaaactgtggcacgtcaaagctatggcaatgaaccaaaattggcaggctaagagagtttggtaattggtactgaaccaaacagcccttaagtaatcgagttttcggcttgagagtacatgaacgtgcgtgctggtactcttgtcatcaatcaatatcaccaaatcgacgtaccataccagatcgagtttaactaagaccagtttgatttcgtgtttgatacaaaaattaagatggacggattcacaagagagcaccctctacttaagctttacattacaaggccaaccagcagctgcctgccggccgaccactgcgtgcgcacgcgcgcgcaataatcaaccaatcacacacagtacgcacgcacataaaaaccacccatagccttcacgtacgcccggacgcacgcaccggttcgtgccaagctcaagggtagatggttctcgggatgatgatgtcgccgatgttgttgtgccacgggtccgagaggtggctggccaggttctccagtgggccggtgcccgggtacgccgactgttggacgcagaaacccacaaaagccagcatggccaatcgccctacaaaccgatcgataatatatacgcatatgttatcgtctccgtttctaaatatttgacaaccgttatcgttattaaaaaaaaaaagaaaagttgggtgcattgcataccgttcttgatctccttgagcttgtactcctcgaacttgacggggtccttggagaagccgagggggtcgaaggcgccgccggggtacttcttcttctcggggtccttctccatggtgcgctggtgctcggcgaaggcgatggcgacgaactcgatgaccaggatcgtcggcagcgtgccccatggcaccgggttgccgaggtacgtggcctggccgccgggctccgccgcccactcctgcgcctgcacccagttgcccagccccagcgcctccggcaccaacaccccaggctgcacaagcgtgattcagttcagttcagttcgtccatggcggcgcaggccatgccatgcggagatcagaatcaagaaccataccacagcgagcatggcccaccggcagtggtacacctccgactccttgaaccgctcgaagttctccggcacggtggcgaggcccagcgggtcgaacccgaagtcactgcacgcacgcatggcaaatcctagctttgtcagtctctcgctcgccacggacgcacgccggcgaagacgtgtcgtcgtcgtcgaacgcttgtgcttacccgggagaggagccgtcgaggtgggcggggcgtggctggcccggcatccactcggcggacatggtgacgcgcccggaggtggtggcgtaggcgcagaccggcaggcggctcctgttcgacgacggcgccagcaggctcggcacgcccaccgcgctgcagctcctcagcccgctcgtcgccattgccgccgccgccgctagcttctcctcctcctcctcctcctcgaacacaccagcaagaagacgaagtaggaagaagaggtggccggtgagtggacgccggaatccgtggcgggatattaaggggggagcacgacgcgagcggccggagacgaggccggggatgggggatatccgaatcccgccgccgattggctgcgatatccgcgcgcgcccacccccattgggccacgtcggatcgtggcatcttttgcccgtcctacgtggcactcccctgcatttgccttctgctctgattgtctcgggctctcagctgggccaagccatgcaatgcagtccacatatccatgggaccatgtcttcttactccttcactagggaaaatctgacatgtaacttgtataaatccacaccaagtgtccaattccagatgatggttttgatccaaaggaagattttttttttcccttatcctcttgaattgtgcatgaaaggaagattttttttatccaactagtatttacagaattgtgaaaaagagcattgttttttcaaaaggttgggttgggcacaattcatgctattaaaatgagatttttaacttgttttattttttgctactgtacatgtaaccacagtgggtacttcctttgatgcaaaggatgatttttttttatccaactactaggcaactagtacgatgttcgccacaattaaaaggttttactgacttactccgtatctaaaagagcactgtcttttactgaaaggtttgagtttgatacaatagatgccattcagatgagatttttaacaaaaaaaaaaattaaaggacgatttggcttatcttattgtttgctactcactccgtcacataatacttgtcattttaggttgattagtataaattaaggtttcaaaaaaaatactatataggtgcgttaccaaattttgctagacctcacatgccgcatagatcaagaacaatattggctacatgctttacagtgaaagtcacttatagtgggtcccactaatatcaccttcacttttcatgtatctctctcctctcttcctttccctgtcggcagagaaagccaaggcgccggaggataaagcgaggcaaggtcagcgacgaccgtcgggtggagcggcgaggtcggcggtgctcctcctctctacattttccctggcagaggaagcgaggtggctcgttcggtgacggcgtcgagcagagcagcgacagcgcggcccatgcgacaccggtgctgggtagggctccacctctcctccccctctgaccagtgggtgacagcgcgatgggagctcagcggcacgcgaacgggaggcggcggggttgatatggtggcgagggcaccaccatcggggtaggggtcttcccgcttcaccgcatccgtacccaatcgccggcacaccaaactgtcgcggcacgtggaccacgccgactcgtctacctcgtccacggttgtggctggcatcggcctcgagctttggatccggtgacgtaggggccgcgagctcagcgaaaactcctcggcgacgagcccggcgatggcgcagtgtggagctagggggcgacgacctgcttggctcccttcctcccttcctggttgacggaggatgacggtctccctccctggccgccgagacgagccgagctctctttccaccctctcccttccctggcgacgagtgtgggtcgacctgacgatgctgatattttttttatgaacagtgtgtctcagtttggtcacgcgttcttggtttggtcacaggaaacacagttggctaggaatatcctacgtgtaagcttgaggcagaatgacacgtaagcatattgttaaagccctaatgcttcatgtttgaatgtgagagggtgggtggttaggataaaatgggaagaaatttgaataggagatattgatgggataaatggcactatatgtgacaactattttaggatggagttagtacatgtaaccacaggggaaaaaaaataagttgggctgggcccattcttggcccaaaaaagtgttcattctgtcatccataggtactaatgaattctgctgcgctctattgttgttctggtctctctagatcagcttatcttccgtaattccgtaaagcagtcagtcattcagccccattgattttccttgatcagaactgatttgcatcatctttcttctttttttctgggaacatctttctttctttctttctttcttttgacaaacaagatgaactattctgaaattaatggaggatgaaaagggcttgtcagtggctggctcagttcaggatggctgtctttgcttcatattgttgcaaagtgtttgtatagtcttcacctgtgctatcaatgtattcattctgccacggaatcgtatgctgaccaattaccggtgtcggatgaaatgaagggcacatgatttgttcaaggaccacaagcaaaacaacgtgcagaaaaaagtgtttgttaggaaattatgtggttgtggctaactggtgcctttgtagtttctagttgcacacttagcacaattgtactaattcattaactacatcaccagtcaaaagcacatgcgcttcgtcgatgactgaatgattctatgtgaaaccgttcacagaccatcataataaaataaagagacaattagcaccgagggtccagccaccaatagcatgtcttataaaatggagtaaatttcacaaaactacaaaactacaaaactacagatacttagatcaaattatcataaaactatagatttaagaatgtattacaaaactacagatttagcgtcaaatttttcacggaactacagatttaatgcaccatatcacaaaactatagatttagtgatgaagtaatcaaagaactacatattctagagtttagatcatagcactattatttatttaaagttataaaaatatgtagttttatgataaaatagttttaaaatgtgtagttttgtgataaaatagttgttaaatcaatagttttgtgatataatatcttaaatctgtagttccgtgataaatttgactctaaatctgtagttttgtgaaatacattcttaaatctgtagttttgtgataatttaatcaaagtatctgtagttttgtgaaatttactctataagataccgtctctctttaaatatagaataaattttagaaaatcctatatttataagttaaagttgtagaacatcatctctctcgttttctatgcgcacgcttttcaaactgctatacggtgtgtttttttgcataagtataagtattactatgacccatggtacatagtattatgattataaagcttcacaaaatctcacctttgtgtatgttgagtctgatttacttacaattctaaaatatatagtgcatataattcttttaactattaagttcttgaataaagatgataataaggttgttagtttaactcttctttacttaaaaaaaattatttcaaatatactgaaactaatcaagattttaataacggtggagttctatgaaacatatataccataaaacttgtggtcatgtgctacacgtcataatacttgtggctttgtacaactttaattttctaaaatttgcttttaaacattgactttttgacatgtttgactacttatcttatgaaaaataaacatgagaagaaatcatgttttaagtatatttaataataaaataattcgtagtatatttaggaatacatagtttttttaaaaaaaatgattaaacgtcatatcaaaagtctatggtgactttatttttcaatttttatataacgtttgactcctcgtcttatttaaaaattttctatgattaatagttttattgttattacatgataaaacataaatagtactttatgcgtcatagtttatttaaataagacggacaatcaaacggtgtacacaaacctaaaaatgaaggtttttttttgggctgggggagtacaagacaatgttgtttacaaattgtactagtactgatatgatttgatacatagtataatgaatttggccagaggtatgtctaaattcgtagtactatgatgtgtcacattcaattttagattggttttttatggaactgcgagaggagtacaaaacaacagaggaagtagtacaattatttatgctgaaccagcttcagtaataatcatgcagtaatcccagaagcagttattccaaacaggcaccagcaacaaataaacacatccagtcatgggggtcagaaccaccaccctgatggatcttggctctagctcctggttttctttctttgctccctccctgcctgtcacccagtcttgggatcctccctgttcttctctccctcttgaatcccccaagagcagataaagagaactagtactaataccactacagttaatccttaagcacactgtcatttgcactaataaaaatctcattcttgtcaggctaataatcacagtggagctagatcatctcgttttcaacggttggtagactgtaaacaaagtgcaaggccgagctgagctgagctgagctgcagcgagtgacagctccacagaaaagcaaagcaagcaagctacctctctctctctctctctctctctcggtagcttctctctcttgctggctggctctctgcgcgtggtgtgtactcctgctgtccctgctgcggctacagctactgttgcagctcgagcacccagaaggccagaaacccagaacaagtctcacaccctcctcctcctctcgtccatactagcaccaccgctgctgctgttgctcctgctgctgtgctgccgccgcctgctcgtccaagaatcttccagctttccccaatactgagcagccaactcctgctaccgcttcttgatctgtgggattttcttcttgtttcgaatccaagatcacttccaatccatagttttggcttttggcttccctccagcatcagtgaaaattggttctttggaggggaagaaatggatagcggctggatatgcttcttgagccagattgctgatttgatgcaataaggtaaacttcctcctttttttttctttttctcttctcacctctattggatggttcatctcttgaattagtttctctctgtctctctcttttattgatgaaatgaattagtttcttgtttttgttcctatcttttgtgggttagtatattggttgatgtattccaacctgagtttaatggggatatttgttgtctgaacttgtcaagttctatggatctcaatatgagacacttcatttatgcttaataaatcgattcccccagagatatctgataatctgaaatatactgttccaatagcttgttacagtaagagtaagttcttgtatgcttttcttgcagatttctatcttatttcttgctgcagtatcacaaatcaaactaggagaactgactgagaagtgaaatattctgcttccaagaatcaatcagataaactgattccaagaaaataacaagaagtaatcagataacagaagcagctgcagctgcagcagtagcatctttctgttcccagtaattgcccaatccaactccagctagatttaatcagatagagaagtaatctgctggattgaaatccatgggtaggggaagaggcagagggaggaagctcaccaatggcaggagccatgaggacaagggcagcagcggcgaggaggttgtgcctgcgaggaagaggaggggaaggccgcagaagcgcattgtcgacaaggtggtggatcaagcagaggccaagaatctaaccgagggcgacgacggtgatgctgactaccaacaaggcgaaggagaagacggcggtgcgaagccgaaggtgtcaagaacggagaagagctctgcagggaagggcaacaagaggaacaggctgcccaaggaggaagaaagctcaaaccttgaccttgaggagaacagctcaagcacccggtccagcaacgatgaatccaccaggtccaatggcttccggcagaatggcagccggcgtaagagcacgccgcggcgagccgcggaggcggggatatagcttggaaactttggaatagggtggggaggacagtttcatcagggattggttcttgggttatatcatcagttaggcaagctgctcttcagttttgtcatcttcagattcggcaagttttccttcaaaattttgtcatgttcatgtttgctaggcaccaacatgaatgtaatgtaaacatatactaatccgcgagacatcggagttttgcttctggtgatgaaaattgtatgaactagcatcggcttatggtactactatagctagcatcaccaatcttgttgcaactttgtttcatctcatctgctttacttttgccatttcagagatacatccatcggagttttgcttctggtgatgaaaattgtatgaactagcatcggcttatggtactactatagtctatagctagcatcaccaatcttcttgcaactttgtttcatctcatctgctttacttttgccatttcagagatacatccatagctttttttttttagataagagtatttttacctggcctctacattcaactggatatatgcagtttttttaaattaggaacttagccctcaaataactcaatctaaaattcgctcctgtgaagatttgaactcagaaccttggggtgttactcaggtcactgcaatcattaggctatatgccctttcatcagtgttggctgttactccttgttcttgccagatcaagataggttgactgttgatcgattgctgcactttgtcttgctctaatcaagatagcttgattgctgatctatattgcaaaggccaaatgactataacatgttcattctgttcactggtgaagtgcagacttcatggaattcagatgtcataatatctttttgctgggcatctagggttccttttgctggattcaggatacactataaatagtgaagcatagtatcctgtcttagattggtgaagaaacagtgcttttgtggacaatttgcacaccatgatggatgttttcaaatgatgtcaaattatcaatctagcatacacgaaaggaagattttcagggtatttgattctgcagtgatgatgctgtcgaaccatatttctgccctagcatttttttggcaactggccttgaaccattatcgaccatattgtaacacaaattgttgcctcctgtctggatcaacagtaagtctaaccacactaaaacctaatctaccactcctagtatttatcatcatggaacaaaaagattcagacaccatgatagtatctccactgagccatgtaagagcaagtttaatagtatagccaactattggctctaaaatcaattatagttaatttaatagctaattcatacaatagttacctataaacatgtactatataattaatatctggtcccacctatcatgcacacatgcatattggagtctgtgctacagctggctacaaatgtgtagctcgctgcttttatctctcatcttttatcttcttaaaatatgtttatagctgacttatagtatgctactgtacttgctctaaatgtgatccctctgcattgttggctgcacttgtcagaattcgttttttgtgtagattgcttctctgacgaccatctagaaagcgtttcaagtggagactgaactttcaattttgccatttcaatttcaggtttcaacaaggcttaacaaaaaattcagtgcctattgccggatttggcatgtacgatgggcctaggtacactcggaccgttgaaattggtggtttgtggatgagcattttgttttgtggttccttgctagttgctccggcaagccgtagtggtagtgccggtgacctaatctagaaccaaagatgggtcctcctgtttttggaatttgtgtaggtttagtttatcatgtatatatatgggaaggataagttcatgggtgagaaagttgaatcttgcactttctgccagcacaaatagtagatgattccgattttctagtattttccttttaaatagaagttgtttcgatattgggcttttgatattgtagagaattgtatcgactatcatcccatgtaatcggataagagatgtaaaacaatcttattatgatttttataacgtgcatgagcgagaaacaatcggagatagaaactgttaaggccctatttggttcaaagtatttttcaaagaaattgtaaggttccatttccttcaaggaaaaaccgttgtagcagcgtttggattaaggtttcattttcttcgaggataatgtttggtgaagcactagggttatgtgaaaagacaaatgattaaaagtcatggtaattaatatatttttctcaaattcctccatttcaaacacaaatatgcctatattgcctatgttttttcattcctttgttttgcaattatgcattcctaagttctttcctatgcttaattcatgtggtttgtttttcttagtttcatacaggcatgcaagcgatgggcttggtatgtgttttatgatctaacctcaataaagtattgtatggtacttttcaagagataccaccgaaaaaaaaacatggtaataaaaaggtagagaaattctgttatttgtagctgttgaagcaagagtaaggactctgcctataattttttttttggatggtaatccccagctctcagcatcaagcgtagattctcaagcatcggtcttgagttagaatgggtttagtgacgtggcgataatgtgacaccgtatcccagggtgttttccatggatgaaataatttttgaattttccaaattagtaaacagctttaaaaatcatgaattccactatagagtatttctaatatagattagtttgtaggtacaaaataaaacataatttgtctgcaaaatataatttaaatgtactaaaaaccattttcgtgcgaccaatttttttcactacacctaaatttatttaggtttaaatcaaatgtgcaaatgaagtgggaattgttccataatgttttgagtttattactaacttttaaaattcacattattaaacaaactatttaaaaaaaactaagtcgcatattgtgggttttagaacctagatattttgtctacaatagactaggttgtcatctataagatattccactctaaagaataaaactattctaatgccactcaaaaagatgtaatgctgtttttccactttgaaaccttttgtattagttagtatggattcaccatttattgaccattttgcccctgtgcttttaaaaaaaatcccccgtgtgcattccctcttcatctaacagaatatggcaaagctcagaagcttggagtggcaaaaacagaattacaacttttgaaaatagcatgataacaattacattggagtggaactcttgaaaatgataaatgttcaattttctcttagaatgaaggttacttgcataaacaaaatcataaagaaaaaaagagttggatccataatcaacttacctcccaaagggtatgtttcttgtaggaagcaattcccagtcctactttagccacattttttcactagaaccaaacacagttttacgggggatttacaattatgacattgcaattttttacataaacaaccaatacttaaattgaaaagctccacactttgccctgatagcaaagcctgatatatgacacctggaagtacacctgaagcactaaacagcagacaaattatgcccttttttatttgtaatcagaaggataagccttcacatggattttgtatcagcaaatgccaagatctcgctgttccccggtggcatcacgggcagcacgacttgtaaagcaactggacataatgaattctgttttttttttctttctccaagcaccaaatctgcctataaatacacaaaccttagtgagaacagcagcaggagaagagtcagtggagaaagatctactgctgcaacaaagaacagccatggagcttctctggctgctgctgttgctgctcatggcttcctcaacatcgtcgcggtccgaaatgaaggcgggagaggtgatcaggagaagccaattccctgaggacttcttcttcggcacagcttcttcggcataccaggtatgttctagaagcttctggagagtactggaagatgtgtgtatctgtgtgtgcatcacttggccctttgttacaaactttttgatgttgcagtatgaaggtgctgtgagggaaggtggcagagggcccagcatctgggacaccttcacccacaatcatccaggtctccttgctcctatgatcctatccaagattatgttttttactgtaatcttaacccttatctattcttaagcatatcaaatttatcaatctgactgttacatactaggatatttaatgtgatttaatgtgtcgacaatagtaagatttgaaacaggactatgcaaaattttaacctgttgtcaacttggtgaatgacagggaattactttgaacaatatcatagcagccttctgactaaggaaaaggcaagcaaagctagacaagatcaagtcaactgagttataacacagacacacagtagccagtaggaccttcaaccttagaagtcaaaaccctctctgaattatgaattatgacaaaacttcgtacacaatatttatgctttttaagcagttgcaaatgtgtgaatcacgcaaaagtttctatttgaaaaggaggtataggagatctgcgcccttgattaatagtggaagaaaggatagaaattacatactccttctgtcacaagataagttgactattggagttcaaactttgtcccaaaataaattgattgttaccttcttgcctaccacggtccacaaatcaaagacagtcagactaaacatttccaaactggcaaaacaaaaaaggagaaaaaaatggttaccaaacttccaaacaagcaagcacagacaatcctgtgatcttctggttgtcataaagtaataccacttgaaagatgccaagatcagaggccactccagaaagagaacctagttaagtgcattccttccatagcatgttagacattggttaatttagtgaaacacaacatcaatgtaccaacctgtaccacaaaacctcctacactagacattgtatattctttagtcttttgacccttaaaacaattagggtagaaggcacataaaacaccaatctaatgcttgattgggactttaaagcacttcagtcatatggtcaatttgacctacgagaaaccaaaagtagtaaatttgttatgtaggtactataaatcttcattctaacctactaacaagatcaattttacggtccttgaggaggtaccatgaggtacaaaaaatttagtgtaaaatttggtatctcatagtatctaggtaccaagaggtaccaaatttacaatagaaaaaggcggtacctcatagtatctcctcaaggaccgtaaaattactatactaacaaaggaaggggagaaagaagaagcaaaaggctagtgaaaacaaattttcaagcatctgatgatagattggaacttttcttaagtagtttaatttttgttagatgatggcttaagtagttcaatgaccgctattagctatcactactttattactccatgtaaccacaagcaaataaacagcttagttttcgtgtacttaagttacagtccacatggttcaaaagatgtctatagagaacctaattaataagctactggctatttatttttccttatatacctcaagcacttggttattagacaactcaaggatgtcatgcatgaaagaagcatgtctaaatcatgtttaattaactgacattcagatacggtgcttcataatcaaactaccaataatttgttcatgcagagaagatagcaaatggaagcaatggtgatatagcaatagattcctaccaccggtacaaggtaatgcttttaagataacatgatcaacttgtaatattctctacacaagacctaatgtttagaatatgctaatatgttattcactaagtgcaggaggatgttggaatcatgaagggtttgggcttgaacgcgtatagattttcagtttcctggccgagaattcttcctagtaagtgattcctcctttattttactctatttttcgttgaggcttggagcatattccaggtaccacttatcattatagctgctcaaactaatatttttccattgatctgcaattgaacactattgtaacttaatttgatagctgtatagattaaggaaagaaaaagagtaaaataagttgatcgcaggtcagtaccttatgcaatgatgatatttatatagatggaaaactgagtggaggggttaacctagaaggaatcaaatactacaataatctcatcgacgagctaatttcaaaaggtagagattacatatttccgcagtgtaaattcaaaacaaattgctcttattactatatgtttacatcttaataatgcctaacaagcaaatacaggtgttgaaccgtttgtgaccctttttcactgggactctccacaagctttagaacaacagtacggtggattcttgagtaacctcattgtgtaagtaaagcatatgactcttcctatatgtacccgaaatttactgatactccaattactaataagaaccatgatgaaatgacaaaacaaaactggaatcccctccctgtgtgtatcttcttattactaatgaaatgatgcgctctcatgcgtgttcggaagaaaaaaagatatgacaagaaaaataaagcataggagttaattaacagcttgtgccaacattatcagggaagacttcagggactatgcagacatctgctttagggagtttggtgacagggtaaaatactggattacattcaatgagccttggagtttcagtattggtggctattccaacggcatattagcacctggaagatgctcctctcagggaaagtcaggttgcagcaagggagactctgggagggagccttatattgtagctcacaatcaacttttggctcatgcagcagtagttcagatttacagagagaaataccaagtatgacctagttttctttactgtgaatttgtggttattttcagttaaaaaaacagaggtaaagatcaataatataaaatgcatttttacagacgaagtatgttaatagataaagaccttttagttttttttttctcgaacatgcagactttttactaatgaaaacattagatattaatggtaaaagaaaaggcagatgtagatagatagttcatttccgtagtttttgctagcttatttgttgaaacttgaatgtgataatcatgtaatcatgcaggggggacaaaaagggaaaatcgggattgctattgttagcaattggatgattccctatgaagattctaaggaagacaagcatgctaccaaacgtgcattggatttcatgtatggatggtgagttcttgttatgtgcagtacggcaaagagctcagcttcatacttgaattttcagatcaatacatacagtattttttttctttttctgatcatcaaattgaataggttcatggatcctttaaccaagggagattatccagtcagcatgagaacattggttggtaacagattaccaagattcacaaaggagcagtcaaaagctataaatggatcattcgacttcatcggtctcaattactatacagcaagatatattcagggtactaaacaagatagtaacagtcacaaaagttacagcactgattcactgactaatgagagaggtaatcattcaagaactctgttttctgttctccaattaattgaattactttgttgagctagctaatggttttctgaacatgcaaccatagtggaaagaaatggaacagatattggtccaaaggtatgatttaaatcagacatcatcatgttcttcatatgtacgagctagttcatattattacacattcaatatataatccgttgtggtaatcagtggataataaagaacacatatagttaattaaacatagaaggaatagagttaataaataacacatatatagttaataaaaaaacataaatatatttaatttgtatccaggctggttcatcttggctctacatctatccaaaaggaatagaggaactattgctatacaccaagaggacatacaacaaccctactatctacatcacagaaaatggtacggcattctaactgtttaccaaaagttgttctgctgcttatcaaaaaataaataacactcgtgttacaggtgttgatgaggttaacaatgaaaatttatctcttaaggaggccttaattgacactaccagaatagagttctaccggcaacacctattccatgttcagagagccctaaggtaattttgatgacaattaattgcttgacaatatagtggacgaaatcacaacaaatatctcattgtttcaatataatttggatcgaaatggttaagtatctgcgtcaaaataaaaaaaatactgtcatggaatgtcaggcaaggagttgatgtacgaggatactttgcatggtcactgttcgacaatttcgagtggatggatggttacagcgttcgattcggcattaactacatcgactacaaggatggactgaagagatatccaaagcgatccagccaatggctacagaatttccttcataactgaagtgtgcgttgttaacagtatgaatctatacagcttttgagggagaaatattcctagtgtaatgtataaattggagtaaatttatggtactaaaaagttaccggaaaatatcacagattgtagtgttaaactgttaatatgtggtagtaccttgacaccgtagaggtgccagaaggtatcaaaatttacactatatatatatagatcgtgttgtgttgtccaagcttcagcagtagtaccaaagtaactctctttgtggtaagatgcagcaaactggactgtaacatcgcagaactagctactttttctaacacaatactggagcggaacttcatagaattctaattttaagatgtacaatactagtttgaagtatcagataaccacttgctattgtaccgtgaaatttatagtaattttaagatgtacaatactagtttgaagtatcagataaccacttgctattgtaccgtgaaatttatagtagcatgtatctaattaaccccataggggggtatattctacacaaactcgctacatagcacagcaacaaacataaactattcaaatcattgatattaagatatcgattatttgatattcaaaccattgatatctgcttgttagcaatggaatttttctccacaacatatttaacttcgccatcttcagtctttatcacccactccggggcagcaatcatacacaaaagaacatttgattcaggcagcaaaaataacccaagtacaaccagacaagttgttaaagtatgaaccttgatgtaatcaaccagctttcaatctcatcttatttcaggtacagtcatccggctagtacagtcatccagctaattgactaacactcgaacttagtaaagtattgatctctccaattatatgcaccggcctgccatcaaatacagttgatagcgttgtctcgcagagcttcttgagttccctggtttttgtaattgctgcctcctgtcacattacaaagctaatcactaccaaatctttttggctataga

SEQ ID NO: 79386 - DNA, 10215 bp, Oryza sativa
tatttgagatccttggaacatatttttaagccgcacatttcgttttcttttcttgatagcatcgaagtgacttttctttttaagaaaatggcgaatcttggaacagtctgaacttggttaactgattattggagctccaaacattccactcgataacctaaaatattcaggttaggtacatctccagagtcacagatgccaatgtttttttttcccctttagaaccaaatgataatgattgacccagctttcaaaagttgagaaatactattgtgttgaatacttagcatcacagcaacataaaatgtgattctttacaatatacaaaaatttgaatagatggtctacatgtatttatgtgaaataccacaaatatgttctcaatgcatgaagatatctgcattgaaatttgatagaacaatatatacttcttcattcatacgttcgtttagaaaaggatgatacatgtaaaatatgaagtcaagaactgtaaaacctccaaaatatactattcttatgcgctaacattgtactgttgcagtggaaagagaaaaatgctgctctgttgaatcttgagttcctgtcttctgctttttcagaaggccctaaccataaacctttgtttcggttttgtctaaccagatgaagtgaaggccctaaccatgaactatccgaccattgtcagtgttttgtcagtcacccccatcatcatctgtcgtcatggtaacagtcataacagagcaaacctgatggcagatgcgcagaagctgatgaatgcctcaagctttcaacacatccaaggctgttcactcaatcaaagaagcttctgtaccatgtcctaccaccttcttgattgcaggcagtacaaggaatggtgcttcctttcttcagatcacatgatctgcaaggttaatgaccaggcagaggttcccaaatttgcaatagcctataagcatgcattgccctaataaacgactcactgcacaagcagctcatggcctgctggaacacagccaacatgcttaacatgcgagctcaatctgtcaaccatctcagatatctggtctgaatcttggtgctttctatcccccacggtgaactcatggaacgtctcattgagttcgacccagcttgatcctgctgttttctgcgacccagttcctttcatctgcatccttgcctttgccatgtcactccactgcccagcctcagcatagatgttcgagaggacagcatagttccctgcattcgacggctgcagcttgctcaactcgttcactgctatttctgcatactccacattcttatgcagtcggcatgcactgagaagggatccccatataacctcattaggctcccaaggcatgcttttgatgaggtcgacagcttccttgatgagccctccacggccaagaaggtcgatcatacaaccgtaatgctctatctgaggcatgatgccataatccctctccatgttggagaaatgccggcggccctcatccacaaaccccatgtgtgtgcatgcactaagaacattgatcattgtcacagcatcagggttaaatccctgttgcttcatttgagcaaagagctccagtgccttgtctccatgcccatgcattgcaaaacctccaatgatgctgttccatgacaccgaatccttctgaacagtctcagtgtcaaagacataatccgctcggttcacacacccacatttgcaaaacatgtcaatcagtgcattgcacacatgggttgatctccctagattcctctttcgcacgtatcggtgaatcctctttccaagtgaaagagagcctgactctgcacacgcagccaggatactcacaaccgcggcaacatcaagttccacggaagcctccttcatctgagcaaacaacttacctgcctcatcaacaagccctttctgtgcacatgccgagaccattatagtccatgtcaccaagttcttgctaggcatcttgtcaaagatcacccgagccatctccaggtcacccttcttgcagtaaccagaaaccatcgtcgaccacgacacgacattcctctccggcatgcgctgaaacagctcgaaagccgcctccacctcccctgcctttgtgtagccatccaggatcgtgttccagctcaccgtgtccttctctggcatctcgtcaaacaacttcctcacgccagccagctccccctcccgcaccatcgccgccatagccgtgttccaggacacgacatcccgctccggcatttcgtcgaacaccttccgggcgtccgagaacccgccgttcttggagtaggcgtcgataagcgcgttcccgacgaaggtgtcctcgacggacccgagcttgacgacgtgcgagtgcaccgcgcggaccggggcgacgcccgcggcggagagcgccttgatgaggaaggagtaggtgaagctgtccctgcgcggcatggcggagaacgcggcgagcgcgtcgcgcggcgcgccccccagcgcgtaggcgcggagcatggtgttggcgaggaaggcgtcggcgtgcgggtcccggatcgcgtcgaagacgcggcgggaggacgggaggaggcggaggagcgcgtaggcggacaccagcctcgccgcggcgcgcgggttgaggtggaggccctgcttgagcacctgcgcgtggagctcccgcacgtgggcggcccgcgggaggccgcgcggcagcgacgccaggtgctgctccaccagccgcctctgcgacggcgccccccacgtcggcggcggccggaccgccgatgccgacgacgacgcggccgtggacatggacatggaccacttcacgaatcctcttcggcggcggcggcggcggtcgccggagaagaggcgtggcgagagaggcgtggccggtgaggaaggggaagctggagaaggggctaaggttgttgtctccgggtggctgacaggtgggcccgggcaaaacctcttccaggtggactaggattagacgtgtagtgaggcgtttggtttggttgggcctgactatatgtgggctggccctatgcaacgatgcatttagcctcggaaaaagtccacttagactcccttaattgttcaccgaatctaattcgtcacccttaactgtaaaaccggataggacgactccctaaattattgaaaccagtgtaatttgactcttccagcggttttggagggtggttttgctcacgtggcgctgacgtggtgagcgggaagaagcagccgccgcaggggctagaccaccgggtgatggtggcgctggtcaagatggtcgccgccaacttgttcctgcctccgggcaatgccgccgtccgcctacccgtcgtcgctcccgccgccgtccgacgtgctcgacgacgaggtccccgtgatggtgctgctcccgtcgatcgtggccgcacctccacctcgtctacgacgtgctcaccgccgcggtcgccgccgcggacaccaggacgctccgcaaccacgtcgaccggagcttcctcgttggcctcgtggcgctcttcgcctccgaggatccgcgcgagcgcgaccgcctcaagaccgtctaccaccagctctactccaagctcaccgtcgagcgcgcgtttatgcaacgcaccatggccgtcgcgctgctccggttcgtctacggcacgtccccggcggagcccgagcgccattgcggcgtcggcgagctgctcgagatctgcggcagcatcatcaatggcttcgtcgtgccgctcaaggaggagcaccgggcgttcatggcgcgcatgctgctgccgctgcaccggacgcggtgggtgcacacatgccaccgccagctctcctactgcggcagcatccgtcgtccgggacatcttcctccgccactggtcggcgaccaactgccagaaggaggtgctgctcatcgacgagctcgaggagatcgtcgagatcctcgaccagcaccacttcgacaagctcgtcgtccctgtctgctcccggattgcccgctgcgtcagcagctgcagctcacaggtttgtgtgcttcttcctccattttcacaatcgatttcatttcagtaaaaaaaaatcgatttcatctacatttccacattcaattaagtagcacatgcataattactgcttgcttccaacatccgggttcgcgctggatccgagcgccggccgggcctagagggggagcggcggtgggactgcttggagacggggcaggcggtggcgcggccgtcgccgctccagccctcgcccgcacgctgccgtcgccactccagcccccggccgccgccgccatcgatgcttccgaagggggaagagaaaagggggagagagaagagagagaagggagagagagagagggaggaggaagaagaagggaaggaaaaaggatgacacgtggtccatatgtaggtgggtcccatgatatattttgtgtttgaatggcagatgggccccacatatatttttttaattctaaatgccacataagtgccacgtgtaatgaaaaccgggttagcactgccacatcaacgtcatgttagcaaaaccgctctccaaaaccgctggaggagtcaaattgcactggcttcaataattcggggagtcatcctacccggttttacagttaagggtcacgaattagattcggtgaacaattaagagagtctaagtggactttttcctttaacctccgtccctcgcgccactccccagttcgctccccgaccgtatcccgccgctgctgtgggaggaggcgaatggaagcggcaccggcccaaggaggagcggcggcttggccgtccgcgtcgaggcgccgaagttaaggctgcggcagccagcgccgcttcccatctcactccccgaccgcatcccgccgtcgccgtaggaggaagcggaagcggtgccggcccaaggaggagcggcagctgcgccgttagcgtcggggcgcagaagctaaggctgtggcggccagttccgtcctacaccgacatcgcgctgctcccccctctcccgaccacattccgccgtcgctgtgggaggaagcggatggaagtggcatgaggcagaggaggccgacggcgatggctttgtcaattgggcaaacgggtccttccccgggctgccgaacgtcgtccccaccgccggatgccgacgccgccgactgccgcccctagttccgctgcgccccgatgccgccagccgccgctgccaacgagaagaaagagagaatataggagggagtcattgacaggtgggtcccactttatttttaaaatttatttgatgactggaatgccacgtaggtgccacgtcagcgaaaccgcccttcaaaaccgttgagtgagtcaaattgtactggttttaagagtttgagggtcgagatatctggttttgtggtttaggatcacgaattagatttcgatcacttttgagggtcacgaagtgaacttattccttcttgatgggtctgacggtttgggcccgtttggttatgggcctagttgagcgatcattttgagttgggcttagcatgggccgtcattgtacttgggctgctagagcaaaagctatcataaacatttttgtcatttagcaattttagtactccttttcttttttgaaacggcaagataaatgtcatgaatgcgagaagattaaaacggctaatgccagctgcatgccggatttcaaagccagaaaaaaatttgaacgaatacatgctttggattccatcaatgtgtttgtacacatgaccttttttttttcatcaaatgaaaagttcaaaacaaatatgaaaagtagacggaagaaaacaaaaaggaaaaaaagaaaggaagagatgctctgctgctctggtgggacccacctcaggggaggggatcagcttgactcaccctgacacgtcctgactcgccaaccgcctctgcctccaagtgcgtgctaatcctaatctctctctcgtcattagcagcgctaattaacccaaagtacataagattagcagtaatccgtaattagtggagtaattaatcaccaagcaatggcgctggcttggcttggcttggcttggcccgcgcgcgaagaagaagattcgttcaacgatcggacggccatccggaaagcaaggagaaaaatggagggacaggatcgctgcttaattagctggcaattgctttcttcgccgctacgtatcatgcatggacaatgcatgtgcttgtgcttccccttggtttaattctcgcttcgcttttttactcctccctttggtttactcacaaactttttttcaaaaaagaaaaatcttgatggttaggagtatttaagatacttggtgatttttttcatacatggtataatactataatttggatatggagaactcatacacactacgctttgtgccaaatacaataaaaatgagacgatctagatcatgttgtttatagtacgtaaatagaagagatagatatgtcaagttatgatgtttgtatatagaggaggaaagtatatgatatatttatcctacacattgtttccttctcgctttacacgttagtattttggttcgctcgcacctttttctatcttaattattacttatccacacattgtcgacgtggttatgtatgtataccgtttattagaaaagcataccgacaatgtagcgttctcgatatattttccagcattgtttctttccgcctttttacgtaaggtattttcgaaaacaaattatacacaatcaacaacatatgtgtcgtttatcgcgatggtaatggatacgtttaatccttttttaattgcttccaagtaccaatataatcacactcttcacgaccctcccacatttcttactcatccttacaccatctcagccacccaacgcacgatccgacggtccacaatccatcaacagcacaaggtgcggttctaccacagccgcagaggcatacaaagctcatcacggccgtccagatccgatcggacggtgggggatcgctccaaccccaaccatttctctctataaaagccggccatggcggccacaagccaagctcaccgccaccactccattgccatcttcttccacctccagcctcctcctccgcctccaatggagcttcccctggacaaggccgcggcccgctccaccccactcgcgctccccgccgctggggcggcggcggcggcgaaccagtccccggcgtctctgccactgggaccacccgcggccgcctccgccaagcccctcgtcgcggccgccaacccgccgctgctgccggtggtggctccggcggcggcggcgcccaagtcgtcgtcagggtgagctgtgtgtggtgtggggttttgctgtgttcttgtgtgttctttggtggttctgaatttgcttggtttcttggaggaaaaacttgtgagaaaattgcactgcgagatgggggcaggtttggatgttttggtatccaaagctgcactcctctgtagttcgcagttaaagttgcagcagaatactttgcgtttgcatttctttttcgctgatcgaaacgatctcatgtgttcttggttgtgcttgctcttgatcatgccgatgatcctagtgacatccaggggtagagatctattttggcttcctcgaaagcccggttgatgatctctcggtgtcttggagaggcaaccatgctgcagagtacgtgtgttcttgggtttctttggatgttcttggaggaggagaacttgagaagttgttgcactgtgagatggacagctttgggtgttttaatatccaaagctggactcctcttttcgcagttaaagttgcagcggcagatgctctctcttcgtttgcgtttcttctgcgttgagatctcgtgttcttggttgggtaacgaagctgcatatatatgcttttcatgccgatccatgcatcgaacggtagagatctcttgggttcatcggaagcccggttgatgtgatgatctctctcggtttcttggacgcaaacgcgtgcatgcagcgttgcagtagtacgtgtgatgttccagggtttcttttggttggtttgagttgagacttgagaacgatcgatcgacgactaaaggcttgaacaggttggatttctgccgtcttttggttgcatggagggtgtggatgttcttgaacttttggtgttggatctttgtttttcttgggaggttttggtttggcttctaggtttctaggtaaaggtaaccatagatccagagttgagctcaaaatgttcgtctcaaagctgcatgcaagagatcaatagtttttgcacagcttgacgacgagttcgacgtacgtgctagcttttgcttttcttgttcggacgatcaaaagcctgcatgctttcttgggtctcgaattgctttactttcttttctgatcgttttatgcatggctgcttttaatttgatcttgtcttcactccaggggttcatgccttctcatgcatgatctacccactcacgttctttctctttttctttttttttgtcgtgccatttttttttccttgatgacaagcaatattattcggttcttggtttcttgagtagtatttctaggtttcttgataagtatgtttcaatgattttggttcaagagtttctgggttttctttggtgttttactgccaggaggggtcaaaagttaagccccttttgctttttttttagcttctttgttctagctttgtgtttttggtgtttttttttttgtcttcttcttgtggatgaatgcctcggttcttgtactgatctgccggtatttttgttcaagctttggtccccccttactccatttagagatttcggttgttttatttatgattattcatcgtgtgcaagttgataactatggtactttggatcactttgtgcttcaccttgatcttgttttgtcacaacatgaactagtgcaaggtgttagtccccccttttttagctttcttgaacatcttgaagcttatttctggtcatgcgggtcaggctaaagtttcatcttgaagtttgtctgaaatcttcaagtatatttgtataataatatactgtgtaacattagttcactgttcccgtattaattgcactgttcaagtatattttaagtgtaacattagtttttagctgtgttaagagttcactgttcatttattgcattattcatcatttagtactacattaaaccttgacatatacacagttgtaccaattaaacctactgcatcgtttgaaattccgtttgggttaattctaacatcacaccgtctattagatatgatcaggtttactgcttatttagctttgttcaacaccctgactctatttatctctaatcatgttgttgtagggccgtggaagagagcaaagagggtgtggaagagagcaacaagagcaatgtgttgaccattggcagcatcaggagcacgctgatgaagcatgaggacaccatcatcttcggccttctggagaggtcacagttctgctacaacccggacacctacgaccccaacgcttccaggatcgtccggttcaatggctccctggtcgagttcatggttaaaaagaccgagaagatgcatgctagagtgagttcattcatttctgcattctgaatttgtgacagggacagaataatgttgtgacatcctttcagatggggaggtacaagagcccggatgagcatcctttcttccctgagaatttgctggaggtggtggagccatctgttgagtatgagaatgtaatatatatatctcactcccccaattttagagtcactttgtgataatgtgatttatgtgttgactgttaaatctgtctgtgttttactctttttgtgccatgctgatgtgctgtactttttgacaatgtgatttatatgtttaaatctgtctgtcttgccatgctgtttactagctctgcaattccagttctttcgtgcacatgctgataatgatattggtattaggttcttatgataatgtgatcatgtcactgtttcctaatataaatttctgaacttactacttatgattggtgacatttaaaattagaagtttcaggtcaacatcttagtaaccatctatattcagtcatctgctactctttattcagaacaaattgtctgttactgtctgtctccaaaatcatgtcatcagcaaaaactgtactatttgatactgaacctta

SEQ ID NO: 79387 - DNA, 1888 bp, Oryza sativa
ggttcttaaatagctagaggttgaagaaactgcgtaattgagccccctaattttttttgttcctggatccgcccctgctaataattggactgatggctgccactcgcggtatatgtcatgtgggccctcatgtgtctatgacatgtgggttcggtggtaaattcttaattactatttgtaagagtgacaaatagttaaatatcttgtttaattaagcaggtcgctatcagaggcagaaatgcataagcgggtgcagataaacaaacactaggcttgcatgcaagagctgttggtcttgttgtgagaatcacatgatggtgacatgccaaattgtcaatgggagagagagagagagagagagagagagagagagagagaggagttgggttggatggaggtcggtggtttagttgagcagatgccatctaattttgcttgtcaaccatatcagagatgggggcccttcaattttgcgtggacccgtttcatgcaccatgggaggtgtagagtactaaatcccaacaaaatgacatggtgttgcctttggtgaaaacgaaagtggcttcaatattttgtaggttcgaaatgaaatctcaagtgattatctatttctacttttggtccaatagttattgatggatcaatcttgtaaattgatatatcaattatgacaaaaaaaaatgtctctatgccgattggacccattatctaaaaatgtgtgacacgtcatagttgacaacaaccaaacaataattttggtccctaaaacataattaacaacaaattattaaataagaataatattaaacatacaaaattcattaacatgaaaactagtagctagactagaaaacataacccatcctaaagttgcattgtaactatggtgtagtcttattatcgctcttttctttttattattttttcataagtacgatttctggttgagtaacaatgtgttggtagtgtggcatgacttggtttcatttgcacggtaaaggaaacgaacttctagagaaaccaatactcctatcagtactaccactatatagatgacaaacgctagctagatcagcacacaaaacatggatcgagaaagtcaggtgccaacggagaaagcaaagtcatgcgcggatctcaacgtaaatccaacgaacataacaccgactactttttttttagctaaaaatttattaagaaagccgaaactctaacaaagttggcaacaattttagaaggcaaaaacatagaagggaagccatggaaaaaccatcctcggtggtccatggaccgggtgcaccccaaaccacctctgcatctccattctccaccttcctcggttccaaattccacctgcatcgctactccaactcatcatcagcagcagcaaaagccagccagcgacctctccattctctccaaatctctctcgctttccatctccattttcctcgcaatcattccgttcagttatatctgctcgttgctcgttgattcgctcgctttctgtccctgcgatctgtcgccgccgtcgttttgccggcgagaacggcggctagggaggcggcggcggtgagtctttgggtttcttgcccgctgtgtgtgtgttgttcttgtgttcatcaagtactcaaagtttcgggggttatttttttctttttactgatgagatggtgttgatatgatagcactgtttgatcacgatttgattgaatcaattagtaattgattattagttatcactatgttttatgtatcctggaatcttggaatggatcgcttcgttttattgattactgagcgagatttattatgttttgaggactggatttatcatgccattcactcattaattatctgattaacttgcatgtcctgctgatgaatt

SEQ ID NO: 79388 - DNA, 863 bp, Oryza sativa
taagcatagctaattctccattattttagttatattgatggtcgaaatttgtcggtaacgaccgtcaacaaccccaacacccatgtgatcgttctccccctcttaccaagaacaatggggttttgtttattagagttagcaacttgatacttgcattcagcgcgcgtgttggctaaattgtctgtctgtttgtcttcggaaccccaccatattgtgatttcttcatagtgaaactttcatattcatttagtgtttgttctacttgttcttcgattgcttgcaggaagagtgacctcgttgcctggttgttgtgcaccacaagctcgcgacaacagacgttgtattggttgctaaggcgcagcgtcattagatggttgtagtcgggtcgtgaacgtcttcttcatccaagtgagttatccccgcctcccatagaaagatcgggacacaaaccctcgcgggttcacatcatcactgctagagtgcctcttccaccgccaatccgaaccaccgccactgttgtagcatctggctgctcactgtcagcaattggcatcacgctaggctgcagtgcttccacctttcgctaaaatgcgcctagcagtagcttggccacccatccacaacctcaaatcggggcccaaacctgcttctcacactccctagtgagttccgctgcaaactcaatctccagctagcgtttctcgctgcgccgcgactcctctctctcccttaactccttcaccttcccgaggttgcggccatccccgtccggaggagcaccgacgtcggccaccttcccttctcccctacccgtcgcgtgcgaacggtgagaatactctcctcgtctactcccgcgccacctc

SEQ ID NO: 79389 - DNA, 1615 bp, Oryza sativa
tttctgtccttaggattcaaacctctgttcatattttctttgttccaaaggagcaccaagcctttgatgcataatagaaatggattgtagtttaatttgttacgtaaaatttgcattattagttaagatttgaatttgaaaaccattgataatatattcacaattcatgtgtatctcctcaatggccatcgatccatggccagggcattgaatatatctctctcatatctagaggcacggggatgggaaggggttaggcctccttcaacttctgaaattttgcactactgtattataattgcatattttgtaaaattttagaggatttacatttttcgctctaacaaataaattctagtgtttctaaagatcagcctaagttgattcctaccactcaaaactcgtcctaaataagttgatcaacgcacatgcgaggtagctaaacagaactccattaatttctttagccgatcggtcggcatgcatgattgcatacatgctcactttctatctcccaaacctgacctggcccacctgtcgataactttggcagacaatatatatggcttttttagcctaagatcttcctactctctgatttaacatcattcacagcacaattatatactccctccgtcctaaaatataagcatttcactggtggagaaaccatctttcgtcggtcggccaaattccacaatagtcccggttgcaataaaaaccggggctaaagatcatctttagtctcggttcaaatgctgtcagggcttgtcaggccccaaccaggactaaagatcgtaactttagccccggttcataacaccaaccgggactaaagtcccacccctatatatatatatatatatatatatatatatatatatatatatatatatatatatatatatatatatatatatatatgttttcttcctcctcagctgcccgagcaagcttcaaaatttcttcaaaaaagaggggaggtcatgccaaaatttctagtgaatttattttggtgattatatacaaatcggaggtgcataaaaggttagcaacttcatcctccaatatttttttttgtcatattacatttggagctatgttttgtacacttttttatctccaaaatttagttgtaagttgatgagagagaaaatttgtgtggggaagaaagaatatatagaaatttagtttatttgctaaagaaggttttataaaatagttgaaaaggaaaatagtgaaagttaatcttaaataatagaaaacaaactaaaataaaaattaaaagaagtacaacacattaatattagtttaaaactttagaaatagtaaatacgaattatttggtgtaatattttataatttttgtatgaataatgatatgtcattattgtatgactgttgaaagagtttgtaattattttataattattgtatgactgtcattattgtatgaataattatttgtgtacaatttttttttcatctcatgtagatggatcggcaatggatgtacgctgaccagcggttcaaagagtttattgacggcgtgcattattttttgagagtggccgaagctaacaggcataagggttttatttgttgtccatgcaat

SEQ ID NO: 79390 - DNA, 5640 bp, Oryza sativa
gtggcggccgttgtagaactagtcgatcccccgtacgagaacctagaagcatgccctgtttgcaaagcactacgattcaagattagacgagacgatccaggagaagttgacgggcagctaacaaagaagagaattccggctaaggtaatgtggtatttccctataataccatggctaaggcgtttgtttagaaacaaggggaatgctagaatgatgcgatggcacgctgaagagcatcaacaggacgggatgctgagacaccccgccgatggttcgcagtggcgaaacatcgacagaaaatttaaagactttggaaaggatgcacgaaacatatggtttggtttaagtacggatggcatgaatccttttggagagatgagcagcggccatagcacttggcccgttacgatgtgtatctacaacctccccccttggctatgcatgaagaggaagtacataatgatgccgattattattcaaggccccaagcaacctggtaacgacatcgatgtgtacctaagaccactggtcgaagatcttaaactgttgcggtaacgacatcaatgtgtcctcaggctcctgcaccgactcctcctcaggctcctacaccgactcctccgcaagctcctcgtccggcaccttccaagtcaagggccccccaagctccaccgcctgcccccacaagggcaacgaagaaggcgaaagttgacgccgcaaaaaacaaggacccggggtacgattgcacgcaagaggagcttgacgcttatgtggcatcagaagtcaggagacaattgaagcctcgaagtccagaaaagaatattcctatagacccgagtgtcaggaacttcttcaggggtatgtctgcacctgccaaggaggccataaagctatcggactatgagcgaacacttaagaaagcatcttctggaaagtccaaaccagtccctcagcttggagagcaaccaaaccaggagatcgagccgttggtgaccggtgaagattttggaatacaagaatttattaatgacaccgggctaactacaaatcaattgctacgaggcgcaccaatcgaaaaggcggaagtgaaatacatgtacgaacttggtaaaccgcttgtcaagcctgagcagctgcagtccctacccacacaaatgtacaaattccatcaactgtacatggagatgagcgccaccggtagagagatgatcggagcgaggatcagggacacggacttcttgcaaggagatgatattctctggatcaatttcaagggtatctacgaactataccagctggacgccctcgatgtctctattatgagttgctggattttgtaagtatcgttcagttagatttcttattacgtttctttcaattaattaggtccttgtatataagtagctatatataatatataattccttttattgttgtagaatggatattcaaagggcccgacggcggggggttttcgatactggattcatcgaccctcggaaagtaaatgtcgcaatgctcaaccagtatccgcaagccacagaggacaatctcatccatctcctgaaggcgcatcattacaagacgttcgtactattgccgtacaacacagagttagtttttactgtcttcctataccaaatttcattcccgtacgaacatgctaagtgtttcatacgtaatgcatccgatgcacattgcagattccactgggtccttttactcttcgacttggaggcctgcaccgtcaacgtatatgactcaatggataaaaaagagtctacgtttgacaatattttcgaacttatagacaggtactgtcataagttcctatgttaattaagaatcttgttataattaattgctactacgaatcatagctttaaactccatctagggcttggtatcggttccgtcatttggtccgcggtaaatggagagaaagacttaggtggaagtttaattttcctgtgagtacacatgctctacatttatattgaatctccaattcaaatacatacaagtgtatattaattagatctctcgccgtttgtcatttatttatagtgcgcaaagcaaaagcagggaactaacttgtgcggctactacgtgtgcgagtattgccactgccttgcagaccaaatcatcaccacaagagagctcgatgtacgtacaaataaattgaaaatttcattgtgtacgtatcgatttgttgtttaattactaattaatttcatacattcatatagtttattcgcatgagggataacctcacacacaaggaatttatcgctgcagttcaagaacaactcatgggattcatcaacgaacaaatccttgatcccaagggtgaattctactacgacggaaatacaattcataggtccttagcttctgagataacgactactactacgtcgaaatcgtagctagctaggacatcataatggattgtaattaatacatgtctatttttctatatgcatgtacacattttctttaatgtaaatatatattttggtcatatatatatgtgcacataaaatgttaagtgctttcatatacacacacacatatgcatttgcataacatatatatgtataaatacatatatattatgcatgtatatgtattgaaacatatataaatataatattatatatatatatatacatacatacatacatacatatatataatatatatatatatatatatatatatatatatacacacacacacacacatacacacacacatatatatatacggtgatgctacgtagcgcccgtacgcgccatcgagtttcgtaacgcgagtaacagtcgcccccctccctctcctcctccgcttttcccgtttttaactcccttcgcagtaccgctattcttttcttttttttcctcccacctccttccgacttatccgttccacatgcagcactccagatgctagcctgtgttaagtaaaatatttactgcagttggtccattctcactaataaaattattttgttaatctttttcccacttacatccggtagtattaattccagtaaaaaattccatagcaaaatcagacctgtatatctacctagttaaaattttactccccacaagttagttaaattttactcacctctatttaaacttagttaaaattttactccccacaagttagttaaattttactcccctctatttaaacttagttaacttaggggctcgatattactccccgtatatttttcacaccagtttccgtgtgttaacaatagtaatatttttgttacatcctttttgcattattatagttaataactcattgattgttgaataaatattttattactcacttaatgatggcactgtatccatggaaccactacagcaggcaacgaggccacgcagcccgcgggggcaccgtcgatgtcatagaggatggccggcatggcaccaaggctgacgctcttcatcgatcctcctgctcatggaagttccatggcacgctcctagggagcgacatccagtgatggtaggggctgcgcagatcgattgtcgactgcaccattcgctagttgcttcgcaaaaaacaagccatatccggccgtagagcccggcctactcacagacaatgccagcgctcgccgccatgcccctcagcaccgggatcatgtatggcaccctcagcatccccgaccatgcatgtacgcgcaactgctgcgtaaatccaagatgaaggatgaggcacatctatttctccgagtcctgaaccgcctccatccctgtggcccggcgcgtacgcccgccatcaaggcaagcacttgggaaaacattgttgcgggcgccgcaccaattcaatttgacaccggcaatgccgacgggtagagccggataccgatccgccaccaagtctcgcaacttatcaccgctcacggcttggatctcgtcgcacgttgcctactgcggatcccgccgcgaacacgacgatcacgacggcgtggcggtgaggtgccggtagggcattctacggctgggtgctgggatggatccaaaaatttcgggaattggaggtttgaatggttacgggcttattgctggatacaaatacatatataggcagtgcaaaatgcaagtaaaaaaattactactacggctaggggtggattggagattggtcgtcggtgagttaaattttaactgcttattatggacctggtggggagcgtgggtgtgtggggctggaggctgtatcaggtgctgtttaatacgtagcaccttagggtgttgtatagtagttctctctctctctctctctctctatatatatatatatatatatatatatatatatatatatatatatatatatatatatatatatatcggtggcgctacccacaggcgctgcgcgccacgaaacaaaatggcgccagacacaaacgacgagaggtcagcccaccaccgacaaaatcccaccaacgaggcatccaacccacctgcggagttaaaatttaacttagatacagttggtggtggtggtgcggtgatatcgttgaggagttaatattatgcgatgattcagttggtctgagttaaagtttaacttagatacagttgggtggtggggtaaaaccaacggagttaaattttaacttagatacagataggtggtgggtgcgatgacgtcgttgaggagttaatattatacatggtttcagttgatatgagttaaagtttaacttacgtacaattgggtggtgggatgcgatgacatagtttttgtagttaaaaaattacttgttgttgttcaattctggattatatgtgattgagtctggtcgatgctgagttaaaaattaactcgcgatacaaaactgcaagacatcgttgtagagttaattcagtttgtatgagttaaattttaacttgtgtacaacaagattttaactcaacatatacatcctcacaatctataagcgtaagttaaatttttatcggcacttgctccggacatcaacggcggagcgtcatggaggtgttcgccgctgctcctccatgtccttcggtgttcgaactcgccgccgcggaggtcgccaccgtgtgcgtggggcgcggagcggcggccggatccgccgccgcctcggctgtcgcccgcagtcgctctgtcacgggatccgccgtcgagccgcccgcatccacgcctgacatgcaccaccgcagccggatccgtgtacgtgggacgcggagcggcggccggatgcgccgccccctcgcctcgccatgccatgttggatccgccgacaccacgccttcccgtgcaggattatccccggatccgtcatcgcgccggatacgccctaccatggccggttccgcgcgcgtggggcgcagatcggcggccgggtgcgccgcctcgtcgcctcctacacgtcgtcaaccgtcgcctccacgcctgcagccgtgccgtaccggatccgccgacgtcgcgctcgccgccgctccgcagtggaggtggcgctcgacgtcgcgccaccagccgtgccgtgccagatccgcccaatgccgccaccaccaccgcccgccgccacgcccgctcgctgctctcatctccgaaaaaataggatctggatatgtggttggt

SEQ ID NO: 79391 - DNA, 2824 bp, Oryza sativa
acattcaatttaaacagaccacgtagttaatttttaactcagcgatctaccaccccgccacccccacgtgaactcgatttggtgcaagctacacagttaactgttaactcaaccacccacccccacgcgcaagttaaattttaactcagcgacccacaacccaacccttcccccacacgcactcgatctagtgcataccacacagttaaattttaactcagctgcccacaacccacgcgtactcgatctagtgcataccacacagttaaattttaactcaacatactgactctatcttgtatatatattacggattcccatcttagaaatcgtctacccactctttcctcttcctctccatattttacggatcaacgatgacttgtggttccttgtgcagagaggaggaacggcgatggcgattaggggatgaggagtggcggcgaggcagttccggtgatggcttggcgacgaggaggaccggtggcagtttggggatgaggaggaccagcatcaaggaggagcggcggatctgatggcgttgaggtgcgtggacgggcgcgatagtggtgcggtatcgacgggtgactgtgggcgagaggcgatgcggcggtggatccggctgccgctctgcgccccatgcacatggatccagctacagcggcgcggatccagcgcggttgcgggcggcgcgtccgcggatccggcgcccccttcctcccgcatggatcctgcacgggtgaagactatgggcaggaggcaagatggcggcaaccttcgcggcggtgagcttgtcctccggcatccatggagcagcggcgggcatccatggagacggcggcaccgagcatgcctctctccgagttttccattttcatcttcttcaccggcagaaggagtggccaccgcccgttgtttccgttctcaatctggaaaccaccgagagccacctttatttccattcaacggatccagaaggagaagaaagctgctaggatcaacaacacaatcaatcaattatttttcctgattttggttggacgttgtcctgttatttgatctcaccgatgtgttattgcattatttgtgtgtaattagtttctaatacatgtgattcctatatgattagatgcatccggacatcttgcaaaaaaattgcaatctacatatcagtatattgacaattaaaaaagtactatatgtaatgtttggagtaaaatatttactatttgtaatttgtcagtaaaagtaaccaaatgatgtactatagttgaatctgaccatacctaaaagaaacagaaattccgttccctgtggagagaaaactaaatttaggtgtacaagcattattttcggatcaaggactctgttcattatccaccaggaccacaacaacaggatgtatcgcatgaaatgatttcgcagcttatggaattaacgccaaatcaatgcacgctatgatttcgcagtttctggaccaacggatccggcgacatggagttgagttctatccggtgaattaatcattagttaatttctatcgacgtaatttccggggagatgtgcatcaaaacaataaaattctaataataaagtgtgaattacgtcacacatcgccatcaccgcctaatttctcaaagtttttcatctactcgtaccagtttacaataagttaaaatttaactcatattccttgtcatcagaaacaacacacatccatgtctagatttagtgtattcgtttatcacagagctagacatttagtgtcttcatttatcataaaactacatatttagtgtctccattatcacaaaactatatttttttaataatgctaaaacctgtagatttgtgataatgaagatactaaacttgtagttttgtgataaatgaagatattaaatctgtagttttgtaaaacaagttcctaaatctgtagttttgtgatatattgtgcaaagtacctgcagttttgtgataaacgaagacattgaatgttttgtgaaacaagttcttaaatctgtacttttgtgatagatcgtgcaaagtatatgtagttttatgaaatttaatcatgataaatctagtaacataaatattatatgattgatctttttaacttttttatattaacagtcaaagttaaaaatgtttgacctaacactatgctaaaaatgcttatattttgggacggatatagtagttaactattattagggtatttattatttactccatgtgtctcaaaataaattaatccctcgcattaagaaaataaaataaaataatattctttatttggataagtaatggatattgaaggataaaacttctccattcgaggaccaggtaagaagttatcaattactaaagccctgtttagatcccgccacaaaatttttcaccctgtcaaatcgaacgtttgaacatttgcatgaagtattaaatataggctaaaaaactaattgcatagtttgcgactaatttacgagatgaatcttttaaacctaatcgctccatgatctcaatgtgatcctacagtaaacatttgctaatgatggattaattaggcttaataaattcgtctcagagtttacaagtggaatctataatttgttttttttttgcccgaacaccccatgcaacaccatatataatacccgacatgacacgccaaaactttacacccctgaatctaaacacccctaatttattttgcaaaatagtttaaaatatatgagttgatttattttgggtagaggagtagtaattaacctgttaatttagtttaatttattgactaataggatctgcaaccggctgt

SEQ ID NO: 79392 - DNA, 2214 bp, Oryza sativa
actagaggatcccccccatgtgactggccttgagcttcttcaaacgcttctgaaccttcctcaacgaaaacgctctcctccagaacgtcagaaactaaagcaaatgaacaaaatcaacaaaacagtacaaaaacaagcataaacagaacatgtggatatttttaacatgtagatctcgattttagatgaatttagcaacttgaaccactcgaatccgagttacgatgatttagttatgaatttctgaagtttaatcagattttcatcaaatacagaaaattattacgaattaaataaaagatttatgacgtcattacgacatcatcgccggccatggtgcgggatgacgcgaccaccggtggtagagggctcggccgggctatccaaggacacctacgcgtagaggacgacgacgcgaactcaccggtgcaaagaacaacgacggacgacgacgaacaacggccggcgacgaggaccgaggacggcgcggctcggctcgacggtggcgacggcgctctggcggcttgcgacggcggcgaaggggttgccggggtactcctcctccgcacgcacccgacggcggcaatgggaagcggcggcgacggctacagcggcggcgcggcgcggctggaacggcatcggcggcggcggcgactagttcaacgcggcggcggtgctatgggcaacggcgacggctaggacttcgggcaaacagaagaggatgactaggggatgctatttataggcttggattagagaaatcggactccaaacgagaggaatcgaagccggaaaatcctagggttaggtggaaagataaactcgaaatcgagtttgattcggataaaatacgaagcaattagctccaattcttggggaaaggatagaggacaacaaagggataaaaacccctcaaccaatcggactcagagatggccggttggggcggatttggcggggaacggcggcggcttgggctcggcaggccggctggaggttgaagacaaccccgacatgtgggccccacatgtcggcggctaaaaggaggggggcggtggcggctcggcttgggccggcttgggccgcacggccgcgcgcgaggaaaagaggagttgggccggaaacggcccaacggcctagggaattttaaagactttttcaattaaaataattcgtgaaatgatgtttcatttattaaaaatacttcccttgctcaaataatttccaaaaaaatctagacaatagataaccaagcaaagtatttaataaaattttatctagctcaattttatgttgaaatttttcctagattattagagtttaacttgtaagcttctaaaataatttctaaaaatgatttaaagaatgaattattaaactaggctattttcatggcgtgacaagtggtcaccaaattgggaaggcccgtttcaaatccataaggttgtgtccaaaggagcttgtatgttgcaagggtttgatggagaagtttatggacgagcacttaatgacaagtacttgaagaaatattacccaagtgtctgggtcattgcatgatcggctaagtgttgccgatgcatgttagccgatgtatttagatcgccttcagatggccgatatagttatatcgcccttagttttgttatcataatcggttgtgtcttgccgatgtatgacggccgatatggttatatcgcccttagttgtttttctgtattattataatcgatggtgttttgccgatgtatgatggccgatatttgctatatcgcccttagtacaagttataattttatcaatgccttcgtcattgcaaaattaggggggcagatatatgaaaaaaaaagtggattttcaacgcgaaaattatattaatcggcagatggattaagagttagactacaaatagccgattacaaaaatgagtttcaagctaagtcttattacaaagccaatcatttagagaggtattgcaggatagccgatataggtcattgtctaatttcctctacttcttggatgtcttgggcatcggttcctgggataaccttcacagacttggttaaatcagcaacatttttgatggccgatttaagtcatgattttttctcttcgattgcttttgggagattggctagcttctgtgtttccaaggccaatttagcattgcattcttcaagttgtgccatgagatcaatctttcggagggctgca

SEQ ID NO: 79393 - DNA, 8274 bp, Oryza sativa
  unsure (1)..(8274): unsure at all n locations
acaacatttctcctcgttacgttcatggggaatcggggcataaagaggggcaatcttgaatcctatggcgaaggccatcatccgcaactcccggacaaaactctcaacactgaacaagtactctggcctgtggagtggcatctaaagacatgtgaaaggagagagttaaggcatttatccaattaacagcacaagttttggattaatttgaataaagcaagaaaaccagagtgaaaaaataaatagataaaataaactacttaagagttaagctgcaacagtcgaaaaccagattttttttaatacgttgaataacaaattttaagacaaaataaaagagagtcataaaaatgctaagttcattatactgtgacatcattatacaagaaatattgtaaaatttttctagtaattgagtcattagtatagtaatcgatgtacagtactaacaacataggaataataaataaattttgaacaaggagcaaattaaagaaactataaattgcatgtgccattaatctggtttaattagagaagaaagaggagaaaagttctaatttttaaatatttttagagggcttctaacggtaaccatttggcataacctaggatcaaggaggctctgataccaacttgtcacgcccggaatttctatccaaaactccaaactcttacatgtgtgtaaaccctcgtccagcaatcagccgaggcacacaataacaaattgataatagagtgcaaatatttatctaattaataggcgaatataaagtcattacagaggtagatagtccctctcaatcattaaagatctaagcagcggaaaaataaaataaatagcgtagacgacgacatcccacaagcagcttgaccagggctacacctaatcctccacaccttcagcatcactgtagaactcgtcgtctgattgcaaggtgagtatatgacatactcaaccagcagcgcagcaaatatgcaagtgcaagggataacaaaggatggcataatatagtctcatttgcataaacggtatttaacaaacatttcaaaatttagaaagcagtaaagtatttaattcagcagtattaattcaagctatacaacatacccgttgcataggctctcccatcctgaacaaccacacccggctgtacagatctatccccaaaccaggaatataccattccaaaccaggagctaagcaaattattaccagttataacatcaataattattgtgagaggtgtgagactaatcacgaaaaacattgttagaccccccataaccgcgagcacagctattcgaatagttttactctggcccgatgtaccactgtacccacaagacacagtcccacaaaatgtcaccatgcgcctgaataccaccacggtaccacagaaaggagctatggcagtacccctcgcataagtgcataacacaattcacagcagtggaccgttcctgtgtcataatcacccccttagaaaacaaggcatggactccctagcgactcccccaacaacccccgtgggtttatctctgccacttcttagtctggtgccccacaatgaaccatgctatacaaaaggtaaagccattgcccacgctggcttgtggttgtcacggttaatgtttcacaaccgaagctcgcgaccggtccttaattgtcatgagcacgaccaacaaaaccatgtgctcacaacccaccattaatcaagttttagttgacatattaattaattaaccatcacgattaaccatcgtgagctacaattaaatatctatcattacttaatagtgaaacattaattatcccaatcatgtgctaatatttctaagcatggctaagcatcctaataaatttagctaaaaccatagaatgttctagcacaaattttgacaatttgaccctttgaaaaaactaattttacaaatgatatgccgccaaaacttattttaaaaatgacccttttttcagcgctaaatcatgtggcgctgaacttaaacacctcggcgccacgtcaactggcgttgaatgccgtgccaccacggatggaggctaagtcagcgtgccaacgtacattcagcgccatgctatttgactctgaggtgtctaaattcagcgccacacaatttggcgctgaacaaaagggtcggttttgaaataaattttggcagtggttcatttataaaaaatagtttttgcaaagggtcaaattgtcaaaatttgtgatgttctagctaatccaattattaaccatgtgacaaagtacagataatcaataacaaggggctataacaaaggcaataggtcattcccacccggtgacattaaaaaataaatgcaatagttgaatagaaacaatagctttaaacaggatcaacgtgttcaaagggtgtttgggatttgtgtggcttgccttgctggccttcaaactcttcaaaatattctcctgaaaagacaaactctccggaaacgttggaatctaaacataaaagaacaaaatcaaccaaaacagtacaaaaacaatcataaacagtacatgtgaatatttttaacatgtagatctcaattttttaagaaaaaatagagacttgaaccaactaaatccgagctacggtgaattagttatgaatttttgaagtttaaaccgaattaaattatttatagagattttaattgaattatgacgcaataaagaattattttgaaaagaaaagagttaggacatgttaaccgaggagcgcgtctgtggactccgggtacatgtagaagtcagtggcggagaacggagaaaaaaagtatggcccatacttatgtgcagagtcaatacacaataagaacaacgaaaaaaaaactccattatctcaatgtcagatattatacggcactaattaaacctaataaatcgatattcacatttttaacatgtagatctcaattttaggaaaaaaatagagacttgaaccaactaaatccgagctacggtgaattagttatgaatttttgaaatttaaaccgaattaaattatttatagagattttaattgaattatgacgcaataaagaattattttgaaaagaaaaggagttaggacatgttaaccaaggagcgcgtctgtggactccggttacatgtagaagtcggtggcagaggacggagaataaaaatgtattgcccatacttacgtgcaaagtcgatacacaataagaacaacgaaaaaaaaactccattatctcaatatcagatattatacggcacttattagacctaataaatcgatattcacgaccgcgcaacaagccaacagtcacaaccatagaatatctataaaacatgtgtacataagagagtaaacactgaaaaatacctcaaccaattaagttttagcggtacatcacaaatacatcctgataataagtagagaatagatcttattaacatgtatataatctaccaaacaaagagcaaagatagatttttaataaggatgaaataaggaagaacaagtgcaatgggatgtgaaagcatactacacttgactgcattaattgccgcggctgcttgttggcttgctgccgcagcgtcgctgaagttgaacagcccagttgccctgcgcggctgcactccaagagtctgtcgcggcgttgttaaggacctgcctgccttgctcgacagcgaattctcgcgctcgcgtatctcagcagcggccagcaaggcagcaactgtgccgttcatgcgccaaccctcgccctaccgagcgctagctccgccattgtgtagaacgataagttgatctaggacaccaaggatcaaacgcacacaaaatgttttggctaaaagtcgcggtgtatcataggcaggagcagcacaaaatgctttcgaccaactgaaacattaggacaaactcattatagcctgttattttcgtttttcttcctagtttggttgctttattcattacttgggtaacaatgccacatcatatctgatttcagagaatcacaagtcatttttctaccactgcacattggctaacaatatatttaagagtgaactgcggttttaccgcatttcattaccaaagttaagaccactatgtaacatttttattttaactggttaaatttatctttatatcactttagaccaccgtaattcttttctccatccacattcaacttatcctatgtcaaatgtttgggtttacgaacagcttcgaacatgggagtatctacatggtggtccggaaaatttccagcctaaaacccttatagaaaaatatatttaaaaagaaaaaaaactcatgtcatgtgaagcgtaaagtagaaacgtggtcgtctcggtcctatatcatgtttttttttcttcctcgccacatcgtgttgtcatagcagtagtcatcatgccagatgacaactacaagtctaagacagaggtagcaaattggcacgacaaggacactctgtcatagcaatagttaccacaccacacaacaactaggagtccgatatggagccagcaaactagcacgacaagggcgcatcactctattatagcagcagtcatcacgccagacggcaactaggagttcgagatggagacatcaaactgacatggtaaggatgggagattatcaagccgacatgtcagtaaaccaggaagggcaaacaccgtggcatggcgtccgtgcctctgtggcagccaactgacagcaaggtggtaaggatggcgcacggtggtatgttggaccacccaaatctgaaattctagatacgccactgactccgatgttcattaacgtgcaagagttgatttagttgatattatttatgtacttgaaaagagggtcagggtgatctaaatcacaacaaagataacataaaaattattaagttgggaggtaaaagtaaaacttagacagtaaaaactaacccaatatacaatatataatcttgttatttgccatcccctttacatttatgacatcttttgtccaccgttcaattatgtcagctaaactgtccaaagaccacaccaaatgttttaaatatcatgttttcaacttttctgttgatgaataataatcctaggaaaaacaaattcacttttcggtagtctttgttcagaggttacgtttggatgggtagttgaaatgggattcggatatgaggtgggatatcatggattggttatgaatagtgatttcaattgataggctattgtttacgagtatttgggtggcaaatactaccttcctctatcgaaagaagatttattttataatatccagattcgtatttaaaaataatttctttggaattgagggagtacaaagctagtaatcggtttaccatattttgctatttcgtctccttccctgttgacccaaaactgggagaaagccttactacaccccaaaagctaactcaagaggagtggggctccctcacttttaagttagttcaactccctctagataagtaatgtgggactattcctaacaatctcccccgtcacacattggtgccccttagccctgaccagccccacacacgggcacatacgggcctcacacccacgggtccactaaccggccccacacacaggcactagagattgtgggtttggctcttataccacttgttggcccaaaaccgggagacgttggcccaaccgggagaaagccttgttacaccccaaaagctagctcaagaggtgaggggctccctcacttttaagttagttcaactccccctagataagcaatgtgggactattcccaataatcccccaccccacaattcctacaggtgaaaatggatagtggtcctacagcatatttgtttaagcgtattcagaacggatacagatggtgttgatacatagcagattgtttcagatatcagaaattgtgtggaataggtgcaaactcggttcaaaaaacggattaaaattatcgaatgttacttgtatatgcaatcaatgcaacatcaagttagcaatggaaagaatgacaatagaataatcaataaacgatcaatcatagtatatgcttaagtgctagcaacatgaatatataattgtggcgggcagctaagcagcaaggccggtcctgggttttcgaggccctagggcgaaaacttatatagaggcccctatatatatatacacataaactaatatatatatatatatatttatagtcttataaaaacacaacatttaatattcgatgtgataaatttatctatatataacattttaaaacttcaaatagaaatattttgatgagcaatggagagattaggataacaatccacatctctaacatgcttgaacatctcaaatgctttttctgtttccttttttcgctactggatgcatattttctcgacgacatgattaatgttgtgttgaaaaaataatcatcaattattaagtagtacgagagctaataattttttatctatgaaaagaaaagatggagaaaattacctcgagcagcactgcagcaggctgcagcctacaggcgtggcgccgagccgtcgatcgaccggtgaggacagagggtgcgccgccaccacgcggttggcctgatggcctcgtctccttgcaacgcaagaagccgagaggcgagagctcaccccagcaggcagcaggcagcagcgaccgagcgacgtagcgtctgtagcgacgagcgatcggccagcgccgtgatcgaggcaagtaggcgacggaaacgggagtcaaatcgcttcgcttttccttcgctcctcttcgtttcgtcttccgtcttcgataggaaaggatcccaggcctgggaagtagcgatgcatatggggcaccgtgggccatggcccattagccatgggggccctggattttaggggcctcgggcctgcgcacgggctgaacccccccccccccngnnanaggaggccaggcctgctaagaaagtcagcaggcacgcaagatgaaacggttagagccttggacaaagaagtctaggttaactgatgaattgggttattggatgggccagctcatgctctatggaacagatagattggttgagcaggcctgataattttggattacccacaaaacaaccgatcggataatccaataaaaatatcagataatccacatccgtcagattttagggattgtacgattcctgtttggcatagctctacgggtctaagattttttttttagttggatatttcaaacttcacaattatgtggatctagatctatgtttacgttgataatatttagataaatcattttgttcctattttaaatgaattataaaattttaagtgattataatataagaaaacatataaagtttatatggatgatttagagttgtgagtcgtcacaccatgaagttcttctcccaagcctaaattaattaataaatggcctcaagaaattatctgtgtaatggcaagagagaaaccctaatttaataaatgcaaataataatcggaaatggcatgtggaatttttcttgggttttatatgtcaaaatatgccaacagaaatttagtggaattttcagagctctagaaataattttaactaaataaaaatgagcacaagcaattattaaatccctggaaatccctttttcttttctttttcttttcccccctttttccttcaaatgggccgtcggaccattctcccctcccctccccgcccgctagctaggccggcccgaggccgaggcccagcaagcggccgcgccgtgcccctcatccctccgggacaccgacaggtggggcccacctatcgggcccgtcccctacctccggccggcgccgtccgcgcccgcaaccgccaccgctcgcctctcgcgcgtctctcgggccacgtcgcccactccccgcactcgccccgcacgtcccgcaaccgtcgccccctctaccgcccgcgtgcccgcaccgagatggccgggattcaatttttgaatcccgcctctctctctctctctcctccccacctccccacgtcactagccgattcgtgcccctcccagccacgtctcaccccctcgcgcctatataaagcacccccgtcccctcctccacctttttctcattctcgccgagctctcccgtgcaatccaccgtcctagcgccgcgcaccacccgccgccatcgatttagccaccttggccgctgctcagctatgccagagcccgcgccgagccttcctgttgccgccatcggattcgcaagcccggggtccacac

SEQ ID NO: 79394 - DNA, 15792 bp, Oryza sativa
tttatcagtgtgtgtacgtcatatgaggccctggcatatatgcccaacaatatgtctgagactaccactcacgtggaatttgttggattgcaatgagaagtatatatatgtttttgtgtgtggagatgtaactgctgtagcattgtcaatccttggcatgtgcattcagaaagtgtgtgcgttcagataggatttcatttttctgtgatcggttgctgtcgatatgtacaagctcaatgtcagccactcgcacaaaatatgtgaaaaattatagatatggcgatggtttgggattttgcttatttgacaggaatactctcttctgcagcatgtagattccttgcttacgctcattgattcctccgtaattttgacattctagcccatccataaaacttatttcaaaaataggctgtgataaaaactatataaaaaaatatctttacactgtgggctaacatctcaccagtagggatgaaaacggtacggaaacggacggaaaccatctttatcgttttcgttttcataattctttcggaatcggaaaccccggatacgaaaacggaatcgaatattatcggaaccgaaaacggagcgaaaacgaaccggcgtgaatacggtaataaaaatttatcagaatacaaaaacccctcaaactgataaatccaattctcaagtctcaacggtcgacaattcatcataaaacacaatcatataagtccaattgttaagtctcaatagtacatcacaaaacacaatctatagaataaattatctatatttaagagagtaatgttgttgataaatcctaatgcatgaaaaaaatattcttatgtaacttcagatttgcataacaaatattttttaaaaaatagcagccaaacaccgtgatattcactatttagtgcttaaaaaaataatccaggatatttcaatcacaaaatttctgaaaattccgagaaaattttcagaaagtttccaaccgattcaaagttccgatggaaactgcccttatcatttttgattccgtttccgagaaaatatttctgaatttgttccgtttccgaaaaattctaaccgacagattcgttttcgaaaataggtccggcatctgaaaagtttcataccctttttcacccctactcagcgctaaggcctatggcaccaagacttgtgatatacaatttaaataaaagatgaacatggttggtggtggctgccttcatactagtgatctgtgttcaaatcaatccttgccgtgccacattttcagttcttttttaatcctgccgtgactttttctctagcggaaaagacacaaacttttcaactgaaccgcttcaatatgttgtacatggtaatgctcatctatattttttatagcttaatttggtcagcgccagaccctgctacgctgaggcccaaatcttagcgatgttgggcgtcagcaccaaggtctatggcactaagatttggttatagttttcgtccggtctacttatagaataagttttttgtgaaagggctaaaatgttaaagtttcgcttgattcctggagtcacgctctacacttacgttggaacttggcagccattttgcaaggaagctctaagttgccgtatgaataataattcctcgtttcatcgcagcacattacagtgagaaaatctgaagctgatctgtatttcaagagtttctctttgtcacttgcacgcctcctttttcatgatcgctaagaaaacaagtaaaaggtttatctaaatttgttcctgaaagtcaaactcaaaattcaatcactttatattataatccaaggcagggccaagcatagcataaacttagcttttgaattttgatagtctcattcaataatctacggtcatataattggtaactgcagaaactagggaagtagttttcaagacacataaagaaagtggcatttttttttttgaatctagagagcttgtattaacgatgaaaataggaattatacattcctggtctaacaaatcaagaatcactgcatgagcacataatctctactcggtgcaggacctcgacctcattgttagctgagcaagaacacgagtcatactattagctttcctctttgtttttgtgtgcacctcgacattttggagacattaatttcatcacaccctttgtttcagaaattgttcctgcccaaccaaaccgatacggtagctttttcacaagggctgttgcgacatcaacattatcagtctccaaaattatcggcatatgcacccaatcaattaccgcatacaaagccttctaaacagactagaaaatctcttctataccccaaaatttttagctaattctttctatgtctctgaattttgcttacttctttgtataccccaaaatttgattttgatctcttccatacccctcccgtcagttgactgtctaatttctataaaaataaccattttaccctttggatgaatatagaaattcatgaatcacattattaaaaatgtaaaagtttgccacataagactattatagttatgagtttgttatgcgatacattatttatcacaatttatttttagataaataaataaataataagtatttattttttaaaacaaagtcataaaaatgaggagcattcatacaaagataggactaccaatgctcacaatgatttttttatgaatgctcccaatcaaaaatatccatcgtcctattaaaatttcaaataaaaatttaaatttattacatttgttttattttcaaatttatgtcaaaattttatgcactaattatttagtctcattagtttcataaaatgcacatactgtacactaaaacaaaattttcaatcgtttttcaagtttatattcaaatctaaagcatcaaggacaaaaaagatatttgcaaccaaacgtaatagtaaaatgaaggaaaatgtaatggtaggagcatggaaaggatcaagttgaaattttagaagtatagaagggatcgggtaaattttaagggtatgaaaaggattgagtgaggttttaggggtacagatggaatttactccaaaaacttcagcctgaactgcctcaccgcaatgatgaagtgctttgtgagccacaaacagaactaagcctctataatccctcactattatcccagtactcgcttcccctgcctcttctctaaaccctacatcagcgttcacctttgcagagtctataggtggagcttgccatttttccttctctttgccgcagagtggggagtggtagcgggcagcagcgagcggccggagcaggtgggctagcgcgcggtggctgagtgcgcggcggctgagtggttatggccaagcgcgctgtggccgacagagcggaccggcggccgcggcggtggctgagcgcacctgcagagctaaagccatacgcgtgggaccggctccagtgccgacttagagatggtaggcgctctgtggccacggccacggcaattgctgctgtggcggccaccatggcctctcggtcttgtcggtaggtggaatggagaaggcggctaacgagagatgagggaggagagtggcagccggcgaccggcgtggcgatggtgggaggcacgttgaagaggacgagcccaccccaccacggatgaattgtcaatttgtcatgcgtccgacgacggattggcttgacgagctcctctcgccggtggtccctaacaaggcgcccagcgccgccaacaccgcctcctcaccgcccctaatcggtgtcacctcctcgccggcccaagccgtcgaccgtcgtcggctcgtcgttggcgtaggccccagacgacgcccccacaccacctcgtagcctcggctgcaacggctactaccaccatcacgtcgtcgagggaggagagattaagagcagaggagagagagggggaggagggagagagagcaggggaagagagaaggtggagactgagtatgataggtggggccattttcgtttttgccacatcaactcgagtagaccgggtcaaatttccacgtcagcaaaaccaggtgcctatattgctataggacgtaaaatggatggtcttgtataatttaggggtgaagatttatggtattaagtataagggatgtcaaacaaactcgttgtaaagttgaggtatggcaggtgaacttattccgatgtaggtaagcccaaggagctaacgtagccaacgagcccaagtgacctagtgaagtagctaagcccatcacgaaaataaaggcaaaaaagctcattagattagtcccgtacttgtctgaaccctagatcgaatcgatcgattccattctcttatcgttttcctcccgagccgcttcgtgttctcatcccctctcaccgagccgaggagagccgagccagctcgttatcctaacaagccgagccgagccgagccgagctggctttttgggtcccagaagcccaaaagcccaaaattctgatccgccgccggcatccctgctccgccccaccaccaccaccacctcgcgcggcggcgatgcttccggcggcgctgaggcctctccgccgcatccccctcgcgcgcctccggagccgcctcctctcctcctccgcctccggagagggcggccctcccgccgttgcctccaccgacgaagcggtgagggcggcgaagctgagggaggaggcgtacaagcaggtggctaacctcgactggtccagcaacgccgacttctggaaggccgtcgatattgtcaaaaccttgccacccaagcgcaaggaattcgggtcagcaccccctcccatcttctcctacattacattttattttggctttagaactggcggtcaatttggagaatggagctggttgttatttggggcaatggttgagagctgatgccaatagcccgttctgttgaaaagctttcacctatgatttgctattcgtgatgcaaatgtttaaaatgaatacaagtgcgtattgttacttcacactgaatgctagtatcattactaaaagatgtctattttgtatctgaacagtcgtggcgagtttcaaatcgattttttgaggtttagataacgctgtgtggtccataaatattttcgaaacccaaattccttgtcctaacactcatagtgaatagtgggaattaatcatgcggtcatcctttgtgcaaggttatcactattttgttcacattcagttgtaaccaggaaacatgacaaatttgaaaaaacgaaactcgttcaatatcctgctgaccccgaactttatgaccttgtagtccctggtaagtttgtaaagagatccaagaacatggcaaccagattcaatttaacacgaacactaattcagagaaagcacactatctactgtattctcatgacactcctcgtaaacatgtctatgaaacttggaatgccttccaaaattcaagatcatgtgatgtgtaatatatacatgtgttacatgttttggagatgaatttcattacggacatatcctatggcaggattcgttgattgtacatttccttttgagttttaggctggacttccacctggtgcaactcttctttgtgtgcctgccttctctaggtttgttttgttataaaaatcctcactttatggccttgttatttggaatgtacaatgtgaaatttcagttcttttgtgacaatatttcgtttgttttcttgtacagccgtttatttggttgctcagtatgcacggagtgagatcaaaaggatggaggcagtaataaactatgcttctctcatgcaccatttccttttgagtagatcccaatcagaacaatttgactcttaaacatcaaatgcacagaattctcagtttcaactatcttgttagtaaatactaaaacattgtgtttcaacttattttcgtaaatgattatgctactcatctgatgtattttatttttatatgctataactgtgtttggtgaaaaaagatagcttgtgtaagatttagttcttgctaaaatgatctcaggcaaaatcattaaaactgagtccttgggttggtggttgttccaatatcagttttgatcaagctctgttgtagggttgtcacctaaatgcatcaacgctggaacttgtcagggcatcttaaatgagtagttggttcattttaggtgttcaaaatatttgcatgattacatttagcaaccaattgatagcagcttgcctcgtacatggtgtagagagaatgataagtatgtgccgtcaggttatcactgtcactttttttcagttatatatgattctgaacatttaattgcgaagctgcaagtgtaggctgtattttggactatgtttccttgaagtgtcaagtgtcaacatagttttttttatccattccagttgcttttttcttccactgctataatagtatgtgcaacaatgcatttgtctcaagattgttagcatttcttattactgataatacatggtttggggatagtgattgttgataaattgaacacacttgaggttgcctgtttgctttagacttgcattgtgtcgaatattcaaatacttcatatgatgtcggcaacaatattactccctctagtctgaacatgactttttggatattgacatggtcttacaaaaaaaaaaaacaatttggaccataactcctgttgcagtgtctacctttaactctttatgaaacctgataatatgtttgacagcatgtgtgtccaaactaatatgtatttttggtcacagtgagtatagcccgagacattagtgtccatgtgtagttcgcaagaaaattctgttttcagatggtccaattcgccgtatgttattttgtactcatgatattcttatgataaggcatgttcattaagcatatgatgattgattaatatgatgcttgcttcaggaagcagaagagaaaaagaaaaaggatgaggaactggagaaagaaaaacagcttgaagcagattctgttaaggatgagactgattcaaagctgtcagcagttttagtccggttagatacactggagggagttgttaatgagattgtggatgacaaaaggaaaggttccgcccctggtttttccaacaaggaggaagccacaaagaaaggtgagagacaaagcaattccactgatggccaggtagtgccagtcaagagtaaggacatcatcaatggtgctacaaacgcttcacccaattctacgcaacagagccctacagggaatggagacaaggcatcttctgaccccaagggttgatgaatctcgctggttttttacgcttggagtgatacttggaatgtgctgtatgcatcagttgagttttttgttgatcaagcatgagcatcggttccatagagtagatgcagtcataggttcagttgcatcgcaccattttccaacagtgtgggactctctccgggaatggttgactccctacggtagagtagatgcagtccatagagccttgcagtcttatggtcagttttgcaggagaaaagacgccaatggtggatgaacatcagggctccctgctcaactttggggacttgaaaccccaaattttgtgtctagacattgttgatagcagttctattccaccttacaaaaacttggcacattgaggcttgaggtctgttgatgttggatgtactaactcaggattcggtttataaattactgagaagggctaacttccagaaataatgaaaggtgcttgttctgggtacatgtgaattgtgatacgtgacactttcactttcctgagctggtctatttgacaagtgtatctccgctttgtaagtaaacactaacccatttgaaggttccaatttcaagaatgcagatattgtttcattctttaatgccagcaggcagcagcttcaaccattaaatcgcctactaattcagtttgcaacggttcgtaaggaacgtttcatactgatgaagtgtctcgagcaaatagcaaatgttgtgctagctgggtgattgtgagacttgggggtagtttgccattagttaaaaaaaaaaacagtcagtggcaaatagtttcatcttttcacttatttgtgggtaaaacttttgtatatatattcttaatgatttaaaaataaatgctataaaataaactacaatgataaaatcacaaaagcaacttcaaaattaaaatttaaagtttggcttataaacataagggaaacgatggagcttaaaagtcgtaccatttcgcaggcgattagtccctcccctccgcatttccgccttttgaatggttctgtcattttaatgtgctaagactctatttagaatggactaaaacttttaagtcctatcacatgagacgaatctattgagcctaattaatccatgattagcctatgtgatgctacagtaaacattctctaattatagattaattagacttaaaaaatttatctcccaaattagctttcatttatataattagttttgtaagtagtctatatttaatactttaaattagtgtctaaatacagagactaaagttaagtccctagatccaaacaccacctaagaaaagaaaaaaggtctatgtaaaattgctagcgtttagggtctcaaattgataactttttcggtggttaagcagcagcagaaagtgttacacggtacttgtcacctttatgcctccttatgaccttacaacatctccaacagcctccttatcccattctccaagttaaactatagcaattttagctcaaattcgcactccaatagcctggccaaccggatggccaagccatccgactggccaaagtagcgctcgcgctggccaaatttggccagccaaacagcctagccaatcatgggccccacctctattctctctccctctcgtagcttctctcctcccaaatccaacgccgcccgtagcatactctccgccagcgccgcccctccgccggcgaagagagctccctccctgcctgccgcgccatccgcccagtgccgacgtcgtcgtcctcccggctccgccgtcatcatcgttgtcctcacggcgctgccatcgtcgtcctcacagcaccaccgtcgttgtactgccagtgttggccgccctagtgccccatcgtggccttctctcaacgtcgcctcgagcccgccttgcgtgcgcacggatttgcccagagcggcaccaacgggcggagcccgagcggcggcggcggcggtgaatggggacgcagcccgagcgatggtggcggcgggcggatggggatggggcggcgccggcggatgggatagggaaggggggtttggagagaaggggagaaagatgagggagaagaaggaggtgtagagactgacatgtgggtctaattgtcatagactcagaatagagaggacgaatggagaggcagttagagtaaaagacagtttgacttgccaaattaaatggagagttggccaaataaatatttggagagtcaaatttggagaaactgttagagatgctcagcctctccaaatcaaactctccaaacatttatatagccaactctccatctgatttggctagtcaaactagttactcactccaacaacatctccatttacactctctataataagtctatgacacttggggtccacatgtcagcctctcatatctattattcttcctctttctccccttcttttcctcgactcccactggagccatcctttgctacgacaacgatgtccacgcgacagcggatggcgaggggaggcataaattttacaatatttttttaaaaagtagtttatttcacataaaaaaatctataaaatatttatattccaaattcaggtgcgagttatttggaatccatagggcaaccatacgagatcggtgatgaaatggcaggtgcagtcgttgaggaagacgataggacataggttcaatttgctgttatgtgctttttttttttgaagctatggtgaaatgccaataattatttttgaatattagcaatattcatctcacgtctgcaatcatttttttttcgtcttgtagagcatctcccaaggcaaaatcgatttaaataaataaaaaaaacgagccatgtacattgcgccagtcgatttgtgattatctgaaacaaaataatcgaactctaatttggagtcgactcagagagtaaaaaaatatttattgtgcatgcatgtatggagagcagacatactgattggtggaatccttttacgtaggtaccacaaatggattttcacttcagccattgaaagaaatttacttaaatcgtaaaagcaacttagctttgcaatagaatagaagtaactaactatagcattggaagtagttatataatggatgaggactatgtgaaataaattcatatgtaaaatggaaagaaaaattgcaagtaaatacaactacttctaatacctttaagagttatttatattttattttttaagttacttcccttctggagtgtatttacttctaatattacgaagagttacttctatttttttttttaaaaaagttacttttctccagtagcgttgttacttttaatatcgtgaaaaaagttaatttttatatgatgcaagattttatttttcaaaaaacattatagtgattactttaaataaataatatatgtatttacttgaaaatcttctctacactttacttgtgaatttactccacacagtttcttattttatctcactcataatataattacttataatgctataaagagttactaatattgcatagctaagttacttctacaatttaaataaattacttttagattaataaaatgtttaaatatattcaacgttgaacttgttttgtaacatatttttgagtgtggtacaatggtgcaaataaatcttaaaaataatatacagtttaaaagataaaaaaatatacgttagtgatcaatttatatatataagtgtttgttgttgctatttttagatggtaaaaagggatttatacgtcatgtgagataaagtggtcgtgaccgtgcactacgtagccgtgtcctttttaatgtgctctaaatatgtttagaccctccattggtgtttatagtccaataggcgatataatctatattcccttgttacaggtaagaactcataataaggcaagaacagacgtggaactaaggcaagtaattagtagtaaattgatctcacggaaatgttctattgattcgaaatatcacgttgcaacactactacagatccgggcttcagtgacgggtcatctgtgacgggccaacgcaactcgtcaaagatgagtcatctctgacgggccaaaaaaatatcctctttaatatatggctaccagggaggacccgtcacagatgtgaagtcatctgtgatggcttgcacttgtaacccgtcacagatcgtctgtgacgggtcacaaccatggctcgtcacaaatgacatgtcatctgtgacaggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtcctatataaaagttgtagctctcaatgatatccacaactttataactaacaacatttctattagagatcgtttacatccccgaatatgcattacaagtgagtcagatctacttttaaaaacaaaattttgagttttttttcaaatgacatggatggatacatgccccgtatcaaagtcatagaactcaaccagatctacaacattataattgaaaatattttcatttcacaaaatttacatgttataaagtgagatatattttgaaaaatgaaattttgaattcttcaaacaaacatcagatgaagatattttctatgtaaaagttataaaacacgatgagatctataactatttagttgataatattttcatttgaagtcatttagggtgttaaatatatgttaaatgattcagacaagcatagacaaaataataacattgggtgactagtcaatatgtgttgagtaggtgagttggtaagggatctcacgtgtagcatgcaagttatgttgcatgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgatgggtcgtaagttacaacccgtcggtcaggtagttacgacacgtcactgatgactcatctgtgatgggtgacaagttttaacccgtcagagatgacttatataccagtcagagatgggttatttgtgacgggtgtttcatccgtcacaggtgattttgtcatcagtgaccactaatcactgaccaagaccaaacccatcaaaggtgagggtttgggcccgtcagagatgacctggtccggcgtagtgtaatttcatgtgtgtaaaatcatatgtactagtgtttgaaccatgctttaaattcagctaggatactgcatgcagaatttgcaatctgatgccaaaaatcaaaacgtagacgtttaagaaagtacttataacatttaaatgtattttttggtatacattttgtgatatcaggatttatatttgaaaaaaagttgtcacttcaaacttaattacatgcaagaccattaaattacggccagccgttgccaaattagtaccccccctactttctggcattcattcatgattaattgagcattatgttttatagaacaattaagagtgttgatcttttttttttcattttctaccgtaatcagtcaattgagaggaataaaaatatttttattagaagaaaatggatgaatgatcaatgcttaggatttattagagatcttacctcccagagcaggtcaggtggagcaccaaaccataattcgaacctctcctgtaattcaaacaagatcatcataagctaccacaatattaacgagcctttgtttaaatttgcgaccactaaggtaggcaaggaattttcgaccgacaaggggctcatggagacgggaactgttgccaatgccactactagaaaaaccactagaaaaatcatttttccaggcgatgacatttctttttccaggcgggtagacatctcggagctaaatggccgcctacgaaaataacaaccgtgggcgagatcgttgttcgtctacagaaagtttataagttataaaaatcaccacctacaccccttccctcactcacctcacccccattcctgcacccccatgatcccccatcaccctcccctccctccctctctccctccctccctcccagtcccgaccggaggaggggagggcggcggcggtatggcgtggaggtggggcggaggcggctccccctctctccctccccgctcctagatctagacggaagagggggagcaacgttaacggcggcggtggaggaagcgatagtggaggccactccttccttccccggtcgtagatccggccggacgaggggggtgacggcggcggcgcgtgatggtggcggtgcggaggtggctcccctcccctccctctcccagatccggctggagtaaggagatgggagggtggtggcggcgacagagacctcccctcacatatctggctagaggaaggggagcgatggcagaggcggcacagagacagtcagcgacggtggagacctccctccctcccatatccggctggaggggggagggtggtagcggcggcggtgtggccctcctctccctctggccggatctttcgctgcatgcagttgcagaggatgccgccggcagcacggcactgcgttgcgacgacgatgacgttgtttttgttagtagttttcattgattgatgttaatttgcaagttgatgttatagatttgaatccaatgctcttgtgttgatgtatggatgtttgtgattggattttatttcctggatgaagttgtgtgagagtttgtgatttgtgatttgaaaccctagggagggggagagggaggggcggggctggcgaggattttttttttggcgccgagattattttcgcaggcagggatactgtagcgcctgagaagattggaattgccgcctatgaaaatcattttcgtaggtgcctataaaaaatggggatttttacatgcctgaatttggccgcctatgaaaacgtgttttttaaaaaaaggccgcataaaaaatatttttgctatgctactctctgctagcaccagaggactccatcatactaccatgcatacgactggctgcaagtgttgttgcttcattgctaggcggatacaggcatggtcttaaaaataactcatgtacaacaaaatgctatatatatgccatcatattttttataaaaaaatagtcaacataacagcatttatttatattgtaaatccccaaattatatatatgcaattacactgcaagttttaaaattatatatatataagttgatgtaagtagatgaccatatacggttcaaaacaagaccgttcacaccttaacaggcccatcaacgatgatggtttgtaatcctcttcatcgtgtaccatcttcgtagcccataagacctaacctattttttacttatttcttcaattctatatcagctcactggtgaactaccgtatatgcggtggcggtggagccactgacattgttaagcctggtgaatgaaatgacttttactagcgacctataattctttttgggcattttaggctcctaaccatggcacacaccaacttacatagacccgaccacacaggtaccatcgtcgccaccttgttccaatgtcctatctctgccacaacttcctgcacgcctccaaatggttgcccttttgtccatgttctacaaatagtctaaggttagggttcaaaattagaagagatagtctttatatggatagaagttgtcagctgtctatgtaacatttgcaagaaaacccttcatcatgttggtaacttttagatggcccaaatcacgctaaggtttgtgcacaacttatctcctcccatctcccatctctttttcccctacccaaccctaatgctaggtcttttcttcgtcccaaccctgacaatactagatctagaggatgtgtgctgcctcaccaagtgccgccacctcccctgctccaacgtgctaccagaaggcgctaatgactctcgtgaggctccgttggccgtccacctctcctcgtctccatgtcgagcagtggcaagatgcttccatcccgtcgtcactactgcctcttaatcactccagatctagtgcccccgcctccaccgatggtcccactgccctactccaacccgcggcttcagaggagccattgccgcctcccaacccacatgtgtccattgcccagtactggttcgactaccacccgcagccatccctctaagtctagggaacccctctcttcccccctaattggttggagtgatcatcgccaccgtcatcagagttcattaatgtcattagagttggaggagaagctcactggagtacgaatcgcgaagtggatccgttggtccaaaatctgtatgagatttcggcttcggaatgaaggttagaaatgctgaataaaaatattgctttcaattactactagaaaaagcatttttcccaacgtaggggtctcattt

SEQ ID NO: 79395 - DNA, 1494 bp, Oryza sativa
acactctactcatggtaccactagtatgaatttaggtagatgcttcgccgcttaattaggaaacattaggtggttttacaactctagactttgggaatattcatatcacctggacattatggaatggtttgattattgtggaattggattcacacctccccctctattgaaaacccttaaaatggttttaggctgggctcggggtgcatggttttgatagtatcacctcggccatataaggaccggtcttcgggcctctgttgcaaagcactaccgtacttccacatatctagtgggtaaggcttagtttgtggctcagtctggttataaacaaaagtatacggatggagatggacgaagtcgggggtcgatggacatctctagggcaaatgaaggctactcgagctgtggcccggtagtcgagatgtcatggcacagggctggtgtcctgctgctaggggctcagtcctgcctacctgtcccggaggttccggccgtaggtggggttgggtcggtactcttttctatggctaggatgggttggaaactatgtcacgtctcccgtccgtataccgtgatggtatgtggcacgtggttacacataaggaagatgtgtcttgtgggtaaagatgtgcacctctgatcagagtataacctattcaaatagccgcgccctcggttatgggcaagccaagcaatgtacccaagttagtgttttaattcttaaaacctgcttaactactaaaatgtggaatggctggcctgggttggcttgagacgagctgggacccagggtcgggttgccagttcggtctgaatcatcgtaggccttgggttaaggcaggttcgtgtgggttcatggccttgattaataatattgtatagctctagggtcgtatttacaaaatagctttgagcaaccaagtgtcttttaatgctgtttactgcaaaccctaacccctatattatggctcccttgtactcccttgcatttattctgcacttatgggtgtgtcttgttgagtacggtggttgtactcagtcttgctcaatttttcccaaacccagaagaggagttcctggaagatgaaggctttggtgtctagctcatgcctgccgtcaagcgcctgtggtcgtcgccctagtcttccgctgttttttgtttgtcttcttgtgtgctgggccttcgccgcccatgtaataaattaactatttacgcttccgcttgataaactctgaaatgtatcaacttttggtgtactttgcctcctgggacaaggaataatacacgcacgtaaggaacgcccgttgggttatttccggtcgtgacagatcatcacttgatggtatcagaacctccttgaccctagaacgagctttagatcccaagccttagcaatattttcgaaataaaaatccttccttatttgtgaaaatcctctagtctctctctgtcctgctgcttcatttatcgtcaaaatctgatctttaaaa

SEQ ID NO: 79396 - DNA, 19108 bp, Oryza sativa
aggattcgagctcgattcggattcgtttttcctcccgaaccctaagctttccttcgccttcgccggccgccgtgggcctccgtcgccgccccctagcccctataaaaggacccccgggacctcctctatccgccgccaccctcgctttagctcgccaccgcttgtagtgccgattccgcgtcaagtcgtgcgccgccgccgccgaagggagaccagccgtgcaccgccgccgctctggtcattgttgtcgctcaggaaggccaccgtcgggatcgccaagtcgtcgtcgtcctcgtccagccctccgtttccgccgaagaccgcaggagcaccgccgtcgtacgccggcgagcgtgagttgccaagccgccgttggtgatgacgtcatcgccgacgtcagcattgcgttacccgtagacccacggtagaccgattagatctcggccatccgttttggattagattagatctcggccgtccgtttcgtaggccgtccgttttttggtgattttgctcttttctgcttagattccgaccttcccggagagtctgattttgcaggagaagactttgaagagttccaatgccagcaaggcaagtcacatagatcccaaacaaccctttgagcatgttgatcctgtttaaagctattgtttctatttaactattgcatatatttttgaatgtcattgggtgggaatgacctattgcctttgttatagcctttttgattattgattatctattctttgtcacttggttaataattggattagctagaacattatatggttttagctaaagtgctagaatgcttagccatgcttagagacactagctcgtataaatggggtatcttatgattcactattatttaatgatggcttaatgatagctcacgatggttgatcgtgattggttaattaatcaatttgccaactaaaacctgacaatggtgggttgtgagcacatggttttgatggtcgtgctcatgacatttaaggaccggttcacgattttcggttgtgaaacattaaccgtgccaaccattagccagcgtgggcaacggctttactttttgtataatatggttcattgtagagcaccagactatgaagtggcggagataagcccacgggggtcgctggggagtccatgccttgtttataagggggtgattatgatctaggaacggtgcactgctttgaattgtgttatgcagagggtattgtcaccatctctattcgggtacttggtaagtatcgcgacgcatggttgacatgttgtggggctgtgtcttgtgggtacagtggtacacctctggccagagtaaaactattcgaatagccgtgcccgcggttatgggcgggtctaacaatgtctttcgtgattagtttcacacttctcatcataataaaagatgctataactggtaataatttgattagctcctggtttggaatagtatattcctggtttggagatagatctgtacagccgggtatggttgttcgggatggttgggcctgagcagcatgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatcttattttttttccgctgcttagatctttattgattgagaggaactatctacctctgtaatgacattttattcgcttattaattagagtaataattgtattctattatcaatttcttattgtgtgcctcggctgattcctggacgagggttcacacacatgtaagcgtttggaattttggatagaaattccgggcgtgacatcagtcctgcctacctctcccggaggttccggccgtaggtggggttgggtcggtactcttgtctatggctaggatgggttggaaactatgtcacgtctcccgtctgtataccgtggtggtatgtggcacgtggttacacgtgaggaagatgtgtcttgtgggtaaagatgtacacctctgatcagagtataacctattcaaatagccgcgccctcggttatgggcaagccaagcaatgtacccaagttagtgttttaattcttaaaacctgcttaactactaaaatgtggaatggctggcctgggttggcttgagacgagctgggacccagggtcgggttgccagttcggtctgaatcatcgtaggccttgggttaaggcaggttcgtgtgggttcatggccttgattaataatattgtatagctctagggtcgtatttacaaaatagctttgagcaaccaagtgtcttttaatgctgtttactacaaaccctaacccctatattatggctcccttgtactcccttgcatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgttttttgtttgtcttcttgtgtgctgggccttcgccgcccatgtaataaattaactatttacgcttccgcttgataaactctgaaatgtatcaacttttggtgtactttgcctcctgggacaaggaataatacacgcacgtaaggaacgcccgttgggttatttccggtcgtgacagatcatcacttgaccgacgcgctgctccacagcctcgctgctcagacatgttaaacgggaaccaactttcgccaagatgaatacgaaaaagataccccgaggagaaacccgggtcgcgtcatccgacccgaaatagttataggctggatgggcccgagcctggagcggctggatccgcctaccgacgaagtctgcagcgacttcatatcccgacaagccccgttctcggagatcatcgatgatgtcaataaatgactgaagagagggggtcaaagggggtttggctttccaggtcggaatcttgtccggttgatcctcgggaacaacgaagacagggttcgagtccttgatctcaagatagaaccacctgttccgccacttactacgggaagaaggacactggaaggggatataacgcgacttcatgccatcacaaagtcggaacctgacgcaaccagataccctattggattccatccaacgcagttcatagtagaaacggaagagatcgagaaaaggctctaccccaatgtaggcctaacagagatgaacaaagatactaagaaaggtgatggaattaggattcaaatggagaagagaaagaccatagaaattcaacaccaggagaagaaactcggaaggtggaggaagaaaaccgcagagaacgtaatcttcgatcgcaactatgcgacccaagaggggctgaggatcagtacctcctacttctctctccatgtctccacggctgggaagggcgccgtcctcctgaaggttcttcaacgtcgtgccggtggaagacgacttgtcaagatccattgctgttccaagatcgccggaaaacaagcctgagttggcgaactagggtttcttgcggcggcggagaaggcaaggagcgctggcaggcggtgtgtgttcaacaaggttggtagacttcaaaatgagctcccaaaattcctttaaataagcgcactaccgacggtgcaaattccaaggaacgaagagagatccccgccggaaatctctgggcccgttacgcgcggcagttttctagacttcagttcaaaattcactcgtgaccgttgtgcttcaaacggcatgctcgactatgttctatctccgcggtcctcgcaccaggaatgacaacgttctcgacacccgaagtcgtaaatggttgcacgagttcattttaagcagaagtcgggggctactgtcagggttacgggtcaggcataccctctacccttcgatatacgttacatatcgacatggcatacccacgcgcacgcagatgttttctacatatcctaaggaaacctttcacgaaatctacagatgggaagagtcattctcggacagaactgggtcgtcgatgtatcgtattgggtctgatatctccgagtcctacttagagacctccagatctgtgatataagagggacccccccggggagggcatagatcatcgaatctcagagccaacacaatccacacagcctacaaagccgaagtctacaaggagccaagtcatcgagagctagtcgaatccactcgactacgatctcgccggatccgacaagttccatcgttccctttgtaatctgtgttttccaccatataatcccatatctactggattagggctattacctaccaaggggcctgaaccagtataattcttgtcttttgattgttcgatgtcgtactacgtagatccttgtaccaacgtaccccaataccctctatatccggtctacgggtatcacccgtcgacagtctccaaactctcaaaatgcatatacagatcctagaacttgtcaaagtgtatcatctagatcccaaatcgacacatcccctcttggatcctacgtggcgctgatgtgacctgccacatggacgtgacgtgtccttttttttcttcttttttttcttttccgttttcttctcattatttttttcctctctcctactcgggtcacagagaaaagagaagaaaggaaaatacaacagaagaaaaaaaaagaaaaaagaaaatttttaaatgagtcccatttgtcagtcaaaattatgccatgtcatgttcgtgtgacatgccacatcagcggcacgtaggatcctgaaggagctgtggcgatttggtatctagatgacacactatgacaagtgttgggacttgaatatgtattttgagagtttaaggacctagataacacaccgctacaaatttaaggaccgcccatgcactttactcttctagaaataaatttatacttaaaaatataattttagagtactacttttttctgtaaccaccttcattcaaatttctcaaagtcttattcaaaccctcccaccgtagccacagggtaatctatgtcatttttttcctattaaattatcttttgagtgcgacattccttttaatttgtcattttagtgtgacatgtttattcttttaggatggagggagtaggtgatgagtatatcactagcttggatatgaccatggctacttttttattcaccaaccgtaggtgcatgcttattatttaagttttatgtattatatatttgaacaaacgttgctgcactatgagtcctgtatcctctcatttgcagaaatacttgcatgggaaaaggaaagaagagcgggctcacaaagtgtttggatgatcaaagaagttgattgggaccaaaccaagatcttccccaagtctactcctaactcaccccgtcacttttggttcatatatagaaagcaaaagatgaagttctatatgttttagattcggatttaggcttcctaacaacatcaatttcaaatggacctagctaataatatagaacaaatcttgagaccccatgagtacttgttggaaagcttatggagtctaatttcataaggttttagtcttacgtcaaaattcctactaagttattgggaatctgcaaaacaagctacgtagcttatccagtctgagtctattttgaatcttgggctttttaactgtgtcgtgtgctaagcccaaggcggtgtgcgccctagggtaaccctattcagtggtcgtcaagtttagagtgaggttttgcttagattatttctgctattgcagtttcgccactagttcggtttgtagaaccctaactttgagattttaatcattcatctgcaaattgagttgcaatctacctttttcttcctcgtgttcttcgattcgcatgcagagattagccttctcagcgaggtcaactgggcggcacacagttaataaccagaggagacatggtgctgcaattgcagggttcggatcatgttgatcagaagctagatcgtgcgtgttaagtttttgtcaaatcaagagttatcaatacatatcagaagatcgggatctacttcctcatcggtaagttttaagagcggataacgaattttctagatacataaatttagatagaataagtttgcattatgttttaataagtgcgaagaaaaatgtctaatgacgataaatctgcatcccatccgatggaggggcccactttcacatagcacatcacttatacttttgtttttgctttgtgtaaacggattagctggggagtgctatggttggagggataacatgttaattgattcttactcttagctctactagcaaggtggcagtaatcaagtacacaaaacactcatgaacatgccacactctaattgggctaagatgtcataatttttcaaatgataatatttattattttcgcttatattagcggtcaaagtttaaaaggctgcgcagtccttttaggaagtagcagcgcacaataaaatatggaaaaggctgaagtgtggaaatgtccctgtcttctaaagggtattgcattagaaaagcaaatgtatgtaactttgtcttacattttatttatccagtatgttccccacaaagaaaaggcttgttaaaaacaacctataaaactacagtagatatgatactctcttgttcactactgctttttttttccctttttgactggtttaatacagctttctttgaatgactataaataaagtgtccttatcagagaaagcatgtatacatgcattgtaactggttcacggaaaaaaattaccattcatgcatggataacaagaggcgacaataagttgttgtctcctagcaccctggcactttattcctttcaaaaagaatattttatgaaccatcatgtgcattgtactccactaacccattttcacttcacgagcctagtaaaaaaaccggaccggcccagctgttgaaccggaaaaaaccggaaccagctcaaccggacggtctttggtgaaaaccggcgaatcggacgcctctgaaccggcggttctggcgagcacgtggaccaggctacaaaggcccactaggcccaagtcatgcatgcgtcgtttttagtgaataaatgaaaaaaggatgggcagttgaggatcgaacccgggttgccgtaataaagctcaacaaataagccagctagaccacttgtaaatgctgttgaatggagaatatacacgtaatatgactgctccggttctgcagttgaaccggtcgacccagcggtcagaccggtgagccggtgaaccagatgcttgaccggttcgatggccggtccagctttttgcactatgttcacgaggctgtgttccggatggaaggatgggaatttctctaccatacatatataaaatgggctgactagttagcacattattaattacgtattagctatacaaacttaaaaatacattaatatgatttttaaaatgattttttatatatttttttttaaatagacacacctgttaacgacgaaatttgctaagcccaaaatcatcctcggtttagagtcagtttctgctttagagttatggaatcagccgatgggaatcgtcaaatcaccagcaaccgtgttttcgatggagtcggatcaactaaagggaatttatccagaagagtccgagttcaagaaggatgcagcatggcagtttatctattaattaagaatagtttgttagtttacttttatccttaggaaagtgtgtttagtgtccgataaggactttatgttttccttttatttttaggaaagtttctttcttattcgacaaggacttgcatcaacccatggatataaatatgtacacccggggtcattgtaatggatcaatctcacgatcaatataattcggtgcatcgccaccttttaccttttctactttattttatcgtccggcaggacttggcacctgacgcggagctgcatcggtgttcgatctctggctaaggggtaagtccaatgttccgccggctcaggcagttgtatcgtttacgtcggcgtcgttcaaggctgcatcagtacattcgacctcttggattactctggtttggatggtatatttgccaacctatttatcatatgtctctgttaatctagtcttagcatatcaatttagctctatcggctgcttctcgttttagggtttctgccggtatcggctacatcgcgttgctagattagattagcttagacatctaccaccctgaaaactcagtcaacggcttgattgtctagatattatgtttcttttcatacttagtgttgcatcagttaagtttgatctactaagtcgtgcttagaaccataatctctagcctgcttcttgattgccaataagggtttcatcggggtttaagcagatgagttatctggacgttgcatcggcttacaaggattgcatacgtattggatttagccgattgcgataaaggtttcattgattaatctaatcgttttgattttatgacatcgaacctccacccgatgtatgctttaaccttcggatcagtgcttattctatcatattgttagccgattggtttatactggattatattgctatattgtattatcatcagccgattgccttcatatcattatatacattggacatatagccgatagctcaaaatcctattgctatcggctggcattggcatcggctggaactactacatcggcttgtcagccgatcggctatttgatctagtgtttacatatctcgtcagttgcaggatcaaactgactggcacgcccgcatctcaccaacctttggacctgcactggagctaagtagatctcctaggccagtgtgtgtttttcgcatcaacaataccgtttagcagtttgaaaacatacatatagtaaacgatatagtaaacgagagagtaaaagttagaaaagtgtagtttagaacatagcgtgtgtgttttcttccttttttccaaattctacccactcattttttttttgcacgtttcccaaactattaaaggtgtgttttctaaaacataaatctatagaaaaattgattttttctaaaagatcatattaatctatttttaaagtttttttaagctaatattcttggatcaaagcttcgtttcacgcgagtgggggattagctctcaacatagtacaccatttttatcaagcccagcccattaccctgccactgtcttcttagttaggccttgtgtcgaggcccaaatctctatcccgtcgctagggttaattttagctctgatttctggctcatccacaaagatggcccagggtttcaggctttttaaacctggccgaaaggtgtgattaattttcttggcctaaggtctgacaaagtccatttgatgtgcaatttggaataagtttacttttgtgtcccttaaataatgtcctcaaaccggatatctcgaactacaaactattgaaaccggtgcaatttgattcccttgatggttttggatggcggttttgctgacgtggcatcccagtcattaaataaattaaaaaataaagcgggcccacctatcatctctctctactaacatatctcacccagtcaaccatctctctctccccttcttctcgacgtgacagtcgtagggtgctagggtgatgatgggcggcggcggggctctcctcccacctcggccctttccgcctcagcgctggtggcagactggtcggccgagcagggatgagaggcgttggaggagattcggatatgcagcttcctcgccagaagtcttcaatgggccgcggcggcgagagggggttgaggcaggtggacagcttgccaaggtcgcccatggcactggcatcgagggtgtcgctagccaagaccgagtcggcagtcgacacgtaggagctcggcgtcgtggaccgggcgtcgattattcatcttcaatgcgaggacgtcaggaggagggggtagcgtaggcagtatgccccgcccacagaggcggtcctcaaggggtgggcaatgaggaggggtctcgggcgcggtgcggaggcgagcggccacggccggggcgacgctccgtgtggtgggtcgtggcatggtcggctcgcgcgtcccaatccgtagtggcggtggtgctcaataggggcccgaccatctgctgccgcacctgcgccgcttggttttaaggtggctgggcagccgaccatgcatgcctacgcccatcgacacggccttccctaaccttcaggagctcggcatctatagcatcggcatggaaaaggagggccgtgagatcgagttgctcgtggcgacatcaacatccaaggagggtcacccaccgccaccgctccggccatctctctcactcaccaccgccgtcgccggggggggcttgtagtaggcagagatggggaagaggcggagctggcggagacatgaggtggagcggcaacagcacaacctcaaagtggagtgcggccgccatcacgggagccgccactgctatctcgggcgtcgcaggctgcttcgcccttggctacttcctcaccctcagccggtctactcccgctagctctgaatctattgttccatggggagagaaaggggagtgagtaagagaaagagagagaacaaggagagaggggtgaggaagaagggaagggaaaaggaggactgacatgtgggtcccacaatattctttttgtgaatgagaaatgggtcccacacattttttctaattccaataccacataagcaccacgttaacgccacataggatgaagaccaggtcaacgccgtcacgtagtcaccatgtcagcgaaaccgccctccaaaacagctgacggagtcaatcgcactggttttaatagttgaggggtcgagatatccggtattgtggttcagggatacgaatcagatttggcccagtagttaagggagtcaaagtgaacttattccgtgcagttttcgcacgcttgtggtttgccttacccaccatggctagttatttagtgggctatatatacaaagacatgagtttggatggtttggttattgctcctactagtcgaaatctcacgctttgctgcaaagcacatagatgattattacctatatgttacataaataatgtatatatgttgaaataatgtgaaaataatgagagaatgatgatttgacatgcttggagtaataaattatagataataagttatgtttgcacgagtcttaaaataccccaaataataattgctagtgattgatgatgtatcatatttatatttgtatgttgagattaagaggtaatggataccaagtatgcagaaggtatagattggaggtataaacatgagaggacagctcggactacggttacacattgcaccaaactcatatgcatcaaactcatatgcatgacacgtatatatattgcaccagccaccaggcatgggtccagtccattactccctccatcccaaaatataagatattttagatggatgtgaccatatcctaatactatgaatctggacagaagcctgtccagattcacagtattagaatatgttccatcctcccaaaatctcttatatattttgggacggagagaatatatcgtaatgcaatgcagctgtaagatgtacctactccgtttcattgctatatagaggttgtgttagatgtacctactccgtttgattgcaatatagaggccgtgtttagatttagagatgtaaagttttgatgtgtcacatcggatatacgaatatatatttaaagtattaaatgtagtctaataacaaaacaaattatagaatccacctgtaaaccgcgagacaaatttattaagcttaattaatctgttattagcaaatatttactgtagcatcacattgtcaaattatggcacaattagacttaaaagattcgtcttgtaatttacacataatctatgtaattaattttttttatttatatttaatactttatgtatatattcaaacattcgatgtgacagagtaaagtttgtctggagttctaaagagacccagagtacaagttggcttgcatccatgcctcctagagtcccagtacacccgcatgccacacccatatcctgagttcctgacaccaatgtcatgtcgtcatcactagaagctaaatctcattcataaaatatttttttcagtttccgtgtctattgtgtatatgatttgggctatatcacttgccatgaattgaaataaaaaaacacgcggctaatatttttacagatatatgtcattctaaaatatgatttagttacaatctacatagaaaatatatcaaaacgaatatccaccaaaatatgatatttgtggaagaaatgacattgtgcaaagtgatgtaaaaatgatattgcaaaatgatatatcacttgacatttattaaaaactaaaaaagtacataactgatatttctacatatatatgccagtacatcataaaatctactttttccaattgtaatttttttgcgaggaattttccaattgtaattattatagtaatgtaatatatgcgaacacatcagaaaatctaagtttaggagaaaatctaagtttaggagagtatatagactttttccaattgtaattaacacagtaatgtaatcagaccaagttatatgcccagggcaaagagccaatttcaagatttgataatagcacttgaacatacaaatagatttgaaactaactagcaatattcactcacttaaatatataaatagatttgtaaaataatttttcgagagtgaatgtcaggtccttcggcggagcagtctttcggaaggctttcaacagtgtcttcacatttctgtgcatctgaggtgaatattgctataatcaaagtaaagaaaaaaaacaaattaaattactagtacacgaactaaaccccgatcacatccacatccttatttatggaggaatcagtgtaattccctgtttctagttggtcaaaaatatcagtgacacttgtccaggctttagtaggatgaaagtgtgagaaaagaaaattgacacctctatactaccctaacaagtggctagaacaattaaggaataaaactgtcaaacagtagcacttatggggtgttttttttaggggtcctagaatccacaatctccctgggctaaattctataacaatctgtagaagctagctgagaaaataaagttgggtgggaattacccaccaatgccaccggtatacccccaaagcccgaagcctctagcattcatctctccacccatggaacaagcaagcacgggagacgggaagaggcaacgggggaaacgggggtcgcgccccctctagcacggcaaccatcgccagatctggccatccctcgccggaaaccgggatcccttgccagatccggtccttccccgtaggaggcgaccgattttagcacgcgagggagcttgggcaggaggcgctaggtggctagggttttggggctgttctaggaagagggagctcgcactggcctacttcctcatcaactctggcgctctgctgcttcatcgtcaccaactcttgcggtgtcctgctccatccccatcaactccggctagtaggatttgtgcaaggaaacaaatcctttgaaaaaattgcacaaatcaaacacaaatgagacatgattttttttcccgaagtttggattacaagaatcctactctcaattgaggaactccgaagagctgggtctcaattaaccccttgcctcaccgtgaaaagccctaggaggaagtcctcggtcttgaatccaacatttctaagtccatcactagaattcaagtgacaccaagatccataacttgaactcctagagaatacaagtgaggattactctaccaagacaacctctgatagctcagtatggatctttactcaattacctcatttccttgtgtaggtgaggaagaccttaacaaacttcctgggtcaatccacaaatcgatggaagctcgtggacgacacctatccatctaagaggtcaccctccaagagtaatgtcagggttgcggataaggcataccttctatcctacgaattatggaatatgccgataaggtataccttcacgtacacagattgtttccatgcacaccgtttgggatttgtctcaaattatggaaaatatctctacaagtcaagcgatttccatagtcctactcggaagggatagaacttctgttataccgtatcgaatcaaatatcctcggatctttcttgggggtcaagatgatctacggtataaaagggacccccaggaaggggttcaaggcatccaattctatcgccgacacacccaccatagtttactgaagccggagtaccgaagccaaatcgccgggagatctcgtcgaactcatcgactacgatctcatcggtatcgtctatttcgactactctctttgtaatcttttctcaccatcatcaattccatataaactggactagggctattacctgataaggggcctgaaccagtataatccttgtcttttgtttgcttgatgtcatgctacgtagaccctcgttccaacgtaccacaatactcaactcatctggtccacgactatcactcgtcgacaagtaataagcaccaaatagcggcccaacgagaatcacgacgtgctcaagtcatcctagccctcacaccatcaccaatcctcactgccaccctcaatactcacttatctcacttgggagactcaagaacagggtggaggaagcaagaacaccatgagagaggctagaggaagttaggagaaaaaaaacggaagtggaattgccaaaaattgagctggggccagtgacgaagccaccgtgggggctggggaggcctggcaccccccatgccgccatgcgacaaccccccaaggtgattatttactaatgggactaactatatagctgcctaggttttagcttaaattgttacgtgggttaactaactgaaagttatatgtggttgcaaacctcaaattaaaatgatgaaaagacgtgatgttgaatcatccatatactaaatatattatattattgtatttaaaatagatgctatttaatgatctaatttaaaattagtgatcatccatatattagtagacatatacttgtaaaaccacatcaacaatcataatttccataactataaaggagcgattaaacatatcatacgtaattgcacatattaatataaacaagagacgattgggtatatctttctcttctggctaattgctatcatatgcatgataccgaccacacattacactctacagcattgtccatcgagccgcaagtgagctctctcatctcatagagggcacccccaatctctaaatcttggcttcgcccttggctagggcgagctggagaatatataacggctatatgacatcatgcagccgttactcacatttttgaattggaaaggtgttatgaacttctaggccggggtgctaggaacttccggccaacgcttaggaaaattctataggagtgactggctaggaagttccgggcaatgtgccaagaacttccggccagcccttgctgtcccgaaaagcacttttcccaaaatttgcttttaaaaattttcttctatggatatttactaggggtggcaatttccccattgggccggggacccgcccctacgaggctagggatgggggataattctcacccatggatgagcgggggtggggacgaggatgggagttgacccgcggggccccagaggtatgagttacaaatcaaaaaatagcacattctaagatccatttggtccattaggtgaaggactacataagcaaaaccctatattttccaaaatattaccaaacttgcgcgccattctctcctctctgactcacgtatctccctcctagcgcgctacccctagccaacctacctcttcgtcgcgcaccgtccctagctatcactgccccgagccggagctacctcttcgtcgtcgtccccggccggtgttgcctcttagcgctgcatctggacggtgccgcctcatcgcagcacgccacccccaaccgttgttgccttctcactgttcaccaccctcggctggtgttgcctcctcgcaacacgctacccatagtcgacaccacctcttcatcgcagctcctagccggtgccaccacgtcgccatcatcctcggttgtagacaccttgtcgctgccctcaatcatcaccttgttgtggtgcaccgcctctagccgccgcagtaggtgccctagagttgctacccatgtgggtggtacggggccccgcttacccgtcgggtcccctactggggcgagggtaagggcgggggcgggggcaggtgaggttttccacccggtggacaatgcggggagcgggggcaggggcattcctgtccaacctaatcctgccccgctgccacccctaatattcattttaagcacttagatcatctcaggcaactagagataacaatgaggacccataacccgagacccgacaggtttttactctattaagagctaattgtgttctaactcttatacccatgggtctactggcgggcgaaaactcttacccattgggtacgtggatatgggtctattctagctttatccacccgtatccaccaacccgtgggtgaaaaaaaaactcgttgattagcaaaaaactatgagcaagtctcaacgactactatatcatagcataaaactcctttcacatcttaacattgttctagtctagttatatgaaattatttttcgatttcttgattatgtaatgtgtttgtataattttttttactcgcctttgaacgctaatgttaatagcattgttgctaaagaaaatactgatgatttacaactctaatatggctaattacagtaaaaaactataaatgctacaaggcaattatataggtatgggtacccgttggatacccgttacccgcacaggtgtgggtatggggacgattttgtacccacgacgggtgtgggtatttaagtgggaatatttagacatcacgggtgtgggtatggggcaagggaacccaatgggtatgcacccattgccatctcaacaggaaaccatttgaacccctcttgatattacggtttttcctaaaactcaagatcaaaatgcaaacagttttaaatagctctccgagtctttgtgcatcttgcagttgttgttgggggggtgtcctcctttgcacattatcgcacacctcagcaccaggggactaattgcctgcacttatctcaataaacacattagtcccttaaccgttttattattaatcaccgaaacccacttatgggactagatgcactttcaatggtccctcccacactcacagggagtggtatccagtggcggtcagggccatgcagatcgattgtcgatgccaccattggctggttgcttcccaaaaaagaaggcatacccggctccacctaatcatggtcgatgctagcacttgccgtgccccgcggtaacgaaatccacggcctcaacatcctcgaccctggatcgcaccgagtgttgtgtggatccaggatgtaggacgaggtccaagtagtcatcttcccaacgccgccgctcatcgccaaaaacgacttcctgtgtcttccagtcaaatacatgaaaagtggatgcaaagggtgcatgcaaattaatcgagtgccaggagaaccacctgctactggtgggggagtgtttatacctccaaccaccaaaactagccattggggccaaaaccccaacttaagaagcctgcaggtcacattgcaaaggggtggccagtcagatcggcctccaaggcaatagttagaaaactagtcgttgtcgtgcatttaatgcatcaccaaaggcgttggctggtcaaaccgctgggcaccggtggctctggtcagaccaccgtcggctctagatcacaagccatggccatccaccctgctccccaagcgctcggttggcctggcttgggcagattgaccaagacatgttgatcagatcggctttattccacggtcagaccgggtgtagatagtgaatatagataaaaatgaattgaacaaagtgaccttatgcaaatgtgctaatgtggaaattttgatcatatctttaccatagctattacccttgttgatagtacggcaaagctagaaaaaaaacctagcaaaatcgatcacccaacacctcgatcgatgaagacgaaaacctagattaatcaccttcacctcattgttttgcgccattaattttaaatccatggtaatcatccttggcatacacatcatgtggttctaactcatattacatcactcaaacaaaatagtctgtccacaattagcgcttgtcattaaataccaaaatcaacgccaggaatctaaatgcttcagaaaccgagtccacctagtttgaaggcgagtgtgcgagtggggaggccaaatttcacagtggagtggggtgataatagttagccggtctcccgaccggagaaggaaaaaggcttgacagatggacccacccccacctgtcggctgcacaatggggaggagatgccaagcgggctagcatgagcgagctaggctgtgcagagagttgggccgcggaggaacaagatggcgactagctggaggaaggagggagagaaaacgggttggactagctaggccgacgcggaaaaagaaaatgaagagaggccggaccaaaggagggagtaggaagcaggccttgcacgtcaaaggagaaggctgacgggagagaagacgatggaacttgggttggattccgcacggattgaggagaaggattt

SEQ ID NO: 79397 - DNA, 4952 bp, Oryza sativa
ccgcgcttggcgagggagcgctcccgcttgtgcgcgttctggtgcccccccagcgcctgcgacgtgtagaacttgcgctggcagtagttgcacttgaacagccggcgcctcgcctcgccgccgccgccgccaccgttcgccgccgccgccgccacagcagaagccctctcctccacggacggcgccaccgcctcgcccaccatcacgacggcggccttccctttctccgccggcatgacctcctccgctcgcagcgcgccaagaagatcgagctccatcgccgccgcagccgccgccacctcctcctccttcttggccaccacctcgccttcctccccatcaccaccaccaccaccactcccctcaaccttcatcgccacctccatggacacggtggtctgcgagctggaagccatggagctagcaaaacacagcacaagacaacactaatttggctttaaaatttttgctggcacgagatcgagtgagatcgagagaatacgcgttcttgggatgaatcggatccctacttatacaaggggattggaggggttaaacgcggagatgatctgagaggaatggaagcaaagttgccaaatgaaacaagatatggcgtgatcacaggaggcaggcgtttaatgtagcagagagagagagagagatgagatatgctccatatcatagccccttaattcgcatgcattaatcttcttctcttcttgtgatgatcgatcgatcgatcagtcagtactccatcttagccaacgatatttctctgtccatccactccatttggttccctttctcactagtgtagtgcaaatctttgtctctatctctctatccttactgccactaaaacacagagcaacaggggaacggtttcctaacttggacagatatgggtgtgtatgtatggagtttttgaactggagggatgccttgacgttagttcaagatgtgataggatgtgatatgtatgcacttaagttgtgatatgtattgcactctggcagtagaaattaatttaatgccaacttggcagaatgtgaacatggcatgacgtaagggcatgaagaaatggtgtgacgtcagtaagtcacaagatattttgttttaaaatgttgacatgaaaagattatatggacagcctaaattaggtaaataccctgtgagaactggtatataccctatatgaactgctacatgcttactccccctgtttaaaattataaagcatctccttattttccaaaaaaatcaacatttaaattttttattagtaattaattgaaccaaaaatgcatgtttttatagtgccacgtaatatcacaaaattgtattaacaaatattttatacgatcttaaatctgtagttgttggtcaaagtataatacaaaggtatcatccaaatattccatgacaacgcagggttaatgtagattatgcagtaggagcttaattttagggatttccaattaacttgtcttcaattatttcgatttgccacttcatctagagttctagaattaaatttccattcctcttatggcttcatcttcagaatgttttgtcaacctcaatcaatttaccgttacacaccactctagtgctataaaaacgaaacatcgacagtatggtgacactatcatatatatcgaaaaagtccaaataacccccaccccctagactatgacagaagtccatctaacgcactatagtttgaaaccggacattcaaccccctaaactgtgcataccattcatatatatatatatgcccccctaaggtggttttacaaattggtttttatttaatttgcatatacgttggtggagctttgataatgtgacatacacattgaaaatatatgttaaattttcacttaaatctttgtttttaccccttgttcgctcttacatacaagaaaagtaccgacgtaacaattaatagtacgacatcactgtacatgataaattgagctacaattggtggtacgtaaatatattatattagttgtttaaagccatgtgtttaacatcccaaatacgcaaaaccattatccaaaaccatcttaggggggaatataaaatgtattgtaaagtttgggagattggatgtatgtctggttttaaatttaaggttccaaatgacttccatctaaagtgtagggcgatatttagacttgtccgtccatatattttaattacttaaaactggcatatgaggcatttatcattcatatatatgcctagtccagagtttaaaaccaacacatatgaatccatatatatgagctgattttaaacaacattgtatctatatatgatgtttgcaatcttatatgtgccgccggttttaaacaacattttatctatatatgatgttggcaatcttatatgtgccggtggttgttagaaccgacatataatagaaaggctaccgcaaaaatcaatcaccaccatatatttgcactaattagtttcttttctggttccagcttacaatgacgacatgagtacaatggtctgtgcgtgttgcgtcttatgtataattgtaaagaatacattagaatttgtaataaagggcaataaattatgttttgtaaataatgaagagtaaataccggtttgttttcccgataatggacatttgtcctgtaatttttttcgtgaagctagattttaaaagtatagttatgttatttctcataaataaaattatacttataatcaactatatatattattttataatttcatcccctgaaaagttttttccccattttgtaggggggtgactactattccgaaactttgaaggacctgacgattgacgagttcaatagttcaaaggttaatcccatccctaattcctcgacccgtctccgttgagttcttgtagatggttgtgaggctaccaagctatccatatgagtggtccaagtttgcatagaatccctgggggttctatatatctcgatccatgtgttcaagaattatcagaaaattttgtttaaaaggtttaaggtaaaatggtaaagtataagcataattttaaattatggatagagtatcaaatttgggaccggagtatcttcatgctcaaaaggatgatgtcctagattacgtatagttaaacctcagaattttagataatcaatagatgcaaaaatatcaagatttaatatattaatatgatattggtacatttatcatgggatttttatatcatattttgcaatacatattttatcactatatgaaattttaaattatattagtaaagtgatcaatgtattgcaaagctgaccagcatgcagtacattcttaacgggtaatgaaagaaaaagatggaatctttttatgatactagagaatactatgtgccttgctgcgggatttgttaaatttatcatgacaaagattgaaatttaaaactatcaggtgaaaatgttgcttcatggtttattaagtatcctttcatagaaaatgtatgagaaaattccttccattcccctaaaattttagtagatcccttccataccttaaattttcttcactcatttgttacctctgaattttaatttggatccctctcataccctcaccgttaattaaccattagttgaccatttaataggtgtataaaattcagttttacccttcaattatgaatataataaaactatacgtttccaacaatatagctactatacaagttttcatgtttttttcacgtctaagggtaaatggtccttttataggaatcaaacagtcaactaatggtcaactaatggaatggatatgaaaagggatcaaaaccaaaattcaaggatagagggagtggacagaactcgagggtgtagaagggattgactaaacttttaagagtatagaaagaattttctctaataattgtagaacaagctgtgcactgaaagaaacaagaatgataaatgaaagacagaagatgataggaaatggaaacacaagacaagacgagctttttttgaggtattggagattcagcaatcaccattaatcttcattggagcactctatacaagagtacaagagtatagctcccttccataccacaaagtccatagccactctcatcatggtggatcttttccaccccgtaaccttcacaaacataacgggtctcccacaaacttcttgagagatcatcggatcacctccgagattggctaggcacgctgagataccaagaataataggaagaaaccttaacttgaagcccttaagaaccatactcttggtttcacagtgaaccactctcaactcaactagaactaaactaatgaagaaaatgatgaaaattaacgcaatgatgctcttagactatctcttcagttgctcaactcaaataggtttcaaaagacatcaacaagtccatggcaaggggtatttattactgtttgaaataaacaaaccaaaattgcaaggggtcgaacaatcttgtacaccaccggactatcccaccctttatatttttccaacggtaactaggcaagtagccattgggtcattaagtgttggacaatctggcaccatcgagattgtttgaaactctttgtctggcatagtggtggacaatccaccgcgttcaaaaccattttccaaaccagctggatgaacatgcggccagattgtcagacaccctatcggattgtccaattgttgccagatcaacttagtctcggacactccgagggctgtcggacaatcaggctagttcaatttctactatccgatcaagacatgaccatagttggacaatgaactagccggacaaccacactgaattgttcgatcaagttgctctagcaacttgcccagggtttttacccaattgatctagtaaattgatttaagtcactagcaacctagatctaatgtcaccgcacatagactctagcacttttg

SEQ ID NO: 79398 - DNA, 47531 bp, Oryza sativa
cagagcgtgcagcaggaggagaaagaaacctagttttcaaggccgcaatgaagagcaagtaccatctagaaaaattcaaagagtaagtaaatgactgttaggttgtactcctaccatgcatcagttaacgttgtcattgcaagcacatttctactccatacaacatacagggttgaagggtgttacactgtcaaaagtgtccattcgcaaattctgtcaaaagtttatcaatgaaaagattaagatatagattttacctcaatttctgttagaatgtttttcaaactgctaaacaatatattttttgtgaaaactttctatatataagttgttttaaaatatcaagtaagttagtttttcaagtttatataattaaaatttaatcaatcattttgcatgtcctaacttcatctttatcttcattagggaaaaaaaaacctccacctaatgctgatgggagagaagactatgggacttgggttggattccgcccggacatacgagaaggattttaatttgtttttccgttgaaataataactgaaataaaatttatattaataaaattagattcttagctctcaaaattccaaagagtattttaggacatgttgagaaaaacttcagccatgatttattaaacaaaattttatttcccatctttaattaactttttaattgatataaatttcaaatcagagtgtgacagcaggagaaagaaacctggttttcaaggccacaatgaagagcaagtaccatctagaaaaattcaaagagtaagtaaatgattgttaggttgtactcctaccatgcatcagttaacgttgtcattgcaagcacatgcatttcttctccatacaataggacagggttgaaaggtgttacactgtcaaaagtgtccttcgtaaattttatcaaaagtttatcaatgaaaagatgaagatatagattttacctcaatttctgttagaatgtttttcaggctgctaaacgatacattttctgtgaaaactttctatatataaattgttttaaaatatcaagttaattaatttttcaagtttataataattaaaatttaatcaatcattttacatgtcctaacttcatcttcatctttattagggaaaaaaatccccacctaatgcagtttaagaattagttatgtattatttatgtgttttacaatcttggtagccatcttggattgatttggatcattactggtgtctcgctatcaacgaatattttggattgatactagtaatgatttcgtacatcagctcaattttttgaaaatgctcactgagctaggtcgacgtgtatatgtttaaatggatgagtgacaactagggatgcaggtgggccgggttaacccactgacccagtgacctagcccaagaatcatgggacaaaaatcagatgggtcgacccatgatttttcgccggtcaacataggtcgtggtccccttgacccaatcaacataagtgggccgacccattgagtaggcatttgactaatcgccggtcatctccgcccccgccgccgatcctgcattcttgctgtgctccgcccccgccgccatcgccctcacgagctcggcgctctgcgatcgctgtcccgtctccgagacgagccctactggcaggcatcctgcccattcatcttctcctcgctcggcgccagctactgcacgacaggcagcggcgacgcggcagacacacgcaaggccgagagacctgcagacccgccgccgacggagcttaccggcggtgccacagccggcggacgcgcggaggtagcggcgccatggatgattaataattctgtgcgtgttcctttcttctgtccatgctaaaactagaaaagaatcaaagatattggattctcggtggattggatgcagatgtagctcatggatttcacttttcaggcatagcatgatgtctaaattcaaaagcagttgcttcctcgtctttgcttacataatagttacatatggtttaagcgatttggttaatctctcgttcctcgggcctcagttctgcagttttctcgtatttgtttgatttcagctgatgtcaaatgattaatataatcatctatgaattttaggtttgatgctgtctgctatctgttcgatttctgctgatgtcaaatgcttaatcttccagtatgattttttttggtttgatgatccgtgctgctgttgatctgtttagacgatctggctgttgtgcgtactagtcgttgctttgtgaattgccactccacggcgtgattggccaatctgaatccggtcgccccatggacagctcgtgggtcagtggtccatgcatgttttgtgggtcggaaatcaccgccttgggtatcgtgggtcagactttgggtcgacccagcccgacccccccagcacattacgagtgtagaggaaataaataaataaggaaccacctatatatttatcgataaattttcttctaaaattgacagtgtaatttttgtaggagaaaatttatcgacaaatatatagcaaatatatagcaaaattgataaataaaatataggagtatctatcaaagaaaataaaatttgtgttagaaaatcgagcggtttgataagaaaaaaaaggtgagatatagcaaaatcaataaaatattgcgccacctgtccgtcgtctcgtctccagtagacgggcccctgtggtggctgtgtgcgagcaaaatactagcagcaagaagcaatcatcctctcctcgccccgcaccatctctccagtctccatccttgatggtctccttgctcccccgcgcgccctgcctcgcctcctccatccccaagcccaccgcccttcggccgccgtgcatggcgtccacatccgccgcggcccctgccgctgcagcggcgacggcaggaggcgtccgcgtcccggccgccgaggaagctgccggtgctgctgttcgacgtcatggacaccgtcgtccgcgaccccttctaccaccacataccggccttcttccagttcagtgcatctcccgtcccttgtgatcggtgttggtgtgggtttgcagttgaggtgttcgacggaatgcctgcttgggggttcttgggggcttactgttgctcgtattagaggggctatgaatgttaatgatcttgcgtttttgtctggatccggcttaggctatgtggtggttttgtagtaatggcttggatttccctgtgggattgcaatggtttcattggtactggaatgctcagactcccaataaatcatatataagtgcacaattgtgaattcaatattcgtttatgaactagcaccacacaagtacctaaaactgtttcagaaatcctgtgttgaatattttattacttattacctcaatgattcggttaatttaagcgtgaagtctattttatttttcttgctttaactcttctcagattccattttgtcattataaatacttgggtttatatcagtgaaaccatcccaatcaaaaccatgatggaatagagttttgggcgttgtttacctgtaatatgggggtgaagccaaccgttttttgagtttggtgtgaaattttgattccaataagagtttgagggccaaactagactttacccttaaattaatatcttctcctatatgttttactatgatttgtatatctattttgtgttactttctggattataaatatccaatatttgcctgcagaatgtcaatgaaggaactcctcgaaaacaagcatccaacagcatggtctgaatttgagatgggtctaattgatgaggtgtgagttattacttttcatatattggtgagatattggccacggtagtaggatcctagttttgacttttgaattgtttttgcgaaatatttttctcgaaaacgcaagagaattgcgtttcatttcattaaggggaagaaaataaaggaaaaatacaaagtaggagagaccaaagccctcctacacacccacgccccggccaaccccggccaactagctgcctatgtttctgtgaaatataccactaattattgacagttacttactttgctaatggacattaaaggttgccaagttgtgcttgccacgcttgaaatgacttcagttcatcaataacatatgtggttccttcattatcttagtcattgttcttacttcctgtaatcctatttcttgtatcgagaaattcattactccactaggtcattgatcactgctttctggacttggtggacacttactagctcaacattttaggtgtttaaacaaggaaagtaagttttatatgtttgtcctatagataacaagcacaaaaggttatgtgcatttgaggatagacaagtgacgaaaatgctgaaattaatctgtatcaggaaaattgtttccgagagtgattcgtgatggcactggcaccggggtaggattaatgaatgccattgtatgatccacttggtcttacagtgtatgacttcttcactacggtccacatgttaggaggaagaaaaaataatgggtttgggaattatagaaatttgtatgcatcttaaaatacatctacctagtttgagtgtttgactattggcgattgctaagcaccctgatgattcacatgctactgaactctataacctacatatggtcaaagttctaatgctatgtaattaatatatcgttccgttacagataactaagattcttctttttatcttattattttgcatggtgtgtgttgtctttaggaaaaaggtctatttttggccctcaaactctgctagaagcccatttcacctgaacttaaaaatcaattttcacccaaaacatccaaaccggacaaacaacacccctaatgctattccaaagtggttttgtttacttggatgtagttttcagtgacaaaaacctgctacttgtaaagtatcgctttatgtggataccacttagatgaatccaagtcagtgaaatttgcctaataggatccatgctagtgaaatcaccttcatatcgaccaaaaccatggcggaatagtgtctagtgtgttatttgtctgcatatggaagtaggggtgaaatttttagtcagggtcagtgaacttcaggctgatttcgggagtcaaaaatagatgccttctctttatgatttttttcagctgaaattggaatattctgttctactctgatcagagatcaagtcaccattttgtgattttttttcttctacttccagaatgaactggccaaaaagttcttcaatgatggcaggtcttttgatttggaaggtgagaagatcagatcaggtgttttaccggggatacagattgttccattttataaactggcatcaaataatcattgtttgaagatacttgattttgttcattgcttcatttactcagaattgttaattaacttaatatcctacttcaatggattttcaatagtaaaatatagactcaaagctttgtacttgtctaattattaatagctattgtcttttgtgacgtaggtttttctcaaacctaatctgttagctttttttatatcttagaagatgtttattattattgtgttttttcctataggtttgaaagcatgcatggtgagggcatatgagtacatcgatggtgttgaagacattctttacagtttgaagcaaaataactatgaagtgcatgcatttacaaattatccagtgtggtgggtttcaacttatcttgacacatttgtacacatgtgcttgttcggttgttcctgaaatatgttctgtaggtaccagttagttgaggagaagttaaagctctcaaagtatttgtcctggacattctgttcatgcacagttggtaatactatttctcagattttatttttctttttaaatggagtaatatattaatatatatgttaacagatcgatgtctatggatcaaatggacttctttatgtcataaaatggttagatatagtatgttggttctttagtgcataaaaccaatatgagctgaacacattgtcaccaactttaatatctttgtaggataacgttttcctactcctcaaacttacatcatgctcaattctatacacacaattttataatcgaatataatatttacacatagttgaccaacgttgagcatgcattgctgtgctgacacagcataaaatcgcctttccagagcaggggtgcactctatctgttaccggaagttgagggggaggtttttatccaattgacagttggggtgaaaattaaactttagaaatagttgagggatgaaaaatagacttttttcctttttgtggtacccttttttaggcaatttagtgttaatatgttctgtaatgtacatgagcccgactagtttgtactaggtgtggcattagcttctatcttgagttggaacagactgatgtagtagcttagtagttttgttattatgtgttaaatgatgaagcataagggaacttgttaagttgtggtgtcttcatgatgggtcattatgatgttgtgtggtcatcaatgatcaaaatgaccaaacttgaatgcaaatactatctctaatttgttgttacaatttcattcttcaggtaagcgcaaaccttcgcctgatttttatctacatgctgtggaccacctaaacgttgatccagcaagctgcatattcattgatgacaggttcattatgatcaattcatgtctggcatggctatgtagttacattgatatcttaactgttttatttcttctctttccactgtcaggatgacaaacattgaagcagcccttagtgtaggaatggttggtttgcaatttaaaaatgctgaggtgctcaagaaggatttatgctcgcttggagttgaatttgcacctgtgcatgaaggtgaaatacaagtccaataaggttgcactttgttaactcttctgctcatgtgtataaaattcatatatctgacccttctgtcttctgaaccttgtcaataacatgaagacccctgattgttgcagatataaactactaatatattttgtttattcaagtgtgcgtattctcaaagcattcattagcttccatgtttccaacaagtaaaggtgaacaaaataccaatggcttggaatacatgccagtgcttaatcaatagaactttaccacaatctctgttcaggataaaaataaatcatcttgaactaactttaggttaaattatttatctatctaatactagactaatccagacaaacttgtgcttggatcaggtgtagctcatgcacacgttgttagcgcttaaaaaatggaaacatagttagctcttaaaaaatccagagttaattaaatgagcaccagattcaagcatagtaatttgcttaaagctaggtaaagaacagcctgagctagctggcttgagccaaaaaaggatagttttgaggaacaagaacaaacaggctcaatcatgtgttaactgttaactcaaagcttgatcaataatccgtcaactcaaagctgtgactgcattttattggttcaataatcaagatcctaagtaactatgttttgtcagagtgatcgccaattaatattcaaggtcttgcattaaattataatggatgatcatatgtatctgttatgctttcataattaagagtatctctgaaactccatgttcctctcaaaaaaaaaaaaagaaagtccacattccattgagtcagagttaattcatggccggtgttcgttgttaattggctatgtatatgctccttgtggttttgtgctttttactgtgtggtgcagatggtaagtggtagtttgaagtaaaccattttctgtttatttgtcacatagctatgagggatcttgtgaaattgattgctattgcaaccattaaattgtctagctctattttggctgtgtagtttccaataaatatttgtgattgatgccaattaatgatcgagagaagagtggattttacaaaaagacaagtaacggatgcctgggactattaagttagcattctctccatttgtgctcctggcttcaggatgtcacaatagttacataaccagttcacttttactcaaactgtaactaaagttgaagtttcttgtgatttgtcatgaccactgcaatagatattataccagctggaaacctgtagctcatgatggaaacctgtggctagagccaaggctgactagttttgtatggatggggacctggggaaaacagcagtcaggaggtgtctgtcaagggttcaaggcctggccaggtacaaagagtttgttgatgttatgactaattgttagtagttaccctcccctttgttggtgctttttttttcctttggcctgttctttgttggtgtttccatttgttcatgttgatcagtcttcctaaatgggtgcctcccatcatatccaaatatgggtccagtgcttattgtagcaatttgagtaatcgtttagtgctgccgttttgatgttaaatagattttatggctccctatggctgatcctttatttgcttgatgttgctgaatttgaacacattttactaggttaacctgctcatgttttgcatatatgtcaccaagtaggttaaaagatcgtaaatacattatttatgaaaatatggcaagtgctgaaaatttcaaatctattaaaacctatatgtacaagttttaagaactcacaaaagtctcagctgaatctgtgttttgagtccaggtaaatttttactaaaaaaaatcaatcctatttaacaagataaaaaaaggacaaattgaagctcttcactatgcactcatttgacatttgtcaagaaatattgactatacctggacctgttatacctatattatgtgtaaattacaaagaaaaactaatatatggctgtaattaccaaagaacaggaacacccacatatggcgagttctgtaaccgtctgacttaaatctcggattactgccaatctactgccacgaaagcttaagctttttttttgtaacaatagccgtaaaaacatttgcttttgttaacaattacccacactttgcatttcaacattttatttgtatggaatggccacaatttatttcttggtcctatgattttcatttaattcaggaatcgagattgcttccagtttatagcttgagtgtgtacttagcttgatttgcatcctattgttgttcaactactgccaatcaatacatcgaattcaagctcattagttggcaaattatggtatatcatacctcaccatgcgtgaatatttttgtcttcttctaaagatgttcttctcaagttgcatgctggcggcaaaataattgtccacttatttatgcccgatctcatatacttcatatactgtttattcctcttcaacatctcgtggtatggtacaaatgatgagcaagatggctgatatcccaatctgtttacctctatcctttttgccaacttgtgctttctacaacttgacatatgagttggattgctgtcaatttactctttataatggtgccaatgatgtcattatcttaggactcatggactctctgtaccaccctatcatttgaatccatgaacttatctccctttaaaagttggtattatatatttggagtcctagttgtgaggacggctaaaggggtagcaatggatgcttagcttccactttaaccaacttacttaggctgcaatattgtcagaaactgagtattaacagaatgttgtcatagcgatgcagatgtgactaacagtgatttagttgtaaaaattgcccacagcgtgtatctctcacctattttctcaaggtaacatggctggctgtgtcgcatttttatcaaaacatatagcgtgatgtctacgggcatcctaagcctattttgtagattttagacttcatttaggagatttttatttcattatttcacttcgagaagagtagaagcgtacaagtcctgctcatataattttttgtgtcattaacttatgtgctgcaatgaaaaagaagaatagtatttatggcaccatatttttttaagaaaataaactggttttatgttgtaaattaccgacacttacatttacattatatttacattacattgtaaattttaaaacttatattgtaattacattttagctttcaattattacattgtagtttctctaactaatacttcatccgtttcacaatgtaagattttctagcgttgtccatattcatatagatgtgtctagattcattgacatctatatgaatataggcaatgctagaaagtcttacattgtgaatgagatgtctagattcattaatatttatataaatataggcaatgctagaaagtcttacattgtgaaacgaagggagtacatgcatgtccattgtaatgggctatgcctatataattagggataagttagtatggtgattgagaataaaacaataaatctggtgggaccgtacgctcccatatagacgcgcagtgtgctagtaggaggggatagaaggagaacgactctgctttttcatattataggtacatactatatatgagaattaagaattaaggttaagtaatcgattatctacttagaataggagagatgaaaatatacttacatataacagatatcaatcacgtaggaaagtgactgaaatcaagtaaatatatgtcatcatatttttagcaaaactgaaaaaaaaaaagaagtcttctataagtaggtccaacatagatactgataattcttatcaggtgtaccaatcaatcacatgctaattctcttaacaagcagacgtgctctgtttttgtaatgtcaatatatcatcgacttaacaattaatatctgtacgtagttaatcaacacggagagctggaccgaagccgtctgcgcaattgcattcatataagcaaaacatgtgatccttggattataaatgggcaaaatttgctacaggacacttaaagattgtggtctttgctgtgagacacccgaagattgtgtatttgctcttggacaccgaaaaaatgtggtaatctgctggcggacactcctcccattattttataatttccagctgaaacggtgaaagaaactttcacaaaagacaattttgcccatgggccatttgtataagccgaccaagtccggctgcaaccagatgtgagaggaggaggaggcagagcagccatggctccctggacgtgctctgccatggcggcggcgcggcggcgtttgtcggtgacggcgcatggctgccgcgacgagcgtcagcgtcggcaagaggagatggaggcgaacccggtggcgcggcatggggctctgggatggcgtggaggtggcgctgcggcaacggacggcattggccggaattggggaagagagagagaggcagtggcgcgagggaaagaaggcttcggccttggagctcaccggcgacggcggcacaggaaggagacggcgatgtccatggcgcagcacccggccgtgatggcctccacgacgcggtagctcgccgcggccacgccctcatcatcgccggtcgggcacaggcagaaccgcgctctgcccatgagctcgccatggtccacccctgccaagaggagaccgtacaccagcacctcccgcacggcgccgccatgcgcgacgcctcctgcagcgaagaacgcgaccagtgtcaggggcaggaaagagagaagaaagaaaatactacaaagaagcacagtgtcaggggtattttggtactttaacactctttctctctctgttttcaccgaaaataataaaataatacatcgagtgtccagcagctaattaccatatttttccagtgtccacaagcaaatacatgatttttgggtgtctcatagcaaatgccacaatctttaagtgtcctatagcaaatgggcaaaatttgatacacatcccccatttggttacatatagtggtaagtactgtacatatcaatcatacgtgcagctgtgcgaccttgcaacaaggacaatgtcaacaagcatgcataacggttttctggtgaagtgaaatcttgtgcccattcctcgcggtctaaccagaatgccatcctgaatgttcattgtttatccttgctcatgaaaaagagaggaaaaaattgattggtgttgatcaggacctagattggtcatatggcaccatgcttgctctccactcttcaatcagtgattgtcaagagatgtaattacattttgaccggtagacacaagtatttttttttcggggaccagtacgagtcattgagggtttataaatgtcggtttcaactaaatgaactaaatcttaatccgcaaagtaacacatgccaatccctatgcagattgtgaagaaatagccaatatttgcgagatcttttcgagaactaactccttttgagatcacgctccggccgaaaatgggttctcacttgtatatagtgtaacatgccaactcctcgcacaaaactccactcgattgcgcacgaattagtctactactccttaggttctccgcaacaccccccctcaagtcatgagccatcatcaacaattcatcatcatcattccctttccacttcgctctcactccaaaaaacacaactcgctcacacttccaaaaaacacgcacctcatcagctttcctttgcttcccttctactcccatccaccactccccctgcctgccctgctcatgtttgcaacaaccaggcccatggccccccaccacaactaactcctcactactgaaacaaaaagaaaaagaaaattacatctcatattctcactcccctctagcatctcagtctatatgcacactgttctctgccacgcggcggcggtgtgggacccacatgtcattcacccataaagacagtttgtgatgttgcttaatcacaagttccaaacgaatgcttgtgtagatcacccccttaaatactctctccaccactccaaccctcaccactcttccagtgtgacacaataattatcttaatttttttttccaatctgtatcgaatttgtagatgaggaacctactgctgctgccgctgctcgtggcggtggcggcgacggtgcccttggcggcggcgctgtcggccgacggggtggcgctgctggcgttcaagacggcggtgaccgacgacccgtcgggggcgctgtcgtcgtggtcggacgccgacgacgacccgtgccggtgggccggcgtgacgtgcgccaacacgtcgtcgtcggggccacgcgtcgtcggcgtcgccgtcgccgggaagaacctgtccgggtacgtgccgtccgtgctcggctcgctcgcgctcctccgccgcctcaacctgcacggcaaccgcctctccggcaccgtcccaccggcgctggcgaacgccacctcgctccactcgctcttcctctacggcaacagcctcaccggcggcctcccgccggagctctgcgacctgccgcgcctgcagaaccttgacctgtcggataactcgctcaccggcagcctcccgccggagctccggcggtgcaagcagctgcagcggctgatgctctccgggaacggattctccggcgagataccggccggcgtctggccggagatggtgagtttgcagctgctcgacctgtgcggataacatcggtcacgcggcggccatcccgccggagactcgggaaagctggctcgcgctcgccggcacgctgaatctctcgcggaaccacctctccggcggggtgccaccggagctcgggcatctcccggcgaccgtcaccctcgacctccgcttcaacaacctctccggcgagatcccgcagtccgggtcgctcgccagccagggccccaccgccttcctcaacaacccgggcctctgcggcttcccgctccaggtcccctgccgcgcggcgccgccgtcgtcgttcaccccgccgccgccgtacgccgccggctccatcagcggcgccggcgggccgcgccagccggtcaagaccagcctcatcgtgctcatctcggtcgccgacgccgccggagtagcgctcatcggcgtcatcgtggtctacatctactggaagctccgcgaccgccgcggcgacggctgcggcggcgacggcgacgacgacgaggaaaggaagcgaggcctcttccccttcccgtgcatgcgcgccgacgactcgtcggacgacgggtcggacgccggcgacgacgtcaagcgcaacaacaccaccaccaccaccaccgccagcggcggcggcggcggcggcgaggaggggcagctggtggcgatcgacaaggggttcaagatggagctggacgagctgctgcgttcgtcggcgtacgtgctggggaagggcgggaaggggatcgtgtacaaggtggtggtcggcaacggcacgacgccggtggccgtgcggcggctgggcggcggcgcggcggcggcggagaggtacaaggagttcgcggcggaggcgggggccatcggccgcgtccgccaccccaacgtggtgcgcctgcgcgcctactactggtccgccgacgagaagctcgtcgtcaccgacttcgtcaacaacggcaacctcgccacggcgctgcggggtgagcacacaccttccccttccccttccccttcacaattcgtgaatttgtttggaaagcgggaaacgtattttctcaaaaaatggagcaaactttggctggattataacaaactttggtaaaacaaaaaactggaattgttttggcccaaagaatatccttcttgcgtggggttcgaaatacattcaattcgaaacatagaaccctggctgtcgcaaacttgcaatcgacacgtccttctcaatcggcaacacctgctctgtttttggtttgcactgtacatgccatggatgcatcatgcaaactatatatttttggtacaatagtttgtaacccccgtaggacccatatgtcaatgatataggtatgcttgtcttatatatcacaatatagaataaggtgagaaagtacccatacctagttaacttggaaattggataatatgaattctaaatttacttaggacaacctaattttatcccctccggtcaataatgttttactttggatagagtatttcttattagaatctgaaaaaggaaattatttgcgggtattgaccatccaatcagaaatatgaggaccatccaatcaaagtatgagtatcatataacagcaccttaccctaccacaagaggaatccaaccagaattttcaccataaacatgaggaaaactccaaccaacccctgcaccaagtgacctagagaaacatgaatacacaagatacccagtgaacaggagactagatgacaaagacatacctagtggctcttccggtactgcaaaactgccactgctgctgttgtttacagtgcatcagtgataaaagcttccaagaaggccaggtaggagtgtgcatggactgttctgcatgcatgcctatttttccatggaccacataaatcagtcacagcatcacagatcagtcctctgccagtgtttgggcactgatgtactgtagtgctgtaccacagtggatgatggtccagttttttctttgtttgccctgcttcatcagtcagagacactgggctcgctgccatcatgaaccatcggcatgcatgcatggttggggttgggtgagctaattttggacaggctttttggtggacaagattaggacgagaggaacatgtgaactttgatgggtagctgtctggatggttaagtatggtgcttagattcataaattcgtatattgacagaaaaattggtccaattttaggcgtctaacgtaggtgatctttatcttcaaacataagcgaagcagactaattcttgaaatgatttgtttgcaaaatcgactatattttcttcatattgtacataataattgaaccgtcttgtatgacatcctaatgttcaaaaacttgtgccgtaataagttagggcttaaaatcgacgagatgataagactgcactaatataagttcacaagtcaatgataattcacatataatttgcatcaataaaaagtcactacattatctttcctagtggcaggaacagggtagggcagctagggctgctgtcctactcctaagcttaaatatctattaaaagttacatttaaaacttcaaaacatggacaataaaggtaagttatgtatattatactagttgagccctaggcttgaaaaaattctggctacgccactgatctttcccaataatacattaaatttgaattatctttccactaagtgagagtctaggccgcatgattggtgttagtaatcaactatagcagctcatgccaaatgctcatcagcttggcacataaccgacagagacaaaagagagaaaaaaatggggctcaacacaaaaggctcaaccaaccgagggggaaaaggtgccttgcgacctctgtctggctgacctttagacaggggaagccaaaaggccctttttaagcctgaaacgctacgcagctacgctgctctgctgtggtcactgcaggcaacactcgcgcagtgcagctctagaacctaaaaaaagttgctctttgggtgcagaaagttgcagagaaaaaggcactacggcaagttattcgtcacacccaagagagaagaaaagtactacgagtagtgcatttcttttgcttccaattcttttgcattttactagtactagactactggcttggtgttgttgcctggctgctctacggcgattgcaacacttttggaggttttaggctcaaggaatggaaattgcagtacaaaatatattttggtgaatcctcatgcattctcattatagtcgtacctagggttgttttgctttagagccaaattttacacaatcgaattgatggcattttaaacagtgattttgcaacgtttcgtttgttaccaaaatttgctatatatgcatattcatggttaaaatattagtagtgccaaaatttaggtaggttttcatttctaagtgaaatgaaatgggcattattgtattgttactgtagcgattgatttgaacgatttgtcctatcatgagttagctaactcataatactgtacacactcactgtagcagcagaggatccatcactgcataacacatcacatcacattaccttaattaccggctatagtaccattattgtactccccaatcagggtgtccattgtcctataggatatataccattgtcctataggatatataccatttaaattcatgaacaggagcttaatatacttcctctgtttcataaatgtaagttattctagcatttctcatattcatattaatgttaatgaatctagatagatatatatgtctaaatttattaacttcaatatgaatgtgtgaaatgctagaacgacttataatatgaaacggaggaagtaccattcagtgaagaaagactattttgttttgaagactatgaagaaaacatcgggcattgatctagaccaacaacttgaaagtcttgaaactaagataggagaagtttttactccctccagtcgaaaaaatatatgaagattggtacttcttatggtcagctgcgttcagctttgaacataactagaaataaaggcgcactacactgtgcctggcagacgatgaatttgaatctgtaggaacaacattgttaatagctataggcatgtttactttgacgttcaataatagcttaagcagaataaaaaatcatgtatataatatatttatgcacatagatgtattaaatcaaagtcgatttccaattacattggtgttagaataggcagaatgaacatgtgtgtccaactcccttatttagccatgaccagggcaccgtaagaaccaaaaggtttagctctattatccttttcattgtgccagcatcatttatcaaatcatgatctgccataccattcagtacacaaatatatcatcgacaaccccaattagatcaaggatattgtcaataggaagaagggatagataagtgcggtgcagggtttactgtgtaagcaaagaaaatatagacctactaaaaaaggcaccagatagcaatatagtcaacaaaagagagggaactcaacagagcaaccagtccgtcagtgaataaatataattcttcttttgtgcgagttaacatccaacaaaaaacccattggatatgctcatcaagctatttatacaaagattaaatcaaatgtaggaactgcaccaatagttgttttagttgatccacgtaccaggaagatgcatagcatggaggcataacatggcataatggtgtaaccaccttatgagaacgtgaacaggaaagaatagaacccgattacaccggttgtttgggaacttcgcccaagaactaattattaccaaatgataaattcatcctttgtaagttgaaatcaactaaatctaacattaatcgataatatggatgggtaattatgtaaatggttggctcagctattttaggtgtagttgaattgtgaaatgcaataaaaagaattgactttttgtagagtgaccatactagttgcctttactaatttcggttggtaaagagttaaattggttttttcctcttcaaacactaacattaggattctgtgccttaggaaatatccacataagctacttcaattggttgtgatcaaatggaagcattgttgaatcaaatagctgttgcacataataaaggaattaagacctcattttatatttaggatacattttatatttaggataaccgacatatctaaatggtatggtacaggtgagttgtgggtcctgctatactaaaattaagctatagtatctgtggttgatgtgctccttataagccttagtttggtcaattaattgattcaatcaaataaccacaactttttggctaagcttatgtgattgtaactaattaagcttgattttctattatccatgtccaactggatcactgtctaccttatctttatttaggccaaatgaaacattgctacatcatacgcatagataggaaaaaataaaactggaggcttattaaacttactttgagtactccagtttaatagcacgctcattggcaacgatctactcaatatgaaattaagatggaatttatgagaagtcaattcttataaatcggcaatacttcttctgacagcagcagaacacacctcttggaataagaccccgtgttaaatcttctcaacaacggctatttttctgcaacatattagtgcaggataatgattaatgtaatgaaatttaaaaccttaaaacaacaaaaaatgcagcgtacaaaatgaactttcaatacattatttccatcatggatcaatggtagatatggtttatttaaatgtgcctattcggtagagaaaagggagatgcaaacatttttgtaatgaataagcataactgaaattcaaggaaaaaaataagtcaatgaacatatacagataaatatagtattttgtttcacaatactgttggcaagcaaacttgagttggtattcccagagtcgataacctgcagagatcatgtacagacctatttgcctcttcagatataacatggtggagaagatctgctcagtttgtctgcatcctatttcctctaaccgcaggaagaaatatatgagaagctatatccaaatgtaggggaaacaatagatctcacttggctaattgggagggggaaaagcaagaaacacaaacacacatacaaccattagtttgaagcccataccatccacatcgaataaaccagaaaaagacagttagcagccattaaaaccaagatcgaggtagccatgcactattttgagcggtggtatctgtaattaaaattatatgtgcaacatacaaattagaatatcaaacatagcacaacaccataattatcaagagatggaatttgataccgacaaaagcagaatgtgtgagtaaaggaagatacggccaaacaatgggtccaatcgcatcaatatgcatgcacaataggaggggtagaaagccccaacctcaccttcggtcctctcacagaagcagtggtcgctgccgactcccgtgaaacctcttatcatgtgtgactcccatgccggcgagctgaggaagatggagagggatcctctaacatgcgaagatgaaagaggagaaaagggtggtaacggctgtcatcctcattcgggtttctggatccgcctgtgaggaggacggggtcgctagacctggtggtcccgggctcctcgctgggagatgtggcggctgaataggagggaagaacgatctcgtcgtggcgacgactggtgaaggatcgtgaggcgacgacacctacccacatgaggcaagcggcggcggcggcgacggtgacaccaaaggagacggcaacggaggtgaaatagggagagccggcagaatagagggaggtggtgacaacggtgaagatgacgtggcggcgacgctggcggagagagcgagagggcagcgaagagagcgagatagctcaagcagttgacgccgtcacggtcgtcggggtcgcggaagaacacctccgacaccagcagcgcgcacacgatgtgcgcccaccgcgcgttcgtcgtgcgcttcacagtgccgcccctcgccgggcagaggcagcagcgtggccacggagagagcgagagggcggcggagagagcgagaggcgacgccgtcgcggccgttggggtcgcggaagaatgcctccggcaccagcagcgcgtacacgatgtgcgcccaccgcgcgtccatcgtgcgcttcatcgcgccgcccctcgccgggcagaggcagcagagagggcggcgaagagagctacagggcggcggaatgggctggagctagggttttgtttggtggctagggttcttggcaaatccaggccatccgttcctgatccaacgatctcatgatggtggaagagcagccacgctgggacacgtggacggccagatcgtccctcgcacgtgatcgaacggacgatagcggcgggagccgacgcacgattaacaggaagtggggggttttcttagcaaaaaaaaacaatggagtggcgcacctagttctccagaacgtgattagccagaggtgaggggtgtttccgaaaaatttgatgacgtggcgagctaattctcagccattaccacggcatttaagtaaacctatattaattgtttactaaaaataggtttaagtttataaactgcaataggtttatacaattctaaagaaaactttttaaaaacaattatatacatacttaatactactatgttttgaaaccaagtgtttagaacttatcaataaagtttcgtaatttttccttctacgtatatcgtgggcatattttctaaacctctaaatgttattttttttacaaaaccctattatatgaattgcttacaatatttttctggaacaacttttaaagctggatattaatacattcatttgtataaagtattataaaaaattgaataacacattatccatttgtccattcaaccctttagaattacgtttagtggtatgttgcctttgagactgaagcggtggcaagcctagggtagctagtttgggcttgagacctaggcttgccttcataatcatacttaaattctcttaatttatcatgtaatttttaagaaaattaatattatattagttaagccctactcagtccttaattttaatttctggtttcgccgctatgtgagaccaattctgctaaccactggtggtaactgatgactgatgagcatccaactacaatagaagtgaatatgcatggtacggctagccacagtgaaaagcgtcccaaacatgtctgtgattagcacgatacccagggcaatgatcagaggccagttccctgtccttgtggtagctatggttgaatgggcagctttctgcctgtgctacaacaactacaagagggtctcctctcacctttctgatgtagctgcactgtacaactattacggtaaattggccgccacattttaattggtaggaacccacaggtttgacttctgattgtaggattacctactgctacccacttttattgttcaggttaggcctccgagagatattaggtgaatattggtgaattagaccatgcatgagaatgttcttccgctatcaattggcttactgccgattataaatcgtacagcttatcagaaaaaaatatatttgtaggtaaaaactttttttatatatacattgttagtgatttaaagtcaaatgctgaaaaataaattataacaaaataacttcggaatcaacttcaaaaattaagtttttaaaatttaaattttgacaatgacttgtaagctagcttatgaagaaaacgatgggagttttatgtgctgaatttgtagtattacggtatagttccatgtagtactagtattgtttaagcactttatatgtttaaatagagagagagatagagagagagagagttatggtgactgatacatgtagttgtgtgtttcacgatctgattttatataggtattaatccggtttaatatgtacatgtagttgtgtttagcgagaagaactaaaaaaagacacgaatattagagaaacatctaatatcaaataattataaggggtgaggcttcgaatccaggtcgtctagcccaccaccctgtggagacccctgagtgtttctcaagcaagaagaacttaatttgttaggttttcagattacccaactttgttatgctcccttcaattttttctgttggaattgtggtaaggatgcacatttgtaattaattgtctgtgtatgatgttgggtgccgtctccagttcgaattaaagaatatcgaacgaaattttaattcaaacagaatgttagtagcctacaacaaaatcagtcattatgtatgcatcgaactgctccattttttattataattagctttgattttttttttctacaagtcgatttctatatgtttggtcaaatatttcaaaataaaaaaatatatattagcaaaatatattcaacactaggtttaataaattaatttggtataacagatgttgcaatgtatttctatacatttagttaaactttaaataaatcaaaatgatttataatataaaattaaggatgtaattaagaagaaggtaattcgagaagctacaaaatgttggttaaatctgatgttttttcgaagtagtttaatgatcctaagaatttttcttcttctttgggacggtgggatgatgtggttgtgcactgcagggcggtcggggcaggcggcgacgctgtcgtggtcggtgcggctgcggatcgccaagggcgcggcgcgcgggctggcgcacctccacgagtgcagcccgcggcggttcgtccacggcgaggtcaagccatccaacgtcctcctcgacgccgactacaacgccgtcctcgccgacttcggcctcgcccgcctcctcaccatcgccggctgcgccgacccttcctccgcctcgggcggcggcctcatgggctgcgcgctcccaccctacgccgtcaagcccgcctccgccgccgcggaccaccaccaccgccccagcgcgtaccgcgccccggaggcccgcgccgtgggcgcgcgccccagccagaagtccgacgtctactccttcggcgtcgtgctgctggagctgctcaccgggcgcccgccggagcaccacgcctcgccgtccgcgtcgacctcctcgtccgcgtcgttctcggggaccaccaccacggtctgcggcggcggcggcggcggcgaccaggcgcaggcggtgccggaggtggtgaggtgggtgcggcaggggttcgaggacgcgcggccgctgtcggagctggccgacgcgggggtgctgcgcgacggcggcgcgcggaaggaggtggtggcggcgttccacgtggctctcgggtgcgtggaggcggacccggagcggcggccgcggatgaaggccgtcgccgagagcctcgacaagattgggtcgtgaggaaagtcgctcagagctgggggggatgatgtgcatggttggtttctctgtttttcttttttttttcttttaattttaattttttatgttttatttttttgccctattattttttttgtcttccttttgcaccattgtaattcctgataaaaatgcaattgttgtagtataatataatatagaatgagaacaagtttatcttctttgtgaaataggaatctgcttgtgaaatctaccaccacactgttgtcctaaattcaatgctacttgtcgggctccttgttcaaaatattactccatccatccataaaagtaaaagtagacatatttcatatttgagatttttcaaataagttattcttattcgtagtttctatgtatccaagacttaaataaaaaggtaaattaaatgtttaatcagagccagatgagctattttaatacttattggttgcatgcgtacatacactccttgatatttgttccatgcaagatgagttttttttttgttggtgacaaaagttatatttgtaatttttatggaacgagggagtactacaacatttagatggtcactgaacaatgcttccttggataatgtaatctcgaccattccaatttgttccccattaaaccaacatcattggctttcaatcttcctcgatcaaattttattgtagccatgtaaaccaagctggccttgcttggacttactgtttattatctgacaatggccaatacttgacaacccatgaatgctgacggaagaccacagtatgaaagctatatatatagccttagagctcatctgtgccacaaatcacagagtactatctatattcgcgaccacattttaggcacattaattgccacaacattttttgccattcaaatcccaattttgcaggtgaaaaataattttagatattttgctagagttgcttccaaaaatttgctaactacttgaagctgaagaagctgcaatatatatgttcagattcacattaccggatgtgacactgaagaagctaaagaagctgaggccgcttcacctgagatctttgggaagtagttgaaaatcttgctgacgccttcggtatgtgattgaaattcttgccggtagaaaatttgaccgagtagcctaaagaaaaaaaatatggccttgccaacaaatactttcttccccttctgttaaacgagagacgaagagagtgcagatgttgaccaatgaaaggatcctctgcacacaattgaagagaaaatgagtggtttttcccttcgatttgtcctcaatgctggtcacctcgtcgatgagcatgttgtagttgtttgaggactattgactgcgtacgcgtttcaccagcgagagatcgtgcgatagtggcggacggcggtgatggtggccgaagatcctgactgctgagcgccgcgaatccgtgatgcaagtgggctggacatcgagtcacaaagaattatgggcatgcgactaaggacggagtggaagagttactgcccatcggatgcacaaaaggatggtgtttcaggactagacgtttctatgacgtagaattcactattgttttctactatagcaacaaactcatttcactgtgcatctccacctttttcctgaaaggcagagggtccggatccatggcaatgcgagatttggggcacggccaagcatcgggaaagggaaaagatttagaaaatcacggagttgcactactctctcgtcttatataaaagaaacctacaacgaatctagataaaaataaagaaacctacaacgaatctagataaaaatatgtccagattcacagttatcaggatgtgtcgcacatggccctaaaacggtattggatccatctcatggagttggatcacaaacactacaactcactatgtttttcgtcctcactttaatgcaaaatttccgaaaattccaaaatggagttaacagtctgcgggctgtcctcctatttatgttgggttgaatggagctggctaagcgaggtggtattattcggtaaacactaactggcgatgctacagtgccacgctggcactgtgggctgctgctactgctctgctgctgttgggccggcttgctgctgctttgctgggctgcacagctagctagctttgcttttcttttttttttctcaattatttgctgggggtgttacacaggatgtatcaaatcccgtactacttggttttctatgggacggagagagtactgtataaacgtttcctatgttcgagggatgattgcacgtggaccgtaattggtcgcgcctccaaaaatcgacttcaattttcacatatggctcattagggcatgcaaaaatctatttttataggcgaatctcttaacgagccatatgccaaaataagcctatttttctaggtagatctattaaacagacgcatgggaaaatgtattttcgtaggttgccctcttaaaaatctacctaaaagtctgacttacctctatttttagtctcagcactgcaattttttcaagttatcatccttatttctcatcctgtctctcacctcctctcctcctcatattatttcaaactcccctctctctcatttctcacctcctctcctctcgctcggcctctcctctctctcccgagcgatggcggcgagctcggcgacggcgactgcaacgcgcaatggccggatccaccgccgccggccctgcgactaccaaccctgcgacggcaacagagatgacggatccggatgggagctagctagggtttcgattttttatttatttttggggattttatttttgcgtgcggacagcataggcacttgcaagcaaaaatgcgattaccgcgtacaagcatgccacccatataaaaaaatagtgattttttcgcacatactttcgggcagacggacggtttaacaacatataaaaataggttttggccgtataaaaaaacagtgcattgcggatcggcgacaatcacgcccaatcatggggaggccgcgctcacctcctcgcagggtgtgtccttaccatggtgagttcgacgttagatcacaatataaccgtttagagcattggatcagccgatcaaatggttgagaaaaagatgtaagctttgggtgattgctagtacaaacttccttttatattaacatatagatagatagataaaaactaatcttatttctgaactctttccttggcgacggctgctatttgtgttgcacgacggtgatggtggtaaacccggcctcacacgacaaaagaccacagcatgaaagctaatatctatggcacatcccctgtggatcttttaaatactgtaagtttatccttttgttcaaccatagttccacagtcgaactatggcacatcctcagcatgaaaaaatagtgaaattgatcgacagacaatggatcttttaaatatctgaaatacacctacaagttctatatatatgtttccaaactaaggatttagttattatgaactgcaaaatcaggatgtacagtctttagttttatttcatttttgaaacgagactttcatgaaaaaaaatgtttggaaaaatattatgctaaatactacatacggactatttgtattaaacagtaccaaatcatcaatttctggttccatcaagaaaaggcatacttttgttgtgtatttgataaaaggttccagataaattaactatgtttaccagattattttactacgaaagcaaatcagccgagtgtatatatatatatatatatccaaatagtcgaaaatacattcaatccattatttcattcaaattgcaaaacacatcatagaaggataaaataacattgatcttgatcatctctaggagttcacaatgaaacatcaatactgaagttccaacaacgcatcaaagttatcaagacggaagatttccgttctatgttttgattattattgctagggagagttcagactaaggataaaccaacattcacccttgtttaattacaatcttttgagcctcgggaagatgttggaccattgtcacctgctggcatatccttcctggaccggacatttcgcttatagaccaaggtgggtttttcctcgctgaaaagttacagtaggcatcaattaagcaatatgaaatgctgcatggattttagcaattacagcaggcatcggtttgggaatatgttgttaccatgcaaattgtgatgtaagaatagcatatatattaatttaatgcaaggattgaaaagtcatgatttgcacttacagaacagtggtttccctctccggtggtatcttcgcacaggcatagcagaatagacagccgcaccttgatattagggaaaaaaaaggtgatgcaagagtttaattagcagcaacaactggacgacacatacaaatataaagtagaccttgtaaatcagacagcgcatattgtttgaagtaaatatgtcacatatgcaatattgataagaggtagactcttatgttgtaattttgtattttttatttgaataaaatttatgccaacagcaggggcctccccaactgtgttctgctaaaaaaacagatacaaatattgcattgatgtagttactgagaatgtattttagcaaaatggataaaaagattcttaaaatagtttacatgagtcaccaaggcaatcgatgtaataccaatcctgaacatgagttttgctcttttgcaattaatctagtgggttgacaacatgtcaacatccctttaccaacaagaggactaactaatagaagcagtgatcagatatagtgtgacactaagagaaatatattctaaccatgtttcaatcttctagcattaatttgagatggcccatggttgggcttttaggacaaaattagtcaacatgacagatgaatctattctaagactgaaggacatataacaaaaacaaaataatttgaaattataaaagtcacaataaactttatgatattatttcatcttataataaactaaaattatattccatctgttataggaaaaatgtctaaatagctaattagtatacctaatgggcacatagaaatctgttaaaaaaacatatatccacagtaatatcgatacaaaaattattgcacaggacaaagtttgtccatccaggaatatgttttctaatcatgatctttctatatggagctttaactagctaaaacaacaaattgctggtaataatcaaatatgcatcatatgaggaatacaaatggcattaatcttcacaccttacaatttctcacatagcaactgttgtttgaaacaaaacaaattaatgcaatgatccactaactacaatatatactgcgaaagaagtgacctctactagtcatgtaagtaaatcaatggatcaaactgtactgatccaaaaagaaaacagtaattctgttccaacaatattggatcaaatcatttaatttcatgtgtcttgtataagtagaaggttgtaggccctatggtctacctctacgatttgcaaacatgcatggtaagaatttgagctcattgcaaactacatgagtttttagtgcaaaatattacatcacgttaatataaaatgtctttgtgttctacaagactgcaattgtgatgacatgtgaagccaaatgaacagcctatttgacaagggaactgaacccatttcattgaccttcgaacctctcttgccctcccctttcacagggtgaaaaaatacagctcaagaggatagaagcaagaggaaaccagccaatatttgcatagagaagacctattagcaaaaaaacatgttatcaaatagatcatttcataagatacatctctcgaatcaaattcacttactgcgcatccttcggatctaaagtttccatcaatagttgaggagggccaaatggactcatttacatagcagaaaacattctagatactatttgtaatgattactaaggtataaaatcactgtacaagttcagaacatgcaaagtaatatgaactacatccagaaaatcagcaataagtaacctaagatggaatctacttctttaattgagaggcaaattcatccagaacaagaacaacaagtgatgtaaacatgaaaactaaataaaaaagaatacgatgtttaccggcaagtgacaatgctgcatcccccagtcaactcaatgaatatgccacatcgagggcatggccgccaaccttttgcaattgccagggtatgcagcggatcaaggcaatcatccctaccaccctccatcccgtccaaagtgaccccttccaaaaattttccacaacttccacacctttttagcatagcagaatcccttaggtttgcagattcccaagctttgcgcacatcacccctgacatgcttgtaccacttctcgtaggtaagctcaccaatagtacatcctggctcagggcagcaaacatgggcatcaccacccaatacacggtaactaatatgatctaaaacacatttgaagcagaaatagtgggggcaaccttcgcaatggaagcgactattcataggcttgtattccatgcatatggcacagtggaatgtcactgtataagattcatcggtttcaatattaaccctcttttccttggtatccatgtttctctcgtggtctgctgtttcggtggacatgctagcccacttaatttatttatataggtgtaaacatgaatgttttccgtgtgatgtatctccttttgcatatctggaagatacgaacaaatcacgggacagctcaacattgatgacatgggttgtcgtacatggctatagtaattaatataaagatttacattggttatttcttcagatacagtctggtacatgtgtgacacagcgaaacaacgtaacataatgtgacgatacgctccgatacacaaatacagatactataactgggctgccaactggaatactattgaaactaccattttgtatcatgttgctaattcgctagttaatttctttagggacccagccagttaacaccttccattgcagtccttcgatatcagttatagaaaattgaaggttctcacatgcacaaccttccatatcagttatgtagccttccctcgaaatgtgaagccagtttttgcctcttgggatagttgggctagcacctgctcttgtcgtttgtttgtgcactgctgactgttcaaaatccttgcaaagaattgcgggtgactaggaaaatttcttcttatcgtgtgcacgatggcatcgctagctctaccactgcttgtaatatactaggattcttattattctactttcagtaagttggtttccaggagctttgatacaagatccttatatcagtgttgcttctattattggtagttgcccacttaggatgcacttttttggcaagcattttgctccatttcaggttttgtttttctttgtagatcaacatcatggcccaagcacgatgaggtagatacgagcaacatcatacccatcaccatggaggatttgaccgaggagcagtgacaagttcttgagaagcaaaagaagaggttggaggtggcggtcctcgcgagctacttgaaaacccatcaacggatttcatagaaaagcggtcctctacccgaatcattttcgatgaggtaaatctcgatgatgtatccgttcgttttcaaaaactcataaaaagcaccatagttgaaactatgaatgctatattcagtaataaacatgaggcaactatgagattttattttaataggaggatagaaaacattatgagttccaaattcggttctctcatgaccatactctaattgagttgttgaatgccatgttagacattgcgaggctttccaagaaatggtggggtgaggccatattgattgtgttatatcttaaatagaatttctattaagaacaaagaagtaacaccattcgaggaatgggaagagaaaaggttgattctcttatatatattggcgtgcctggggatgtttggctaaggtcgatgtgcctatagtcaaaaagctcaaacttggaccaagaaccgtagtttgtgtgtttcctagttatgctatctatagtatgggaaattgtaaattctggggtaacagacatgcatgttggtataattttttagtccagagatgttacatcttttgagaatgaatctccggtgaaagatgaaagatgcatctacatttctagtcaagaacttattatattccctgagtcttttctgctgattgaacacaatgaacaaacgtatgtggaaaatcctcccaccgtcaacaacgccccctcccccgtgcactccctgtgggccttttcatcaacatttccccattaaggtctcttcctcctccaaacttgctttaacggtctcttccttgacagcgggctatcccatggtgggtactgatcaaataaataattacactgataacctcgttcaactttcaacctttcaacatctcttggcttcctcttaaagtgctgaattttcatgttaagatcatcaccatcacctagtctgtcccacaccctagtttgtcccactgaactgattacttcttcaactccttttccacctcctctctcagcactattatcaggtttattcttctaagtaaaaagatgtcttcttggtagatcacgatcaactgcattgcatctctgtgcataatcaggagaactcgctttgctcccatagctgctcccctccgaacctgatcttgctcactgactgctagccgcctagccctctttgttttcacctgttctgcacgcaaccactcaactcacttctgatttttttttaaaaatatcctctttctcggtcttgcatccctcctttgtatgaaataatcttccacagacaaagcaaaagtgagggatttttttcatactgaacctcataccattacccctccgtatcatctgcatccactcggagcttaacagttaataccccttggcagaggttgatttacattcaaattaactctagtttgaaggaacttatcccaagcaataccatcttcatcaacaactacgttaatcaccttcccaaaccatcgggggcagatcatgcacctggacccaaattggtagttcatcaaaggtgatatcagatggtctttgcaaattgataaaccattttgcaaagagcttcgaggttgggaggagacattgttaagttttcagaaaacatatccttggggttttgaccaattgaattaacctatagtcaagttagctctaatactactttgtcacgccacaaactctgataccgctttgtcacgcctaaaaatttagccattttccagatcctattgatcagtaagaaaatttctgggtgtgagttggctcttctcttactttcctagcgtacttgcgtagaggtttcctacaagctaaatcagatcatttttttgcagggtaatgtacgtcaccaggtcatatctatccaaattcgataatgcatttttcttcattgtttcattgcaatctgcatagtaaaccacagaaggataaaattatcagcgttgatctctatcatctccattgtacttacgagttatagaataatacggaaactccaccaacataattgggtattaagattgaagattgtcccttgtttttatatgaattctagagagagttcagactagttgcgagacaacccaataagcacatctgtttctagctttagagtctctagaaggtgttggactacctgctggtgtatccttcctgaacctgacgtttcgcttatcgtctgttggctttcaccacattttgttgttcctattgatggtctctcaaagattcttgtatcagtttgccatcttcctccatctgttgattttcctccctaacaaaaataatacaacagcattaattaataatttgctataaggatggatgtattaaactacgttttccatgcaaattgtgacataaaaatagcataaatttgacataagaatataaaagtcatgatttgtacttacagagcagtgttttccttctctggtgacatttcaacacaagcataacagaatacacagccacaccttgctatcaaaataaaacgtaacatgattcaagagttaattagcaagaacaatgggacaacacatatacacatatgaactagtctttgcagttgagccatagacactgcatgccgtttagtgcaaatatgtacaacagaatgaacagctgtaattactatcaatactttttagcagaatggataaataattattacttttgcaaataaattgaccttgacaacactcacttttccacttgttttggactatcatcagttttaaaggaatcatctagacattgacgaaattcagcaaaatccagagacaaccaatttcagactagaccagctagccagcagagccaagccggccagcctaggaaggaggattggccagctaggtaagagttttttttttttttgacaattcggctaggtaagagttggcctgcctacgacctgcttggccgttgtccgttgaaccaagctgactagccaacaagggtcactattatttggaaacatgatctgatatagccagtgttattttagaaaagatctactgcaatgatccactaactacaagatatactgtcaaagaagtgctctcttctgatcatgtaatgcaagaaatactgatgtaggtaaattctccttcctgtgctttttttaggttcggacaagggtcgctagactgggtattatctgtagccattgcagttctcttcagttctaaggtaagtacataagttagtttgtgctattttcagtgagagcagaactaagtggtgctactgttggtatttcttaacgacattactagatatataattcctagcaatggcgcagaaatactcctggtatattatggttacaaagtttatccgcaagcgcacggatataccattgtagcatttcacccaagagtattttaagggtatcgtatttattttatcccgtgggaagatcatgtagagagaactcgactaataatttatatattacttgtgataatcatattctaagcggggttaagataatccaagcgtagagtgacacacaagcatcggtcactcattctcataatatattatctaagctaagtggaaagaaaagagagaaaatatattcctatacttctagtatacatagtatacatacattctagttatctgatatactagctaataccctctatctgatgccctcatggtacttcgagaagccactctgactgccgagttccttacgacagcccatcatgaccatacaactggggctaaataaggaggaataccctccccagggaattaacttaggattatatacacgcgcggatccaggaatacccgtactgagctgtcaccatcagcggcccacctctcatccgcagcatataaccccaaataatgatatcccgtaatctagacacaacgtctaaactactagatactactctaatatcattgtcatgatatagagtaattgcataagcaaacattatatctgcaccaaagcatctcccagataagctagccgtatattcagtataacatgaacataatgtaaagtaggcattcatatactcggaaagtatttcaataccataaatgtatatagaaatgtattctaataaaagtacaaagcttacaaaagaggaaagggaagctactagagccataccagaactcttccgaagacttccggactcctgatttctactctattcctattccaccagctagatactactaaactaaacttgagagaatatgagagagctttgcttaaggtgtgtgagtgaagtgagaaggtgatgggtttatatagtctcccaatgacggttgtgacggttggaatggtcggaaataccctccaaccgtcattgggagctaatccacaccgtccaaaagaaaccctgcatccaacggcgcctgggagggtttggccgaacctcttggttcgactgaaccaggggcccgcccaaccagcccaggttttggctggcggccttctctgttgatcctctccttaaacttgtgaattttggcccaattcatcgtgtcaattctgagttcttggcctattcatgcataagtctgattgtcgacatcgtccgattgatttatggtttgggttgatgtcgattctcctctactttatggttattctctgcaaaaggttagaaaacctaatactagtggaatattattattctaacatgtttatgcattgcaagcatcactagttctcctctattttggtaatattgacggtcgaaactgatcgataacgaccgtcaacagctaccttaattatccttaggatcagaaggtacatctgtaccaggtgatggagcatcgatatgatgtttgttgctcaggctgcaccatgccttttgccttgctaaatggagtatcaaattagattgcgtgtatcatagcaggacagagcatcccatacgaggaagatagtgtagagatgcattgtgaatggattttaacattgccgattatcacaaatatcatccagaaatgaacatggaaaaactatgatttaactggaaatcaaaagcaatggcatgagctcacattcatggatagttgttgtacttcctactgttctgaccaagaagattatattaacaatggaactaaactttttgcttgcaaatttcagtaatggaaatacaaaattttgagaaatggaaaatcaaagtaaatttaatacttgaatcacatcaagaaaaaaaaagagaaaaagatacccacctctgcaagaccaccacaacaccttctataactttgcaagaccaatctgtggacaaatgaatcacattattcacagtgacatgtaagtaagataaagggataaatcaaattactaaaagatcactaactatggggctgcatggaatcaatctattatcattgggctggccagaagaatctataaaacaaaagtgcacatcttatttttatatactccttttatttccacagaagctatcagttacaactatctttctccaatagccaccatgttaatttaacagagtataaaatggcatcattaactaaaggtcaaaacataaaagcattagaagatggacatgcagaaattttacattgacagaataaacatgatttagtgcagcatcaaaaagtgttgcaacaaaaaggagaaacaggattgttggtaccttagtgaagcaaagccaccatcaactttgagaggatttgtggcagtgaattgcaatgccactaattaatcaatatactaattaagcagtggtctatcacaatgtatattcggtattttccatctacctaaagtgatgattgaaaaggataataaactgatttcaattgtacacctacctccctgggtaggcaaacataaacacggttcaataaggaatacacattaaatgcacatatgtgaaccatcgaaccaagccataccagttttatcctggtcttgttttaccctacaacagaagttatgaccttatgaaagcattataagttttcgccagtgaaaaatagtgcatgccatcacatgaaattttttgaagtaatcatcagtgacatgtggggatgagaatctgataggttgaccaattctatggtagaaaaataatcatcaaaagctgattttcgtaaagaacaatacaaactacctgtgcattgaactacccaaatatcacaaacctagatcatgcattataaatgaatatgcaattcttcatataagatcaattagatataaccctttttcttttttgatgaaaactaagtgatagattatctggtaactttaacaccgtgctagaagagcacatatatggttaaaaccatcaaataagtaaatacctgtgaaaatcggacctaaaagttttctaaatttatgagaaaattactagagaaagatgtaggaatgtaatacatcctcatcaaatcttaagttataactcaactttacttgggagtaaaaaaacaaattttgggtaaatagtaacatgacactaatcaactgaattttgtctttttccattgctctcaaatgaagttgagtttggactatagatttggtatgaatatatgttatgcctatacctatctctagattttttttatgaatttagagaacttttaggtatggttttcacttattcgaaggttttcactgaatatttccccgtgcaagaatcagagaagtgaaattaaataacaatgatttcttcatcaaccaattagtggacaacaatacatgtctttgatcttgcacaaattcatcatgttttctttgaaccttctgatatattaatcacaaaccaataatgaaatccattgtaaggtggcagctaattggtgttgggaagtttaggcaacttaaaatagaatcaaagcaatagatggattgtggaacaaacactgagataaattgattttatacagtgcaaaaagagcagatatatagtgagctttagccatcgcatccaaaaaaataccgagagaagtgttggattattctcttaaataggaattagtcaaattgcataatactactagttggttaatttggttgcttattgctgcttaagtttctggcacaaattagcttagcttagttgtaaatgagtgataatgggctctagaatacacaagtgagttgtatgcttttgtatggtggcatggtaggatgcaaagaaaattttactagttagcaaggttgtacagtgtactagtagttttgttggtagcttgtgcttggtagcaagctatagttttgagctataaaaagccactgtaggtcgattactgtaacaaccgcctaaaagtcctgtaactggacatgtagccctctatgaaaacaagtatgggagtctatgcttgtgaaatatatgaaaatgcagctcctttggtgtattctgttatgggagtctatgcttgtgaaatatatgaaaatgcaactcctttggtctattctattatgttgctgtctattactatttgtcatgaaagaaattcatcttgatcttagaaaaccaacaaaaagcactacaatgcatatcattattttttttggtaccaaactaaaggtttttacaaacatatagagttatgatccagatagtttagttgttccaggttaggcctaagccttcagagacatgataatatgaaatgctactgttggtaaagaatgaactaaaaatgcaaagctatagtctcttttgattaagatgcatgactacatttggatgaagcatcatcaaatcatccacaaaagtactgtaaattgttatatgttgccggaaactcaaatcagcatactcatactttaactacaaagatatatcaatttctcatagctaaaaataggtttcgcgcaatgctaaactagagaaaataagtgtgcagaaaagaagaaaaatggcaggccctaatcaaccctttcaaaagatccatatcttcaatcaaattcaactactacccatcgtctagatgtaaagtctccatcaatagaagaaggccaaatggactaaattacatacaaaaactatcgagacacatctctacatgtaagtattactatgctacaaacatgtgagattactcttagttgagataaactactactagcaaactaacaatcagatattcaacccaaacaggcacaccagagtcatgtcgacaagaaaacttaaaagaaagacaactagaatgtttaccaacaagttaagatgatatatcctccagcagataaatgaatatgtcacggatagggaacggccgccaaccttttgaaacaaccaatctatgcatcgcatcaaggtagtcatccttgacaaccaccattccttccggtgatccattccaaaaatttcccacaactaccataccttaacactgaatattcccttagaagtgcaactttcgaagcatttcgcacatcatccaagatatgcttgtaccacatctcataggtaagtcaccaatattggatccaggcacagagcaatgaacagggatatcacccctaattacatggtaactaatatgatctacaatacagttgaaccagaaatagtggagacaacctttgcagcggaagtggctatgcttaggcctatattccatgcatatgatgcagcggaatgtcaggctatgagagtcatcggtcacaactggaaccttctcttccttggtctctccatgttgctctggtggtatgttgctttggtggctttatttgcccacacatttatttatatataggtgtaaacatgaacgcttttcatgtgatgtatctgtttagtgaatctagagatactaacaaatgattggacagctcaaaattgttagtattggttgtcgtgcatggctctagtgattaacataaaagatttttcattggttatttcttcggatataatcagatacgcttgcgacaatggaagagcaaatcatctgggaaataaatacaatcagatatggtggctggactaccatttggaatatttatttacttaatgctaatcttcaattttacttggggacctccatttaacaccttcaatgataggccttccatagtggagaaatccaggtttttcacatgcacaacattctatatctgttgcacaatcttcacttctaaaccaattctaggactagtttggtgtccacctgggcttgccccctgtgtgtgacaccaccgacttctggaaacttgtgatgccatcgccagcccataaatgaccataactatgttacacaacaatgaacaaaagagcatgttttatagttagattcgatttttatatatttgagaaaatggtattgcgccatgagtattgtgtgttttgttttttgcaagcgcttgtgcaaattcacgaaaaggaagcacatatgcattcaatttacagaggaccaatgaagatgattggggaacatagtggaaaaagcccgaccggttggtgacccggtcaacctttttgctggtctaatgatatgaccgatggatcggcgatcgaaccgcggttcactagcatacatgttgtgtacatgtttcaacactaacacattcacctaaatggtaggatggctacatgagtttgctttcaacctatcgatctaagttcgactccccattcacatgccttttcatgggattttttgccaaaaacaaaaaaaaggtgttgtgaggcccaaaactaattggaccatctggtggccccttcactcgttgacctgccttagtccaatccgaccagatgtggcatattgcccggttcacctcaaaaccgaatggttcgagcggtccaaagcggttcaattacatgtccagtctttctattcaactaaaccgttccaacctctggcttcgttgttttccggttgaaccctaatccagtcccttcttttccactatgtgagggaactggtcaaatcctaccttcaaagtttcttagtgtcaccacatcatccatcgactaagaaataacaagttcctgttgaatatgtccttgaatccaatttgtcctcctgagattgtgcaacttcaaacaaccacaagatttgcatacgatacctcaaattcaatctgggtcaactgcgatcgatagaacaatgacagactattatcggcccattgagccttcaagactagttgttgattttcgatttgaactatgtatcgagtcaactcctcttcatttttaagtgaggtagcatagttttaaggctacataagacctaacgtataaatcaatttagtttcttcatgctctccatagtcaacacaaagaaagcccaataactcctttcatgtgataaactaacaattcctccattcttccctttgcttatccaaaactcctttatatacatgaacctcatagtgtattcaatcaccgagaatctagccatttaatacttagcaaatatgattactcccaatgatcatgccatattttctaatattgtaagatataatataactcttggtttctaagactaagacccacaaattaaacctaatgcaataaacaatagtctatagataaaacaaattaacattagagtttttcaagaggtaccggagattgaacaatctccagtaatcatgcacaagagtgttcctccatttcttgcccagaaagtccattggtgctcttttgttggtagttgttctccactccaaataggcgagctccaatccttcacacaaaccagtgtacctcataatcttcttccaagagagatctagtaagcttagtggatgcatcatcggaaaggataaaactgccaccgggaatagtgttgcacttaatccgttatttcattgcaaactataaaactgttgtcgaaacgacaaccgcatacgtcgaaagatgtggttactcaacagtggttggaaaaacgaagtgtattaaattttgaatttcactcggggatccccccgttacatggccctaggggactatttatagccccattacaggttcttactactagggcttaggttatacaagggaatttacatgattacccttacaaaagggacatttacaggggtacataatgttataggggctcatgggcccctgatgggctgtctggcgatcgccggccctatagcccctaggcttgatgggccggaaaggcttcctcagcccttgcggaggcgaacttgccatggcgaagtcgtcttcctttggcagatagtcttcgccttgcacccttcgcctgagacgcctctggcctggcaagtcactcgtacgactcttcgcctcacgccgttcttgctccatagccttcgccacgggtttcgacagattcggttgaagggcctcatgccatccgccaacaagcccctcatgggcaagggtgagattggagcttcggccgagaccgtgcaaaccatgtggtatggtatgcggcgccccctttcgaccgatgctcctgccgaaacctacattattcctgtgaatgaagtttgttacttgtgcggctggcattattttgccgcgcttcacctcctgcgattggtggttatatattcccgggccgaacggaacagtattgggctttcccttcgtgggctttttactgtgccgctcggacggtgggaatttaccgtttcgcctacccttgcgacacgtggcgctttattactggtgggtaggcgaacggtcgcccgggtgagctatatattcccaccgctctttccttttcaccgccacacttgccattttaccgcgtgcgttctcttcctccatttctttcttccatagcatctcttgacccctcaagcgtttcggccattttctttcttcgccatcgcaaacgcactgttcgccatggcccctcgcaagccaaaccctgcttcggcgaaagggccggatcccggccgagtcgatgacgacagcaccgcctttttgggggtttctcttatggacgacgtcgagctggtgaagctggtcagctctggggcgttggttgaggggcaggctttcgccccagggaaagccgtggtgccgaaaccaatcgacaatcggacggtggtgttcaccgtcttttttaaggcagggctacggtttccctgcaacgtgttgttgccggagatccttcgcctcttccaggtggaacttacacagctgagcctgtcggcgcttgttcggatcgctattttcgactgggcatgccggacttctgggtttgagcctaacgctgagtttttcggcgccatattcttcgccaccgtgaattcgaagacggtgattaccccagctgggacgaagaagaccgtgttcgggagtgtgaacttcaacgttcgtcccgagcggtccgatctctggccggtgaacgctgccatgtcgaagtgggaccgccattggatggctaggtggttctatcactccatccccttcgaggctggttctgactcgacaaaagccctccggtgccggcgcagggcgatcgcgccgaaccggaaacccaagatcgccgtggacggcgctttggaggcgcggttcgttctgctgcgcaaagtttgctcccgccttagctgccatgacttggtagaggaattctgtatgcttcgcatctttcccctctcccaggcatggcaagtcacggttgatcaaggcgaagaggttgacggtttgccgaacctgattcttcctgagaggacgaacagtaagacggttcttttgctatatactgctgtgctttgttattttgccttgtctgacttttaacatggctacacacttttacttttgcagtgttaaccctcgactaggctgaaaccgaagcccgcaggatgatcggcgacgtatcggtcgtcgagtatagccagctgctaacacgacaagcgtctgggcaggcgaaccgggtttgtaacggcgagttgcctcctcgggcaaacccccacaaagcggacgacgatgcagggccttcgcaaaagcgaatgcgcaggcaagtgaagcttgcccctaggaagcgaagggtccttgcttcgtcggactccgacgccgacgacgaggacgatgccgaagaacgcgacggtgagaatgaaggagaggaggaagaggaggaggccgtggccgataaggccgcgaaagaggcgatcgaagatcgcgtcgatacccccggctacactcctaccccaagtccaggtcacaacgagaccggggtggagtcgaacagctccccccttcgacggaaggatctggaaggggcgaaggctctagttgcgttctccttgggaacggtggcgaagggaggtccggtgaagaaggtctccaaaaagaaaggactcgtcgacatcgcccgcgttttcagcgacgacgagtcttctgacgagactccgacatcgcctgctggccgcagtttggacctttcgactgctccccttgcttcgctcagcgttgctggggcaggcggtagccccgccgccggggcttccgcctccgccgaacagatcgtgtcggctgcggcgagggttttcgggagccctgtgcgtgagccagctatttcgccgctcctatctttcatctagattcttgcggctcactgttcgacggagcgaaccgtgcgggcccgttttgacggttttaagagccgtcttcgggccaaggatgatgaaataagccgcaagaacttggaggtggaggccctggcccacaccctcaaggaggcgaaagctgaagtcaaacgccttcagtccgaattggataaggggaaagaggccaggggcgaggttgatcgcctcaaggccgaactggagaaggagaaggcccattcggcggtgctcatcgattactacaaccttattgagccgaagatggaggctcttcgccagaaggctagcagggccgaagcgagcgccgcggaggagtcgcagcggttttcgcgggagatggcgaagaccacctaatctgcaagaacggcttgccaaacgctccgccttgcccttaccgacatgggcgcgaaggtgcgtggggtccctgccgaggatgcctcagcctttgacttctccgagtggacccagcaggctggtagatcggtttcagactgcgccaccgcgtacggcgattgctgtgcgcgtgtatcggcggccttcaccttaggccttttgcagcagttcggctgcgagcacgtcgccgagttccctaccaacgtgaagggggactgggagattagtgcgtagaatatttcgcccgctcttcgcgcgtggcgaaaacagttctggcagaaagacggccggtccgctgccaagacgcgccttctggagcaactggcgaaggcggaggcggcagatcggtgcgaagaagagggtgcggtgggcgaagaggttggaggcgatgcccaggatcaccctgaggtgtgaggccctccgccctttctttagagttttgtagtttttctccctcttttgcgtttgcctagagaggcaaatgatgtatattcggcaagttgccaccaaaccttaaaaaaggcttttttgtatatttggaatgtatggcacaatgttaaattcttttttgatgattgaagcctttagcatattattacttcgctcatttcgcattatgccatacctcccccttcttttgcctattcttactatataagctgtgttttgctttttctgcgctgtctatcagggggttcgccgaaagttgtgcattcggcccccttccgggagctagcgaagtcaaaacgagaaatttgtggcattgaagggtctgccgaagctgcgatgtccatttcggcctgtttatcgcgaaatggagataaatggtcgcagctataaggtttttaaggttgccgactggctgcgggcgcaccccgggcgaaccttagaagattacgatcttgttcaatcaagacgtttggaggatatggatcgcttttggcgaaaccatcagaagactaaacgtcaggaaacgatctttcaacgtcgttacagtttagtctgtgtttcgccccctactcctcttaaggttgtgtacgatattagtagtgatgacgaacctagttcgcctgaccattccttagggagggatagtgattacgggggcgaaaatgtaatttacttgtaaagtaaattgtatcgtgttgtgaaccttctattcttcgattatttttttttgaagttaataaagaacgtgctttatttccttttcgctatttttcgcatcgtcacattttgtgcttttgttaggttggaacatgccggcccctttgcgtatattagtgaaataggtgtactgacttttcagcttttcgttattcgttttcgatctgtagcattttgtgtcgaaagagacgcttttgcttttatgttgatcgaatagtaacgtcgttcagctagttattttccgagacaagctgttgcggtttcaacgttcggcgagcgatgcttcggccgattcgtttcgcccccctggcctttttcgctgatcaggcgtttgccttggggtttttccacaaattatcaatcacacgaaaaataaaaagaaggcggaggacacagagattttatactggttcgggcctccatggtggataatagccctacatccagtttttttttctctttttttttctcttttttttccttgccgaaaagcttacatagtgccgaagggcttacatgacggtatgtatatttttacaagttggcgatttgggtgccacccattctagacatagaagcgcttgagagaggcggcgttccaggaatggtcgaactcctcgccttcgagtgtcgctaggcgaaaagatcccatcctggacttgtgtttgatgaggtacggtccttcccactgtgatt

SEQ ID NO: 79399 - DNA, 26216 bp, Oryza sativa
tattgcccttagttgtttcatatttttatcaatgttcttgacattgtaaaactgggggggcatatatgtctatcacaatacagaagacaatacagtgcaaaaaaattttttgcaaaaatttttgagcaaagcttatatgtcatattaatcggcaaaattgagataagtattgctggatagccgatatagctctctgcctaatttgttgtacttcttctatggcttgggcatcttgagcatcggttccaggaatgaccttcagagatttggtcatatcagcaacattcttgatagccgattttaactttgctctttgttcttcgatagattgtgggagatcggctaacttcttgtgctctaaatccagtttggcattgcattcttgaagttatgctaagagttcaatcttgcgagcttcaagccggtcaatattggatttgatcgggacttcagataattgatcgagtttggctttttcttcatgaacaagttgccgattagcctggattgttgcttcaatgtctttgcgctctcgatgttcggctaatctcagcttggccttttccagcttaaattgatgttgttcaagataaacagctggagtaaggatatcggctaactcatctaggatttgagtttggacctcatgaagatgagtcctaattgatccacagtcgactactaggctgtctagtgacgatgtctctagctgatgagagatgtcttcaagagttttctttacgtcatcagagaaaggagctagagctttgctagtagtgtcaacctctgtctcttcatcaagataatctctgatatcaaaagagaaaagatcggctaagacctgcagtgatgatttaaagagagttagagatcaaataggcataaccgatctgcatatgttggttataagaaatttactgggatagtctgagcagttagttgaacttcttcttctatgtaatgactccctacagccgatggggtccgatcgcttgatgattgttgaataggaggagaaggagaggaaggaggctgaaaatagacaagtgttatataaaatcggctgagattaactaatgaaagaattaaggctattgcaccggtgagctggtttagatgccattggagccgatttcttcttcacagcagccttccttttctgcaattaccaggtatgtgagcaatcggctataaagtaagatgattacaaaagtggttagagaaggttgcttactcttgtaaaaggagttggagcagaaggagttggaggggtctgcttaggtgaagccgatggtgttctttcagtatcgcttacttcggctgcggcttgatcaacatcttctccgatttcttctttatccagagcttgttcaatggatggatctagggcaggcagatcatcagctggtttagctttctttttgatcttcttctttggagccagggctgaagtatctacagctgatgatctggttttccttttcttgccggcatcggctggttctctgatgagctcttgaagaagagctgaagtcttgggggcatcatagccgatgacaggaggagatggcccacctccattaggaattaagcctggggtgtaggtgatgtccctgccactgttgctttgacgaggaggggaggattctgttgtctacaaatcaaagaagagattagttaaggtaaatcggctaagcagttattcaaatgaaatcaagtaaagtcaaagacttacctgagggacaacatctggaaagaggtttgtcatgtacattgaagctagttggtagaatagatgcaacttccattcaccccaccatctatcaaagtttttgctcctgaacattgctagctctatgttttcaatgctgcccagagggggtcctggaaggctgagcagccgatccatcatcaaggttgatgaaatttctcctcggcattggatcttgtcagcaaagaataagccgattgggagttggcccattccaagctgtctagctgaactcattgggtgatagaattcataagaggcttggatgtttcttccttgatggatgccgactggaagaatgcatggactgattgcagctatgaagacttctctggatgtttggaatctttcatgattaatgtctttgaatctgaaatctgatgggagctcgaggtctgctgaatcttcatagggaaaccaaactcgagcatctttttgaaagccttcatagaaactgcagaaccaatctttgagcagatcggctgataactttgctccagcatcggccggtgtggatgcgtatactctatatgacatacatcggcgatgagtgcgttcttcgtcatcttctataatcggctctaatctcggaaattcagcttctgtgacggatggccgattaacgactttcatgactattagattcaaccaagtctgcagcagccaccatggtccacctgctccaactactgagccgacagctaacttagccgaagcattattcagcatttggtacaagtagccgaggaggattttgcctaaaggaaattgtttctttgcttccaaggcttcggctatgaactgccagttggttgtagggccacagcttgatccataaaagaggaatttttctagccacattagcaaaaaggccacatgttctcgagggtgacagaaccctggctcatgtatgctgctacatagcctaaccaacctcgtatactcttggttttgaagtcgtattggttcttcatgttcagattcatggggttagccgttgaggtgacatccagacccatgatcataatgatgtctatgagagttagggtcatcggtccttggttgaataagaaggcgttgatggtgttggaccagaagtaagaggcagctgccattagaggttcatccttggctgagtttgctatggttaggtcaagtgcttggccgattccgatttcatcccagtgaactcttttgctagccgacatgcgcttgaaccatgtaatccaacttttctcgggtgatgttttttctagagacggccaagatttaaaggtgttcttccaatgacctagatctggattggacagtctaaaaggaatcctattggtctcaccgatgatgaactcagtggggtcggggttgccgattgggccgagaaagtagtggttttcatgcgacaagcttggaattgcgactaaattggagagatgctacaagttcagagtaaccgagaaaagaaagcagtatgaggcgagagaaaaccgatccaatgatgaaaaaggggatctagccgatggtaacttacctcagcgtattcggctgatggtgcggcagatgggctggcggaggtcgacatcgtcgcaggcggagatctggccggagatgaagtcgcctggggatcgccttgcgcgtcggaggaatcgccggagagagagagggtaaagtttcgcttaagcggggaaaacggaagtcacggtgtgagatttctcagggataacggttagtatttgaagcactagagtaacaatcgggaaaacggcagagtgcgaaacttgctcggagtctatacacggtaaatccggaacattaccaaatatcccggacttggggggcatgtgttacgaccaaatttggtaatatcagcatcggagatgaagatgaaatcgaagcggaatcgaagataagggttttttcggaaacagagtaagaatcggctggagtccggatcggctacgactgggatcggctaagtctgagttggactggttaagtgatacagccgattccgacaatacgacccgtgtgcaacattgggttcgagttgatgtgcttcaagatgattgtcacgcatggatagagtcctgggaaggcaattgtatctattaattaggatattttatgtaaattccttagagataaaatgtgggcaaaagtctgccgcaaagacttatggtatcttagagtttgttagagataagagtcgtgtccaatatggacatatcttgtatttctcgggtataaatagaccccgagccctatgtaataaaaacatacacacgttcaatacaatttcggcgcatcgccaccctttttgctttcgttttatttcgatgagttattgctttcgggttgagctgcatcagtttcgatcttcaacaagaggtaaaacttgttatggcggcttgtgttctcgagattagcgcttccatctttatgatactctaatcttgtttatgtaatctgtcaagttatcatatatcttgcataatccttgacaatatcgtcatttaacctacaatcggctaacatctgctaccagaaggcagccgattaggttaaataacgacgttggcttagattatatgagatatccaccactctatgaaacatccagcggcttgattgtctagatattgttcttctttttatacttaatgctgtatcagttgagtttgatctattaagtcgtgcttagaatttcaatctctagcctacctactggttgccgattagggtagtatcggagtttcagccgatcttatctgatccaattgcttttgttctacatgctcaattaacatgttagatctgccctttatgttaagatcttgttgcatttaagtatattagatttctgtttagtatattctatttgctttaatatcttaatataaagtagtatcgcagtattagccgatacacgctagatctatctgatcggctatgctatgaatatatatataatctcattattaatatatatttcgatctaggtgatttatactgtctcggcaaggtgatcgatctatcccaatcacttgattcaagtatatatcgatataaggattatatatcattgatatctacagccgatcgagtagatttagttctgatttgtttacttaaacaattgccgatcgatttacacatgacatcggctcaaagataaatgatatgtcatcggcatctagccgatcggctatcatttatgaatttaatcacggtttctttgtctttgtttcttgttgattgcaggatcaaatcaactgacacgctcatacatccaaagacgagttttggacctgcactggagttaagcagatctcccaggcctcgtgttttctatcaacacaagggcggccggatccggtggctgctccgctccccattgcgtcggcagatctagagagggaggcgctgcggcagcggatctggcgccggcgatggcgggagcagcaacggtgggcttggccgatgcagacgaatgagcgagtgatggcgggagaggggggcgctagggtttgttttttttttgtgattttttatctttgcatgcggtccgcataaacacccgcatggaaaaatcgctaattttaaagaccttttgatgcaaacggctggctcaacggcgtggaaaaattgattttgaccgtttgagaaaatgtcttttgtattagtgcatggagcaacctgaccttgctgttctagagccccaagcacgtggtgaccgtatctccatgctcttccacctttccctccctcggtccctcctgagcagatctcatcaacattgcacacgtgggggaagtaatagaggcggaacaacgacagtgaagaggaagaagtggagcagcctaggagactccttctgctcatcccatcggctggatctgatggccgtcatggcagggagaagaaaggccttgttgtgccactaaccaggtgtgggtgggaagataggaaaaggtgacgagagattgggaccggagggggagatggaagatgagagagattgggaaaggataagaagcggaggaaacaatggacgggggacttattaggatgtgtttagttcgcgaaaagaaaatttttaggtatcacatccgatgtttgaccggatgttggaaggggttttcggacatgaatgaaaaaactaatttcataactcgcctgaaaaccacgagatgaatcttttgagcctaattaagccgtcattagcacaagtggattattgtagcacttatggctaatcatggactaatttggctcaaaagatttgtctcgcgattttccatgcaaactgtgcaattagtttttatttttatctatatttaatgctccatacatgtgtcaaagattcgatgtaacgtttttgggaaaaaaattggggaactaaatcagaccttagtggctttctttttctatttttcccactacatgctcggcctcggtttggctccatcctaaaagtgttgttttttcaaaactactacactttggttttattacatatcagtgtcacattttttaaaaaaaattgacacctatattattattattggtatcgttttttcaataaatcagtactgcatcatatatgcgggttttaaagccgcctagaggtcgggggatgggaaaggctaatatgtgccggttctgagtgactagggtttttagtagtgctattaggctattaattagctgcaaatgcaactaccgcttgcatgacatacgatcgatattcatacatgactcaggtcatctgatgtgaaaccacttaaaattaattaatctgcaaatttaacaaatagattgaactcggaatcttattaattaatctattctctcacgtcgtcctattcctcaatgcagtgatcttaatattcacatggatatcatcaatgcagagtaacagtgcatgttagggaaggtgcatgtgtgaagacgattagaatattaagattaataatctctggggccttattaattagctgcgaggagtactaattttttttttaaaaaaaagagacgttcatttgatacctaatactccgtacatattaattatatacgtgccttatgtttgactcgatcgtcgccggccacaattaatgttctaatttgatgcatgagattcagttcacattgttgcttggtctttgaatttagtccacttgcattggccttgcaagtgttcgtggaaaatgtgtggcaaatcccgtgtacgtacacaggttgaaattatcatggacgccgttcacacatggctgaaacataatacgcctgtgggagaatgtagggtatcttataccatctaaagctggcaggattgctgcaagttgaattggtttatagggatgctcaatatataaattgttgacgcgtgttgcttttaggagtcatcactcaaaatacttcaagctcatggaaaagaataaaaaattaaaatctagagaaatatagagccttcaaatttggtttgatccaagtgacctaggagtaaacaaaacaatattaaagctaaactaatgataaaaaaggttgaagacacctgtagcattacctgataaaatcaaataaggggataaaaatataaatgaaatccagaaaataataagttaaattctagatgcttcccaactatatgtcccattgtaatctgaagataaatcccctttcaatttcttcttgttcttcaatcaaagaaaagtacggaattacttgagagtaaaatgaaaagaaaaatccaaacaacatcgtgcaagtttcaaaaaaggaagagaaaagaatttggaagaaaaaatgcatttttgcccgccgcaaactgccgccatcttcgccctcccacaagccactgccctgggtcacgagcaagccttgggagcccaaatctagctctaatgaagtggggacgagccatcagggtgagagagggatgacaaagtgacatgagccctcatctgccctcctccatcttaggaccaatgggttcaatgacatcctccacggctctatcctccccaacagccttatctcatgggctacagtaggagatctcgccagcttcttagtataggggagagaagtgcaccaacggtgagggtgagcaagaggtctatcgcatcccatccatggtgtagggcctaacacggctgtaacatcacctcaccgcgtagctgcatgtcgctcttgtcatggcatgtgttgtgagcccaacggcccaccctatagctagcgccaccaccgacaccaacattacgagtgccagagaagttgttgcacgcggatctcacctctacgcatctcgcaagaagttctcatctttctgagagagtgagtgaatagccatgatgacattggcgcgtgaagagagagagagaatgtgcgagtgggaagcggggatcggggtctagggagagaaagagagacagctcatgtgccaatcaccagtgtcacacgaagagagacggcactgtggccgagagactctaatatcatgatagaactaaaagttttcatttctccatttaaaatacttcttcttattatacactacatcaaataaagaatgtttacaaaattacacttatgcaccgtccatgtaaaagtacaggcgacttgcgagttgttatccagaagctgaacaactttcaatgcctccttttaggaaaactaaaaactgcagattcccctgaacagcaaattaaacacgcctttcctcttcgagaagtaaggcaggacataaacgaggaatgcacaccctaaaacgaagtttccagttaacagatgattcccaagttatggtcaaaacaaaaacaaatagtacaaggaaaaccagcatagaatattagcgaagaagagattctctcatagatacacgctatctgcgccatgttaaccccaagaagacgccacaacgtgacacgcatgtggccacaccaaacccccgggcggccatcacgcgtgcatccgccatatacccccggccagcactatttataccccctctctcatcgtttgtttcgatcacttcactacttcagcacacactgaacttgttgcaaagagagacatatagtatatagttagtagcttaatttgcagcgctaataagctctagctttctcttcttcctagcaaattataattaacactaggttctagctagcatgggtgtcgagaagacgacggcgaacggcggcagtggcgccgcggcggtctccggcggagggcgcaccgtctgcgtcaccggcgccggcgggttcatcgcgtcgtggctcgtcaagctcctcctcgagaagggctacgccgtccgcggcaccgttcggaaccctggtatgtatatatattgttatcggtagtttttaagaaatccatgtagattaatacgtaattatgtgtgtattatataaaagtatttttgcagtttgtttggtgttccagatccacgctagctgggtttaatttttttatgttaaatcatagtggtttaaaaattatattttatttaaaatgagattaaaataatttattcaaatgttaccaatataattatgtatttggatttgtagagttataaatatccaactctgaaaatcttagatcaggatatgtcgaacaggaccttcatgttgaaacacatgataaaaaaacatactccagatcttatgagcaaaacagcgtacatacacatgccgttgcagcaatatatcggggatgctgagaaataaagaggcaacgatcaactatcacaatctcctaattttgcaaatcccgatattaatatatctcaaccgtttgaccctcgatcgattaatcttataattaagtaattagcgaagaacacggccggcccatatggctggctgacacaccgcgctcgatcgagaaccctggtagcaacagaaagggtagcaaaattaatcactaatgatgtgattagtcagcgctagctaattaattctagtttctttagctaactcattaactaatgaattacttctaattaattgctgcagatgacgctgccaagaacgcgcatctcatggcgctggccggtgccgcggagcggctgaccctcgtccgggcggagctgctcgacaaggagagcctcgccgccgcgttcgccggctgcgagggcgtcttccacaccgcctcccccatcaccgacgacccggtacgtgactcatcacctgcaccagccggccgccggcgacgacgagacgacgtcgccgtacgtgttcgacagtctaagagagactgaccggaatgcatatgctcgcaggagaagatgatcgagccggcggtgagcggggcgaggaacgtgatcaccgcggcggcggacgcgggcggcgtccgccgcgtggtgatgacgtcgtcgatcggcgccgtgtacatgggcggcggcggcggcgaggaggtggacgagacgtgctggagcgacctcgaccactgcagggacaccggaaactggtactgctacgccaagacggtggcggagcaggcggcgtgggagctcgccaaggagcggcggctggacctcgtcgtcgtcaacccgtcgctggtgctcggcccgctgctgcagcgcggggtgaacgccagcacgtggcacgtgctcaagtacctggacggctcggcgcgcacctacgccgacgcggcgcaggcgtacgtgcacgtccgcgacgtcgcggacgcgcacgcgcgcgcctacgagtcccccgccgcgcgcggccgctacctctgcgccggccgcacgctgcaccgcggcgaggtgtgccgcatcctggccgccctcttcccggggtacccggtgcccaccaggtgcaagggcgacgccggcgagacggccgaggggtgccggttcagcagccgcaagctggcggagctcggtgtcgccgtcatgccggcgagccagtgcctgtacgacaccgtcgtcagcctccaggacaagggcctgcttcccttcgtccctgccgccgccatgccgtgagctagcgatcgccggcgcgccgcttttgttttacataccgctccggccggccgatgatgaccacggcgacgtgtcgccaccggctggcctgcgtgcgtacgtgcctgtatgttcgtcggaagatcagaagttgtacaactgtatttctcctaagggccggtccttttcggagcacctataaatcgggcaccgattagtttgtcaaaaatagcgtgctgtttcactaattaaaaaaaatgtttcaccaactaaatcgaaaatgtttcaatcttttaaaacactgaaacacacaccgctagaaaatcgcttttccaaacggaaaaaggaccacctacacgcaaaggcatgtgaaaatagatgattttcacaggcggcccagcgaaaaccatttttgcaggctgcatctattttcgcaggcagtagaaccaccctcctgcgaaaatatttttagcgaataaaaaaaaatccgccgccaccaccctaacccgtcggcggcgccgccagcctcccctcccctcccaggatccaggcggcaacggcggcgtcgtcgttgttgttatcgtcgtagtcgcggtagtcgtcgttgtcacggccgggcacgaaggagtagagctgcgggagaggagagggagggggagccgcacctcccctctggccgcgcgccaccgccaaagctcccctccccttcccagatctaggtggagtcattgtcatcgtcgtcgtcgcagcgaatgtcattgcggctggccgcggagggagaggagagggaggggagccacgccgtcgccgctgccgcctcagctcctctcgctgctgcctcccctcccctccccggatccaagcggcgtcgtcatcggcgttgtcgtcgcggccagcagcggagggagagtagatctgagggagagggagggaagccgcacctcccctccggccgtgccgccgccgacgccctcctccagcaccgccccttccctccacccacgccgctcttatgagaaaaaataaaattagagatttgtcacaacttatacaatactccttctaatccaaaatataagccacaaccacctttaacccaaataaaagaacaacaattatcgcctcctcatttggaacacctcctcatttggaacaccttaaaagatacaatgcatgcaaccaatataattagagattttgaaagtgaagtaaataataattttaagggcccccttgaatcgtaaaattgagaaaacataggaataggaaaaatgtaggattttgatagaaatgtaagtgtaaaatagaggattgcaaaacatagaaataaccatttgattggaccacgggtaaaacgcaggaattagaggagagataaaaactgaaaggaaagtttccacaaggttctaccttatgttagaattcctccaaaatttgcatggtattatgcattctatacgaatttcatagaattccataagatccattcccttgattcacagggctatataggaaaaattcctacaggaataaaatcctctaaaattcctatgaatttcctttaaatcaaagggggccttagtaaagaagaggtgctagttaattacactcatgtatgcacgtcttatattataaaaaaatttaaaaatatagttggaccttatttttttaatggagggagttggatagtaattaacttttcaagagatgtaatctcattggaacgtgagatgtgccccattcttagtacttatataaaagccctctactttttgtgaaaatcacaaaatttcagactaggctttaccatacgatgtaacgggtgaggcttgatccgaccaacctctatataagggccaaggccggttctattggaagcaatctactttcaacacaatatagccaattgaatcatttttttcgatattgcatctacttttcgcctagtttagcttagttttgtccatctttatctatttgcgttatgaatcgtccgcattcgctgtgagagtgcgaaatatctttgcaggtttgtcccatagaccttctattcgcccatgaaacatgtattcatctttagttccatctaaatcgactccgctggccggttaatatatcgaaacccatcttgatctagtttttttgctaggttggggtggttagcgactccataccaccgcaaggctttaggtatcctaatcgtgattgtcttcttgccaaaaaattccactaaaaattcaattggtgtattaaagcatagggaactcaagaaaaatcccaccaagctatttccatttattaaataaaattattaattagggttagctcaaggttaaacttaaacaatttcttttagcgatttattaaatgaattaagaccagaaaaaggaaaacttcagggcatgacatgcattatgccttgcctccgagagcggtggcaatggcgcacgagggacatgggcgatgccacagccatacaaattagtcaaaataccatctttaaaatttcaactaacttttcagccactcctgcaatttcaatttaaaggtttaacatatgtctacaatgtaaataatgatacccgtgcaatgcaagggtcaacaacgactagtgttacataattctccatacagtgagaactggttctccttatacgcttattctttgttgaaagtccacacgagaaattccacattaccacatagcatgctaaaggtggcttataggaaaactagatgttttcccgaagcagattattcaaacaacctctcaagaaacatagagaaagcatcaaatagtgaaccctgacccatcaaacttctcgttaaggattgagtccaggtgttgtcccatctcgagggtcatatggttcagccaatctcctgccactccctttctgaagtaggcatcgttcgagaacgtaatgccgacaccctggtatccttccctgttgatcttttgtttcttcatgctctctaggctgcaaagctctacgatctctgcaacaacacccgtttcttcttcggcatcagaaatcggctgcccaaggaactctgctaattgcctaattgtgcccatcggatcttggagcatctgttcatatgttaggaagagtaccctacttggctcttttttgcttgcgttccagtagccgaggatgtgatcccagacaggcccacaggcagaagtgccctcgcagatagacttgtacacctcggagaatggcacatctgatccaatacgtttgatacgcttgatgaagtgccatgtggagactgctctgtccttctcatctctgcaaattagcatgtcagcaacaaattttaattcaagagatgcaattaactcttaaacttttctaatagtgaaaaccaaaagcacggcatgcattgatccacgtcatccaaaaatcatgaacgttggatcgcactagtaggaaaataatttttgcatgtcccctaccttaattccagaggtggacgaagatacgaatcacctgctttatgtttaccatggtaggggaggtccacgaccgttatgtaaacaaaataccatgggcgactaccttaagcgccctcccaaggtaacatgtttttttcaggcaactgtcttataactctacctatgaaaacattggtttatttacatgtgtgatgcagttaataccctgctcatatcatgcaatttttcaggttgtgccgttaaatgcccacgcccacctagggtcggagctagcacaaaataaaataaaggagggttcctcttgcttgctttaccctggtttgaatcaaatttagcttaatacgggtgcctaactttgaactaatagagtatttatatggtgaaaatagataaactataagtaaaaaaatttttgaaccgggtttctaggcacctcctagctgtatgtagctccgcccctgtgtccacctatgtcatgtcttgttcatcttccttgtatgagatgggtaatcgactagtcgtggggccatcgcatgaggtgaagtctagggcatcaaccagctgggaggaggaggcacctgtagaggtggaggagaaggtgcagccagagtcctcacatgaggacccggtcgtccccattccccaagcacgcactctggtatgggccgaccactagcgccatggcaccggctgaccgggccctagagtgtgctccgacaggggtcggccataaacgttggctctagaggcaaagagattatgcagcaactaattagttagtcttttttttatcatatgcccagggtatgacaagtagtatgtaattagggataaacttttgctttgtattatagtatcttgtttaatatattaaatatttagtagaaactaatatatatatgttaaatatttttttcgaaatataccaatgttccatctcgaaaatattttatcgcgggctattgacatgtggaccggtacaagtttttggcttgtcaatgacatgcatcccaacatctttctaggtggctttcataagatatttttaatagataataccgtcgacttttagcatgatatttgactatttgtcttatttaaaaaattatatacatgttatttattttgatgtgatttgttttattatcaaagaaacttttggtttgacttatagtttagcatatatttacagtaaatttttaaataacacgaatggtcaaatgttataacaaaagttaatgacatgatatgagaaacatcagacattgtatttattctatgttgaaaatgttgctatatttttctatgaattttaccaaattgaagaagagtaacattgctgcaaaaaccctaataaggactggcatataggtgccgatttatttaaaaccggcacctatgccccccttttccaccctgcgcgcaatgaaaaaaatataacctgtacctttaaacactataggtgtcggttcaaggaaaaatccgataccaatactgtatatgttggtttctagataaaccggcatctatacttatattataggtattggttctagaaaacaaccgataccaatactataggtgtttttttaaaagaaccgatacctatactagtatagatgccggttcttttaaaaccagcactataggcgcctgttcttttaaaaaatggcacctattaaaaaaaagtccactgacgcactgcaagtcacaaccttatcccctctccgtctatctctctctcaagtatgccgctcctctccgtcttcttcgcttctcaacaccgttgggtggttctcgtcaccttgaggagcggcgaggtgatggtgggttttctcctcccagccttcacctcctccagatcctcctccgggccttctcctcctctagacgcaccaacggcaacagcttttcatctcctctcctctctgctgccttcttctctccatccgacaacagcgccaatgatggagaaagccaacggcagtggctacggtggtgaaggtggtgaggtgtggggtggcggtggccgggattttttttattcggtgaaaactataggtgccggttccagatccggcacctatgcaccctggacataggtgctgaccaattggttgaggtctttggaacgggcactgatgattatttgtgcagtgtaaacaaatccaaaactggagggagtaggaaaaagaaggtacctgcaaacatatacgatcttacaatcatcattgtcggttattgaagaaggcagcagcgagagtggcaggtgcgtgttcaagagcctcggcgacggcagcttgtccagcacaccctcccgcccacacgcgaacaggccactctccacggtaggcacgcagtcgtgcgagttgaggcggcggagcgggtggtcggggctcgccggcgggaacaagccgcgcgccatggtggcgaacgcgagggccttgagccacgtggtcccggccttgggcagcgtcgcgagcacgacgtcgccggggcgcgccacgaagccgccgcggcgctcgtcggccatggcggccgtgccccgcgcccagtcctccagcagccagaaccccctgtaggagaggatcgggaggctgttgttgtagacgaggcgcctcggcatgccggagatggcggcgtcgtgctcagtgacggggcgagccgggatggcgtcgacgccggcgacctccttgaacgggacgggccctgcagcttgcccatcacggtcagggagtagtgctccttgcacttttgccatatttggagccacggcgagagctataccaatctgagctatatgcatatggttgggacttggagtctaataaagtactacctccacattttaatgtatgacgctgttgactttttgtttaacgtttgactattcattttatttaaaaaaatttatgtaattattatttattttattatgacttgattcttcatcaaatgtttttaaagcatgacataaatattttcctatttacacaaaaattttgaataaaacgaatggtcaaacgtcagtcaaaaagtcaatcgaaaagtcaatgacgtcatacatttaaatatggaggaagtagtatatattgtccacctttgctgacccgatcttatcaagtacagtactagttagatgcattaatttagttagctcagggaaagcacgtgcttggcagatattgtacccttatggatcacactgtccttccaatctcctacgcgtactcccaccagatattctacgatgctgatctagtagtaactagtaccacgtaccaacccgagatatagatgaacagaccgaaaatgtcaagcaagttagatggacagatgcaagcccgccctagctagggattaaaacggagcggatagtttctattcgctgtggagaaaaataaatacggattccttttgaagcggataattctcgaaaagtccggacacggctaatctttccgaatgcgaatacgaatatggtatcggggtttctaacagacacggataataatatgtatatccggtgaacaacactatttgatatccgttgaatccataagacatatcacatttctttataactctacaaccttcaatctatctttttagatttttaataggagaccatctcttaacactagtccacattattaatattatttgaacttttaatatctttgataaattataccatattttaaggaggtaactgctggggcgaccaagatgagcttacatgtggaagctggggcggttcggccgaatttgtggtcgggacaaaccactttcgccgcctttagaaataattttaaaagcctaaaacaagagatctaattttaagttaataaactccaatataacagtaggctagataattttttaaaacacttctattgtttctatagttcctaaatttttctgggatttatttgagccaaggaagtatttttaataaatagaattgcatttcatgaataatttaaatagaaaaagttttaaaatctctcttttgggtttggcctttctctctctccccggcttgcgcgcgcttggcccatgccggcccagaccgccgcacccctccctcctctctcttttccgctgataggtggggcccacctgtcagtcgtcttcaacctccagccgccatacccgcgccgcaagctgccgctgccccttccaaatccggccacccctttccatctccggccaaattgtttgaggggaaatgatcccccggatctcctcttccttttcctttttggaactatcgcaaatttctatggaaatagcccggattcgaattcgattcttcccctctaaccctaaatcttccatctcgccgggctcgccgtgggcctagccgccgcgctttgccgctataaaatgacccccgggacctcgtccattcgccaccatcctcgccttggcttgccgtagctggtagagccgcctccgccctagctcgtgcgccgccgccgttgccgcgtgtccaaccgtgccgcgccaccactctagtcgccgtcgtcgctcggggttgccgtcgccggagcggcaaggtcatcgccgtcatcgtcccaccctccgttttcaccgaagaccgctggaccgccgtcgtcgccaccgccacctcgacccgaagaccatcgccgttgacccgaagaccatcgccacctcgacctcgccaccgtcgccatctgtcatcgttcgtgtggagattatgggtaccccatacccacacggcatggttattagactggttataggagataacttatatctatggaatatgtaacggatcatgacttgggtattacgtttccctgtatattatggaacggcctaaagtcctagtttgataagattgtaaagtagatttaggaaaccgataccgtattgattaaggtttctatcttgtagtcctgccccccatcctatataaggtgggcaggaggctctatatggggcatgacacacaaccagatcgtcagatctacaatgcacttggcggattcaaatccccaaacaggagtagggtattacctctcattgagagggcctgaacctgtctaaatccttgtctccgcatccatccacttttaggtctcgtgcgctaccccttttattattgctgaattcatgtttcgacagttggcgctccaggtaggggtacgtcgagttcctatcaaagaagtgtgatggaatcaattccaaaagcagggttgagattaatctcaacaatttcgaccactccaaacgtctactggtttgtcgtttcaatatattgttattagattgattcttctaatcatggattgctcttctgtgagacgctttgtttgtgtgcatgcactggcggctgatgagatctgctgatcgcctccggataaccatatgcaccatggctcggcgttggcggagagcttctgcgtccgatcttgccctgcgatttggctgaagtcggccaatattcaatggctgatctaatagagatctataatgagatttcggatagcatcgcttactgccgtgtcgagttctcaaccgatcatctggccggttacggcgattatattaattaattaattattatttttcactaatcacaagttaatttgtgatatatatttttgcatgtctaatgaacggttgagtccgattcataagaagacaagcttcccaactagattgcacgagcatggattggtcaggcgatgtgtggatgcatatcaagcgttcatgctacaggagattaattggccaatcaatatatgcgagctgcatatacgcattgataaatgcaaacgtatatacacaagcttctttatacctgtatttattttatgtggtactgaacagattaatctgttagttgatttattttgcatgtacccatgccaattgtctctgtcgccgctgctgggcatccacatcttcaccgccggccccctcgtctgccgccgactggtgtcctcgcctgcacggccggcctattatgccgccgtttttgggcgtctacgtcttcaccgccggccgcctcgtctgccgccgactggtgtcctcgcctgcacggctggcctattatgacgccgttgctaggcgtctacgtctgcactgttggcttgctttgccgctgccgactggtgtttccgtctgcacggcctatgccgccgttgatgggcgtctacgtcttcaccgaccggctggccttgccgccgccgactggtgtctctgcctacacggctcacctattatgccgccgttgttgggtgtctacgactccaccgccggcctgcctgcgtcgccgccgactgatgtcctcgcctacacggttggttggtcacaccaccgttgttaggcgtccatgtcttcaccgaccggctcaccttcgccgtcgccgactgttgtctccgcctacacggctggcgttgttggacgtctatgacttcattgctgcccagcctcgcctgccgccgactagtatcctagattatacggttggttggtcacaccaccgttgatgggcgtcttcgcttacactgccggtttgcctttgtcgctgtcgactggtgttttcgcctatacagttggcggactccgccgccattgatgggccttgtcatctacaccaccggcttgccttcaccgccgttgcccggtgtcttcattgttattgatggacaactttgctcccacatcagccacctctgccgtcatcaagaggaatattacaaagctaagtcattattttttttctttatatgatattttccttttcctctgtctcactatgtcaactggttcgccgttgactagcgaatcaggggctacagacgttatatcatatttttttaacaaatatcataatatttatcttgattgcttgcgacataatctgagtacaaaagtgcctatcgagttatggagttctatcttcctatgctttccgtttggtttgtcgatggatagttgcctttgggctgattcctagcacccgagggctcgttggatggagcgagtaacgcaaggtgctaagtattattcggaataaatcaaaagcatagagataagataaatttaatttctgctctttacaattgcaaaagtacccgagtagtaaattatgattcgtaaaactttgttccattaatgacgaactcatgtcactcatatgcatgtttgggaagtgcctagaccgactcccgatgcttgggggctatgactagtcggacagagtgtttaaacgtacagagtcatctgctcggggaaatcgaaattgagtagaggagaaatatatatttataaatattttaaaatacttgaatattatatatacatcagatactactcatcctatatgcttgttctgtaggatccagatccagatatgcataaaagggattcatggctttaagcttatctcctacgcttcaggattggatcagtcagaacatcaccaccggcttgccttcgccgctgccgactggtgtctccgcctgcacggctagcctattatgccgccgtcgttgggcgtctacgtcttcaccaaccggcttgccttcgtgccgccaactggtgtctccgcctgcacggctggcctattatgctgccgttgtagggcgtttacgtcttcaccgaccggcttgcctttgctgccgccgactggtgtctccgcctgcacggctggccttttctgccgccgttgttgggcatcatcatcttcaccgaccggcttgccttcgctgccgtcgactagtgtcttcgcctgcacggctggcctattctgccgctgttgttgggcgtcttcttcttcaccgaccggcttgccttcgccgccgccgactggtgtctctgcctgcacagctagcctattctgccaccattgttgggcgtcttcgtcttcaccgaccggcttgccttcgccgtcgccgactggtgtctccgcctgcacggctagcctattctgccaccgttgttgggcgtcttcgtcttcaccgacaggcttgccttcaccgccgccgactggtgtctccgcctgcacggctggcctattatgccgccgttgttgggcgtctacgtcttcaccgaccggccacgtcgccgccaccgctaataggcatcatcatcttcaacgcaagctgtctacgtatgatgccgactggtttcttcacttccatggctgcatggttctgctagtgttgattggccttatcgtcttcatcgccagtcgtctcgtctgctgctgactagtgccctcgcctctacggctggtttataccgcaaccactactgagggatgtcatcgtcttcattgctggccgccttgtttgacatcgactatttttttttctggagctgaccggagtatctatcttcacgactacacatcttcgccaccggttttcttctgttgctgccaacttgtgttcacgtcatcacggctatgcaactttgtcaccatgtggagcgacttcaccttcattattttcgacattggcaaactctattgcctctactttgcaagatttgctactttgtcacaccctgaaaatcctaaatttatgaattgttgtttaaatggaattattagaaatgattttaaaagcctagaagaaaagatctaattttaaataataaattccaatataaaagtgggctagataaaattttattaaatacttctcttaattcgatagttactagatttttctgggatttatttgagccaaggacgtatttttaataaatggaattgcatttcatgaataatttaaaaagaaaaaggttttaaaatcctcttttggctttgggccgaaagtcggcccaattcactccctctctctccgcggcctgctagcgcctggcccatctagcccgccgagccgcgccgcccgctctccctcctctctcccaccgacaggtgggcccacctgtcagggccgtcgtcttcctcctcacgccgcagccacgccctagcgcgccagccgccgccgcccccttccaaattacatcgcccctttcccgatccggtcaaattggtagaggggaaatgatccccttgatctcctctatcttttctcctatagaaacttcatctaatttcgtttggaaattgttggattcgagctcaattcggattcgttttctctcctctaaccctaaaccttccatcgccgtcgccggttgccgtgggcctccatcgccgccctctagcccctatataaggacccccgggacctcctctcttcgtcgccaccctcgctttagctcgccaccgctcgtagcgccctagccactagagcccgtgcaccgccgctcccgaagggagtccagccgtgcgccgccgccgctccgttcgtcgtcgtcgctcgggaaggtcgtcgttgggatcgccaagtcgtcgccgtcctcgtcccgtcctccgtttccgccaaagaccgccggagcatcgccgtcgttgtcgacccgaacgccgccgccgcttcgacctcaccgccgttgccgtccattgacgtccgccgtcgtccgagccttcggtgagttcaccgcgtcgccctctacccgtagatgccctccgtttgcgcctccgcgccgtcgttcgccggcgagcccgaggtgccgagccgtcgccggtgatgacgtcatcgctaacgtcagcgccgcgtcatccgtagacccgcggtggatcgaatcgatctcggccgtccgttttgtttagattagatctcggccgttcgttccgtagaccgtccctgtgcacccggtccaccgtgaacccgagccgatgacgcaataaatcctttttccttttcaaaaatagttctttattccgtcataattcaattaaaatctatataaatgatttaatccaatttaatctttaaaaattcataactaattcatcttagcttggatttagttggttcaagtctctaaatttttctaaaattgagatctacatgttaaaaatatccacatgtgctgtttatgattgtttatgtactgttttggtgattttgttcttttatgcttagattccgacgttcccggagagtccgattttgcaggagaagattttgaagagttccaaggccagtaaggcaagtcacacagatcccaaaaaaccctttgagcatgttgatcccgtttaaagctattgtttctattcaactatcgcatttatttttgaatgtcaccgggtgggaataacctattgccttgttatagtctttttgttattgattacctattctttgtcatttggttaataattggattagctagaacattatatggttttagctaaagtgcttaggatgcttagccatgcttagagacattagctcatataaatgggataacttatgattcactattatttaatgatggcttaatgatagctcacgatggttaatcgtgattggttaattaattaatttgccaactaaaacttgataatggtgggttgtgagcacatggttttgatggtcgtgctcatgacaattaaggaccagttcacgattttcggttgtgaaacattaaccgtgccaaccacaagccagcgtgggcaacggctttactttttgtatagtatggttcattgtagagcaccagactgtgaagtggcggagataagcccacaggggtcgctggggagtccatgccttgtttataagggggtgattatgatccaggaagggtgcactgctttgaattgtgttatgcgaagggtattgtcacaatctctattcgggtacttgttaagtatcgcgacgcatggttgacatgatgttgaggttgtgtcttgtgggtacagtggtacacctctggccagagtaaaactattcgaatagccgtgcccgctgttatgggcgggtctaacaatgtcattcgtgattagtttcatacatctcaccataataaatgatactgtaattggtaataacttgtttagctcctggtttggaatggtatattcctggtttggagatagaactgtgccgctgggaatggttgttaagaatggttgggcctatgcaacgggtatgttgtatagcgttggattaatattgtgtaattaaatactttactgttttattaaattctgaagtatttattaaatgccatttatgcaaatgagactatattatgccatcctttgttatcccttgcatttgcatatttgttgtgtggcttgttgagtatgtcatatactcaccttgcaatcattcatcagaggaggagttctacagtgatgctgaaggtgtggaggattaggcgtagcccttgtcaagctgcttgtgggatggagtcgcctgcgctgtttatcttattttccgctgcttagatttttattgtttggagtaataattgcctctgtaatgactttatattcccttattaattagagtaataattgcactctattatcaatttgttattatgtgcctcggctgattcctggacgagaatttacacacatgtaagcgtttggaattttggatagaaatttcgggcgtgacatacttcaccaaccacaacgtctacaagagcttcgacatctcagcatgcgtgaccaaatatgatgccgtgttattttactactacaagtggttttccaatcttcaatatttctactcggacatccccaatgcatatcttcactcaagtgatggctactcgatgacaagaagctacagttcgcgactctatgttcagttgtttctcaactaaccaaagagtcgggggctacacaaatacaagactcaaaattcgacaagctttatgtcaagacaaagcaatcaatcagccaacgagttctatggaatctacttcgggagtcatcagtttcgtcttcacttaagagttggcgttctacttgagaaactccaattatttcaccggcaattttggcttctccatgctgccacaatatactccaaatttctcaagtatcaagtttgagatgtaatttacatgtctgggagtttgatggattattatcattg

SEQ ID NO: 79400 - DNA, 30905 bp, Oryza sativa
aagatataaatcacacttaaagtactatgagtgatagaacaactcataacaaaatagattataattacgtaaattttttgaataagacgaatggtcaaacatgtgagaaaaaatcaacggcgtcatctattaaaaaacggaggtagtatttaacaactcatcttattcaaaaaaattatgtaaatataaaaaacaaaaagttatgcttaaagtactttggataataaattaagtcacacataaaataaataataatttcaaaactttttaaataatgcaagtaaaaaagtcaaatagaacggagggagtaaaacagatttgaacagaacagttcagatttgttttgtaatagatgatgtcaaatccatttctaaattatttatttttttcctaactaagggtctgttcactttgataccactttcaaccttatcaaattttggtaaagttaacaaaaaaaaaaatggttacatttagtttgctgccaaattttggtaactatataagaaatcctaccaaaattttggcaagttaccaaaattttgacaactataccaaaatttgataatgctaaaatttagtaaggttttttttttattaaagtgaacaggcactaagagagtactccaaatagtagtacagtgagtgactgtgaaggccagccagccataagcctaagctaacctaatcctccgtcgcgtagcaagttgacaaggccaacttgcccagcaaccagcaggtggcgcggccgtagcatggcgcacgtacgcgcccaccgcatttccgcccaaacgggggagctatccgtgaccgtgcgcccctatccgaagttgttaagatcattagcagttcgaaagaacgtgctaatgatcttaagtcagaaatcagaacagaacgaagccctaacatagtatgatccggaccggcatcctaacaacctcgcgggcgtgatatatcctcccagggttcacaattccgacgaaaaccgatcgaattcctcgaaatttcgacgtttcgatacggctcaaaattaggttttaattggaatttcgaaggctaaacagtatatttggtcgaaattcagtcggaatttatcaaaaactgattgaaaatcatcgaaaatcgtgatatcaatgagacttaaaatttagtggtcaaccggtaatgtgatcctccttcccgcttgcaggtgcagctcgatcgcgcgcgcacccggcaccgaagcgcagagagatcaggtgccgcggcgaccggcccggccacgacgaccaaaacatatcagcattcaacacgatcccgcgagggcgcatgctaaacaaccttatctttttctttttcttatgtttatagttatcaaccaaaatttaaaattttaaatcgttaagaacacgtgtgtgtatatatatataagaaatttataaattattttttatttgtatcctaataagcaaaaagatagccgttccccaactgccgtggcagtacagcctacaggtggtgtacctgcatatggccggcaggcgacatatccatcgccgtttggtactgtggcgtactgagttgtacgtactactactgtgtagcagccagatcttttttttcttcctaaaaaagagggacgtaacgtaacaaccgattgataaaaaactactaacctcttctgtcgcacatatattttcgaataaaccaaaacggcttattaaacaataaaagttaatttataagtacaacttctatatatttgttcgtagcgacttaaaagctaacactaaaagtaaattacatttaaaatatttaaaaatcattcaaaaagttaaattttagctttttctttggtttattagaccaaccaataaggctctatgtctgatctgatgagggaaaacaaagagcaagtttaataataaatgagctataagattatctcttttttttctcctcctctttctatctcttacctatgtatttaatgtatttatcttgaaatatatgaatagctagctattgatgagagccaaccctctttattttttaaattctcttttctccacagttggtttatagcctctaaggacgggcaattcagtttgtataccgcgtgaagccgtgaaagttgaaacagagccggtgagttccatcgtcggacggtcgccgagaagaggttacgcaaaatatgcaacgatagatcatacgttccctatcaaaatcgcgggtgttttgcttgggaaggcgtacgccgtctccgtcgacgatttaatttgtcccgtccccgcttggattcaatgttcgttgccactgatcaagaaccaataatatggtttaggcatttgcttgctcgctaaattgccctgcctcggacatcttaattcacatcgatcgaagacgacgacgaagaaggggatcagtcctgcatgtgactcactctgatttaacggtgacgccacgctgccttgtgtctagcttccctctcaatatactactactcctattcgtcgtataaagagttactcactccgtcaaaaaaaaatcaacctagaaagagatacgatctctcctagtatgataaatataaacatataatttgtccagatttattgtattaggagggatcacattgcctcctaagttgagtttttttagacggagagagtagttttttttagaaaatctcagataaattagtatcacattgaaaaagatgtcaacgtcttccattaaaggcttctttgggacacatgaatagaaaaaaaaaaatagaaatgagatgccatatgtaagcaaatcccatgaaatacaaaacacaggaatttgcaagacaatgtgtttagatagctcatagtaaaaacttggggatttggatggattttagagagagaagagagagaaatagaggaagcattggacttctcaaagcaatgttaaaatgaggtaggagagctcatgtgcaaaattcctaggaattggagtataggattacaattcaaaggaattttcctatgcttcaaacaagctagatagaaaattttccttaagatttaaatcctttgaaattcaaatccttgaaattcctatagaaatactccatttcaaaggagccataaaccccatagttcgtagtagtgactattggttgtcctgaccatgattttcttttcaatgaattcctaagcatggtttaattactctgcagatactttttaatatttattcacttcttactaaaatatagcaaccaagtgctcgaatagacaccacctaatactaatatttagtagtacgagtatagacaggtccctttatttagaatcgttgagctatgtggtatctactatgttgctactctcttcgtccctaaattaagtactaattaagtatattttgggatatggagggaataactttttatgggagagattttatatgctaaattatagtataattttaatacagacccttgcaattgattttgcagtatatttcgcacaagctagtctgttatccaagtatggacttcacaaacaatgagaccctgtttaaaagggactaaaactagttttaagtctctatcacatcagatgtttggacactaattataaatattaaacgtagactattaataaaacccatccataatcttggactaattcgtgagacgaatctattgagcctattaatccatgattagactatgtgatgctacagtaaacattatttaattatggattaattaggcttaaaaatatgtctcgcaaattagctttcatttatgtaattagttttgtaagtagtctatatttaatactctaaattagtgtctaaatatagagactaaagttaaatctctggatccaaacaccacctgattcggttgtcggttgcaaaaacaaagagaagaaaaaaacatttcccttcaatccccgtgcatttaatttccctcgtactaccaaggaaaaaaccgaaaaatacgttcccactcccacgcacatatggcctgcacgaatcgtcatcactctcttcatttcacgaaagcaactttaatttgctaaaggaaatcagacaggttcggaaagacaaacgagtttccatttttaaaaagacaatatactctctccgtttcaaaatatttgacaccgttgacttttttagtatgtgtttgaccattcgtcttatttaaaaaatttaaataattatttattcttttcatatcatttaatttattgttaaatatactttcatatacacatatagttttacatacttcataaattttttgaataagacgaatgatcaaacatgtgctaaaaaatcaacggtgtcaaacattttgaaacggaaggagtattttcctaaaacatcactttacgtcgccttattcttatatcagtgacactcaacctatccgtaaggctagaaatgaacatcatgtggacaacgtatcatattaaatctttagttttcctaagccactaccaacagtaacttgctccaccataggccagtattttgctacagagcaacagttccttccggctgcgttgccgtgtgatgctctgtcgtggctgtgatctgtccgtccgcttgccaacccgatatgcttgccctccacacagcacacacccatcaatccccaattcatgaaaataaatccctaatccatctgcttgccctctccaccacacacccatcgatccccaattcatgaagataaatccctaatccatcggagaaatcgacgccatcccctctgccccatcgatcaccagttcgccggcggctgcctttctcttccccgacctgcgttcttccccacccaccgcctgtgattgtagggttgccccgtggtggttgccgctggttatagtcgtcgtccagctatctctatcggtcaggctgccggcgcgctggccgcacccatcaaggctcccgattgttgccctggtcgagcggctgccatctgccagcctgtctgctctggacagctgcctccatcctcggttttcttcagtaagtcttttttctctatactgctctttgttgctgttggatgccaatcttgctttctttcagtttgagtcaccgagacaatgcccaggctgatcaatctttgctgttgttaacagccaaaacatgaatctatttccctatgcttccttgcgatagttaggctgagtgaatactaccaaggttgcgattttttcagattaaacactatatgacaaaatgctaatgaacgaaagatagatatgcgcttttccttgatatgttctcattttgcctgtcagtttattaaatatttgtaggccgtcaacttgcagcttggcatttggattattgcagtgctaattttgctatttattttggcttgccatattgggtcgatttagaatatatgtacgcttcagcatggcatttggtcttggtggtttgattttgaactctctgttactgcctatcaattccctatgtgcatatctttttttttaaccttctttccggtttggtgctttctttcataaacaaaatgcattatagcctcttcattacaatttgcaagtacactcacatttaaagaactccatatcaattggtcaaaaagattaattatgactagatgtgtagtgcattttatctgctttcttttatggctcttcccatatagtttaattagtattacctgatatagcaaactggccagtacctaatgtgccactttatggatgcataaatttctctttatatgtatactacttgattgctacacatataatgatgttttggctgctataaaaaatatattactttcattattatagttccagtaaaccactaattactttcataaatcagtttgaatgatgtcagtctcttctgggccatcaacacctaaaccagcttgcaagcgcaggcaacccgagagagcttttataccttcaggttagctccaagccatataaatgcttatttctacatttgaaaccattttcctattgagctctcctatttgtcaacagatgattctgttgtgccatatctatttcctagggaatattcctagcgatggcgttgttctgctggctgatgacgccctctcccatgtttgtgatttccctacaagttttcatttgccatcaaggcgctctatacgtcgaagactacttactcagtctgctggtataatatttgttgttttgatttttttttccgttctaattgtctaccctgttgttttccaaatgtatggcatttctttccatttattatgcataatcatcactaccaattcaacctaccgcagtccacatttacatatcaatttcccatgttattatcctaattcttttttgaccaaaaattgttgctcatattctaaatcaggatttccccacccggatcctgtaacagctgctcaatcacgtcgaaagcgtaagcttgctatggctgccaaatcatctagaggtttgattatattctttatccactcacatgtttatctacatgtgcactttcatgccttatacaaaagttttttttccctaacacatgttgttttctctagaaattaatagtaccactgaaatgatagagcatcggacgcatatccatgtgctacaacggaatgttcgacaacgaaccggtctgtctcagtcatccaccttggttcctatcaattgtggccatacacaaccttttgcaactgtcgatggaggtctgtcctattcctatttccacttattttactgtgtttctctcctaattcttcaacaaatgtaaccaatgatagcatgttcatcgtcgacctcttcagccctattgtctccatctcccacacatcaacgtaagtttagtcatatattagttctctacaactatcatttcatttcaccctttacaaatcatgacaactacaatgctaataatgtacagaccatttgctcatcaattctcgcggttttgctgatgtaaacctgatgctcgacatgtcaaatcagatcactcatacagtatgatgctcgacttgctgttcgactcactaatgtaattctgatgctcgacctgatgtatgtcaatcaatagcacgaaaaaaaattcccaccttttacacacacttatgtcattttcttttaattactaggcactattttctctccatcaaggcttgggcccccatgtcacacttgtccatattgtggggctttcttttggtttgaggagcgtgtccgccgagaacagcacagctcatcaccaatatacaatacatgttgtaaaggtgggagtgtcatcttacctccatataggccacccccagaacctttgcatagtctactcacaggagttaacagatcattgtcagcccatttttttagaacattaggttctacaattcgatgtttgccttcacatcgatgggtgtaaatgtcattgattctatcaatgatggacgaggcccatatgttttcaagattagtggccagctctgccatcgcattgggtcactcataccagaagaaggaagacgaccagagtatgctcacttatatatctttgacacagaaaatgagatcaggaataggataaatgttggaacctatgcaaataggagttttcgtcctaatgaggatattgtggctggacttatagacatgttcaacacccacaatcctattgtccacctatttaggacagctcgtgatagattggctgaaaatggtgatgattgatacatcataagattatttggtgatcccgacaagcatggtgatatatttagtgctccagttgcatcggaggttgttgggttagttgttggtgatgtaggtataagtgatgttggccgtgaccttattgtgcaggaccaagcgggtcatttacaaaaagttgaagaaaagcattgtaaatttatgtcaatgcaatatccaattctatttccatatggggaggatggctatcatgaaaatatcacataccgacgttgtgctcgattacaagctatcaaaagaaagaagtctactatggttgaatactttgcatataggcttcatgacaaagctgatgacttcaatactcctatgcgctgcaagagaggaacccaggcctatgtcatagatgcctattgttgtatggaagaatctcgcctgagtcactatagatccaagacatttcagcttaagtatagaacaacttcatttagtgaggtatccactatggtccattcaggcatcacagaagcatcagatgccgggcagcaagttatattgccttcttcttatattggggggggggcaagatatttatatcaaaattacttagattcagttgctctatgtagaaaatatggttgccctgatttgtttatcactttcacatcaaattccttatggtcagaggtaacacaagctttggctatcatccctgggcaacactcagcagataggcctgatattattaatcgtgtattccatgttaagctgcatctcttcatggacgacatcgtaaagaagaaattttttggccctgtcactgcaggtagtaatttaattgttcatgaatcatgacacaacatactgcacacttcatatattcaaatattttgtatgtgtcattctcacataatttttccttttatgtagttgtgtacacaattgaatttcagaagcgtggacttccacatgttcacatcatattgtggttagataagagtggtccattgacacctgctgatattgacagactaatatcggcccagcttccagatccatccattgatcgagttggttatgatgctgttgcggcattcatgatgcatggaccttgtggtgatgcaaatccgcattgttcatgcatggttgacggtaaatgctcaaagaattacccgaaggaatattatgagaaaacaacaatcctgccaaatggccatgtaaggtatgctcggccaaaaaatgatataattgttgcgaaaaatggaatttctcttgataattggcatgttgtcccccacaacgtcgatttattagtcaaatatgaggcgcatatcaacgtggaaagagttaatcgtgatggaatggaaaagtatctattcaaatatgttgctaagggttttgattgttcgagggttggtctcaagcgcaagcgggcatgtgctggaactaatgagattcatgactatttagaatgtagatgtatagcgccgaatgaggcggcatggcgtttgctttagtttgagattcattatactgatcctgctattgagcgtctccatgtacatatgccattagagaataatgttacattcacagaggatgataatctggaacagatcttggataacccacgcaatcgtgttacgaaacttacagcatggtttgctgcaaatagagaatactctcaggctgctccatatacatatgcagagttcccagaatactttacctggcatggtaatggcaaatattgggctccacggaaaaattgccgcaagaaaattgaaaggatagcacatgtttgtcctgcccaaggagatgtctactaccttagaatgttgctgcacattgtcaaaggagcaaaatcctattctgatctccggaccattgaaggacatgtatatcctacattccaatctgcatgtcaagccctaggccttcttggtgatgaccgtgaatggtccttcgcaatgactgatgcgactcattgggcacttccctaccaactccgtgagttatttgtaacattgcttcttttctgtgatgttacaaacccactgagtttatttgaagagcatctgtcttcaatgggtcaagatgcagcctaccaccttaaccatgccacactaggtataaattcttctgcaccttcagtcatacaatatgtcaagtcctatgttcgttccgagatcgatagcatacttagaaatgttggtcgtactttggcacatttccatttacctgagcctactattcaaagcacatccatccttggcaataggttgctaatagatgaacaagcatatgatctagagaagatatcgattgaagcggctgatcagttaggcaagttaaatctgaaccagagacatatatatgatgctattctcaattctttaaatagtgacattgggcataccttctttatctatggctatggagggacagggaaaacattcctttggaataccctactaaatagtgtaagggctgaagggaaaattgctttggcagttgcttcttccggtatagcatcacttctacttcctggtggccgcacgcctcattctcgctttagaataccattggacatacaagagcatccagtttgttctattaagaagaacactcacttggctcaattaattcaacaaacctccttagtcatatgggatgaggcacctgttaatcacaaacattgctttgaagctcttgaccgaacattgagagatattcttgcatccaatgatccatcacttgctaacaaacagtttggaggcattacagatgttcttggaggagattttaggcaaactctcccggttctaccctatgaaaaaaacaggaaatcttatcttcatccatcacacgttctcatttgtggcagcactgcattctcatgcatcttacggaaaatatgaggcttcaatccccaacattgtctaatactcatcgtcaacgccttcaagaatttgcagaatggttgttagcaataggggagggagcagtagcagattcttcacctactgatcgagaggatgtttcttgggtaaaaataccagagtatttgcttttgccagatgacacaagaaacctttcaggccttatctcttttgtatatgatgcctcaatcaattctcacacagccaattatctctgtgagcgagcaattctagccccaacaaatgaaatcgctgcaagtataaattcccaaatgattgctcagctgactactgaagaaatgtcatactatagttcagacacaattgaagatactacaagtaatcgtgccactcttgatgctctttacccaactgagttcctgaacactataaaaatcagcggtttgccagaccatcaccttcaactaaaaataggagtgctgattatgctgctgcgcaatctgaacccaaccagacttataatgactcaattgacttgtcgtgtgatagaaggggagataattacagggaaggctaaaggatccaaggcatatataccaaggatagtaaccacttcaattgataagaagtggccttttaaattaaagcgccgacaatttcctgtatgtgtgtcatatgcattgactataaataaaagtcaagggcaaacacttagtagagttggtgtctacttacctagccctgtcttctcacatggacaactttatgtcgcactctcacgtgtaacatcgcctgatggtcttcgtattctaattgagaatagtccaactgagcatgtgaccagcactcacaatgttgtttacaaagaaatatttaacgatctggatcaacaaggaatgcatacatgattacaggtaagtcaagcatacgtgttctacctattagtaatttgttgtgtttggttgccttgcccccaatgtgagtcctaggttcttttttctcagacctactaacttgacctgattatattctttgtgttttgatacttaatgtcaaatttacctatcttcattgtttgcaggattctttatctgaaacctctgccttgtcaaagcagcacgcagttggtattattacaatggttcagttctttcctgtctattttatgtgatcttcacactcaactttcctctaatatatgccttctggtatccatggtttcttcgtaagtttgttttcctctttttatattttgcattctgaccactaaacaagttcaatgtgaaaagaagtttacagcattttacaggttacctatataaatttgaagatccttgcattcatgcattaattgccaaaagaaaaaaaaatcttccacaccaaatctagattctctcacggctaatgcttttaagtattctatcatatttggtcacacacctattcctattaatttagtcttggtacaagttcatagtatgctataattcattaagttttccatccatatatatgtttcataacatgtcttaccacttcatttgtcatctcatcaactgtcacatgatattattttccctgtttcaatgtgatcagccacttcaacaactgtatatggatgtttcacacacatacctattttacttaaaaattaatctgttattcactatgctaccagtcttgattatggctgatgctcataatgatactataatgcaggctgccatcatacgaagaaccaagcatccaaccatctcaatgatcattataaatttcatttttccatcagcaggtgttctgctagaaaacatatcaatgcacctctatgccctattatgtaccttttggcttgcaagagtgttatacgagataaattatttgtctcactcacctgtatgcctgccatgtaaataatataactattttaattgccaactgactaccgtcatcaattcttttgtccgatgaaataacatatcttacatatattatatgctttttagtaagtaaacttccagtaatatttttgttgtcatgtgaaatattaaaaatatatgcattcacatttatattaacgacaatgcagtttctaatcatatcagctttgacgttggatttatatttcaaaatctacatgaataccttttgtttccgtgcttcactccatgcttataataaccaattttcattatgtcccgcggcaacgcgcggggcacatactagtttagtatatacatcgtcaagattctcacgtagtccttccatcctaaaatatttttagacgctgttaactattttaaaaatatttgaccgttcgtcttattcaaaaaatttaagtaattattaatccttttcctatcatttgatttattgttaaatatacttttatgtatgcatataattttgcacatttcacaaaagtttttaataagacgaacggtcaaatatgttttaaaaggttaacaatatcaaacatttagaaaatgagggagtattcggtatggtcctagatttacacggcgacatcctagatttacatggccctttttcgagtttttaatttacgtgtttggggtatctttacaacaaaaaaaaagtcacaaacataactcaagcaaccgattagtctcgccctgttttagcatactaacataatttgagatcttatctaaaaaaataggaatttcaacggagacagtttaaataggaatttttcaggaaaccattacaaaagttgtttctacgtttgggttcatcccctcataattccacctcatcagtgcgtgtgttcggccgtccgtagctgttcattgtctatcgccgtcgtccatcatatatatcgtcagatggacggcgatgggggtgtaaaagagtgacgctgaacggaggagggtcctgtgcgttaatgtcagctacttgtcttctcctcgaggccatagtacccaagctcatgattccgcagtgtcttttatcaccattttttttcttcgggcttgttcactttaatgccaaaaaaaaaccttactaaattttagcaatgccaaaattttggtatagttgtaaaaattttggtaacttgtcaaaattttggcaggatttcttatatagttaacaaaatttagtagcaaactaaatgtagccacttttttttgtcactttatcaaaatttggtaaggttgaaaatgacatcaaagtgaacaggcccttcctctccagttactacctccacctccgttcgataaaacaccaacttctgactttaaatctagatgttggttttttatgagattaagagagtaattagtagtagtaaataaaaacagtaaaaatcaaagttaaccggcttggcgacctagaattattaaactgagcggagattattaatttgtaagttattcataaactgattttgcatgcggggtccgaatgatgtgcagtgcgcatgaacctgaacatgctcgtcgacggtagagctatttccccgacttttctaactcaccatcatcgttttttgcgcccactcttttcaaacggctaaacgacgtgttttttataaaaaatttctatacaaaagttgctttaaaaaatcatattaatccattttcaataataatatatatctataactaatataaatatttggatttttcctgtcgtcacctctcaatgatcgctgtttttgtccgatcatgcgacaaaattttcgtccgtaatgtccgactgagcggcgcccaatttccatccctaataatgtctgactgagcggcgccctccctctctgcgtgaacgcaatcgtgtacggtggccaaagaaaaaatcaaagaggatacaaaatcctaatcgtgtatgacaaatcacaacatcaaaaccaaccgataatcctagaaaatcagtttttcattcactattacaagatcaacactacaaaaattatgaaggtggaagcagaaacacacaaacaaatcctagatccctaaaaaaaccaattgcagcagctcgcgatgcggcaaatccaattgtgaccaaatcagcccaaacatctccacaacaccaatggagagcaaatcgggtaaacaccaaagatccccataaaaaaggccacaaatttccaaagaacatcgctcatgaatcctcttactaaccatcccacgattgatggaggaagagaagcaagggtgctcgagtgaaagcaggaggaaaggcataaaaaacaatgttggatctggaccggtcgccccgcgcctcctccttcgtggaaccatcgcaccgtcctcgccatgctccctgccgccgtgctggtccccagctcgggggctgttggatctagcccccgccgccccgcgcctccttctccacctcatgagagaggagaggcctcgccgcacaggggagagggaaggagaggcgcctgccgcggcgcaggggagagggagaggcgtatatcccagataaaacggacacgtatatcccatatatatataccggttttaaaaaaatatataaaatattactggtgccaacactcaacacttttaatgggctacaggtgcgtcacaaaattttcatctgtaaagtccgactgagtggcgccctccatcttcgcacgagtgtaatcgtgtacaacggccagagcaaaaataaataaataaatcttaatcttaactaactaaaagattaataattttcctttcgtcacaaatttttggtccgtaaatccgtacgcgtttaaccgttttaatcggatttcatgcgcgcaggcctagacagagtccggagctagcctggagtccagtacaagcccaaaatgcccaaatacgttcgcacccagtcacaacatatcctaatctgttttcttttcctccattagtttgagagaaaattatatttgaagtataggtagatgatgcctattatagatggagtggtagctggtttagttacgttctttattatatggcgtccccacatatgtaagatgatacaattttctctccataaagcaaaattcaaacaggtaagacagatcgcaacgccgcgagacattacggatcacaacataagacaaatcttatcttaactacttaaaaatttgtaattttctgttcatcacatcatttttcatccgtaacatcaatttttttgtctgtaaatccgattgagatccaatcagacaatccaaagaaagagaaaacgaatggaaaaaaaaaaacccgcataaatcttatctcaatctttgtcaccgccagatccacccacgggaagccactgtcaccatcggattggcctgtgggaagccgcgtgccgtcggcgccagatccgccatcgacgacgctcgcgggaagtcgctgtcgctgttggatccggccgtgggaagccgcggagggcgccgctgctcgcggtgggggacggcgcagcttcactcgctcgcagtgggggagggcgccgccggcaatgctcgcggtgggagggggaggtcgctaccatcgccttttgagatagagagagagagcaaggggatcgggggaaatgatattaaggttagggtttgagctgccgaatatttatctaggtcgggatcaatcgggaccgtccatcagattggatggccctggtttctcccgcgtcaggtcgggcgttgttcccaggccacctagctattgggccgcatatcctttatattaagttgtattatttatatagacagattaatatatccagtttaggggtttttttttggcagaagacttgttttatgcagatatccaattggacaacgtcatttttcaaaaaaaaaaacaaaaaacaaaagtaccaaaacagtgtgaaaataacttcagttaaaaacaaatatttttagttttaatacgccgtagcgaagcacgggcattttgctaataataataaatatttaattaattataagaaaatgtgtcaaatgttttgcgtgcgggacctcacctcccagccccgtactatcttgttcgaaacagaacgtgctgcagcaaaactcttggtttacgtacgcggacagcagtgcagttgcaggttgttacgctttaagaaagtacgatctcatacatgataacgtacctaggcacagtttggacttggacatatatgaatatttgtcgatggtttggacgtttggaagttgtgatctgcaacaaaagtaattaacaatctaccgcccgggcaaggttttttctagtgttaacaagaagagatgcgtaaaagaatcaacagctatatgtacatgcttgtttggtttagtcgtaccaataccaatatcaacacctaaacatgtttttggcactatcaatattttagtagggtccgtagcattctaagtaagtgaagtgggtttaaattgatactaattgagagccaagttttatcaaattaagcatgagcaagctccaaaccaaaccatcatatttactactccctccattctaaattgatctacatatagttttattttagttattcctaaatgatctatacatttgtgatcattcattaagtctattcgttatttgtgtattggagtaaatggacattgatgcatgcatccatgcacacaagtatttataacccacatgcaatatcttgatttgctattggctagaaaatagtgggggtgatgcatacattaagtttgttgctagagttaatatagtataaaaaagttcttagtttttcttgatcttagtgtacctatgaaatatgtagatcaatttaaaatggagggattactccacattttagtatcaatccaaaataatcctacatcaacgaaggacagatcagggcgtaagattcactccttttcactctgtagtcatccaagagcatatgcgtgtgctcttgctaaatccaaaaagaaaagacatgcgtgatcaacaatcgagaacgagagagagagagagagagagagaagaaaccgcgtgcccgattgggccttctgccgactgctcggcctgttccggtgtgcgatgccgcggtggcgtcgagcgtgcatccacatccaattatggaaaaagtccactttcaatccatcggctatgggcttacgacccatgcgccgcgccgatgaccgatctgcttgcggcgtcactgtcacaccatgcataccagccaccaccctgactttggcctcgtcccgacagcatccgtgtcactattcatcggcttggtgtatctccgtcctaaaatataatataaatattttgtatcaaaaaatataagcatttttaaaaattgatatagatattaaaaaaatgattgaaaaattgttgtgatcggttgataagacaaaataagataaaataattaaatggataactattgtgatttgttgagaggaggggataggtggagaaatgtttttttttttcagaacagaggcgccagtaatttttagctgagacggtcgtgcattttgtttgcttgcgtgtgtacgtgacagcaccgagcagttgccgactaacttgaagccgtgaagcgagtgaagctgcgaaacatacatagggaaacagcatgctctcgtgaggagaagttgacttgagcaaatcaaatggtcctatacctggtttaattccgttaaaaaaaatggacatcggcgttggccgccagggtttatggacaagtcaccagatacgtgccgtagcggagacaagggggagcggctgcgagacaggagctgggtggtggccacaacgggcggaggactaggccttgtacaacgctccaccgtggagtgtggtcttagaccttcacgtcggattcgtgtgctcgtgacagtgagaaccgtggtcttgcgatgccgtgcgtgacctatagaggttccggtggtctcatcgcgtctcagctcaggaacaacgacgccacgacctggaaccacgcgttggatgagtccggagagaaatgagtggcttcggtgagagaaggtggtccataagggggaaaaggagaggggggaatgagaaaaggttggtgcacctgagaaaatatcgttcgactggaatagaaaaagtatgtttggtggcataacatgcccacctggattcaagtgcttgcatttacgactatttattgttttaatgctagacgatatactcagtggacaagttaattatggtgacttcattgatataaagatatatcggctcagtctgtatatgagtgtgggtgtgagcatttatagggtgagtttgtgtgtgtttatatgagcaagtgtacccagtaatatatggaatcgagaatacgaagtgttgtgctccaacaaagtcatggtgtccgtatgaattgaacaccggtactagcccggttttgtggactacaaaatgaagtacagtatataagaaaacgctacaacacgccggttcctctctagtactggagtagtactccctccgtattttaataatatatgacgccgttgactttttgacaaacgtttgaccttttgttttattcaaaaaagattttaatgtatgacgccattgactttttgacaaacgtttgaccttttgtcttattcaaaaaatttatgtaattataatttattttattgtgatttgatttatcataaaatattctttaagtatgacataagtatttttatatttacataaaaattttgaataagatgagtggtcaaacattgattaaaaagtcaacggcgtcatacattaaaatacggttaaaatacggtgggagtactacctaacatggaccgtacatcagctgaagcacgaaaaccaccttttgttggtacacgcccacacatgccgcagccgtcaacgggtaaaccagctgcaccagcaggcccctgatggccaggccagccaccatttgaaaccaattgaaaaaggcaaaattgccaatattcaaccagcctacttttgttgatattgcggaggaggggactaaaagtttttcttttactttgtgcatgtacatagagtttttgaaatttactcaactcactttgtactcaggactcctttgaaacataaaataaaagatacaaataaaaaaacacaggataaaaggtcattctgtatgaaatcctataaaaattaaaaacaaaaatttatcaaattggtcgtttggatactccacataaaacttataaagactttagagaaaaagtatcatttaagtagagtagagttaatagaagagagatagagatatggtatcttggactttcggtagtacaagttcccgactcctccttctcattttccgcgtgaacgcttttcaaactgctaaacggtgcgtttttttttttaaaaagtttctatatgaaagttgcttaaaaaatcatattaatccatttttttaaaaaaatagctaaaacttaactaatcacgcactaaaacgctgcttcgttttgtgtgccggctcccgaacatagccttaaaaggaattcaaaacttgaggtttaagctcatgcttgaaatcctccaagaagtggaggaaaaaaaatattcgtccgaaacttttccaaccatcaaatcctacaaaccaaagggcattgaatccttagaaatcctatgaaaatccctcgttccaaattaacctttaacattgcagtttgacatactgaagttcgtgattaattttggatggtttatctatatggaaatttagtgtaaaaagttgtacttcctctgatcaatatgacgttgagtgtccaagacatttagccagtgcggagtagtatacttaataaaaataatgttggcggcataacaaatcaatgtgtattaataatatatgacatcgagaatacggagtacaccctccttttttcatgttacttatctcttagctttgtccttagctaattatttctaactttgacaacaaatttttcaaaactagtatagttttttttaaagaaaacgtatagtttaccatcatgtaaattatacattacgaaaatatttcatatggtgaagctaaaaatcataaatcttatcattgaactatataatttttttagatattagtggacaaatatacacatatttaatttaaaacaaaactataatgactttgtattaacactatgattgtagtacgattgagcggctcaggcaccaccctggttttgtggactatgtaaaaggaaaaaaaacgctgccacgccgtttcatacggagtactacggaagtaccctaacatggatgtaccccttccgttgggtaaaatctaaatagtgctcgcgtactatttgtccttagggcatgtacaacccacagataggggttcgtctccaagaacctcgaagttatcatccagacagatataaagacagctcatacaacccatagacagaggatctgtctgtaagctgtttaatgcttttgcatgtagctttgatcaattgcaaatacgtttgtgtataccattgtgtggctatatatttgaaataatactatcaagcatgaataagatacatgattataataatttttaggaaccataaatataataattatattacaatgcctttagtctaatttcgtcgccaaacttttcaatcaccccttcagcaaattttatagtataaaagtgaggcttgaattcacgttcacattcacagaaacgggcatgcacataactgaagcattcacataaaggagcacatatacataatgcctgtaactgaagcatgcacattcacattccagaaagaaactgaagggtacattcacattcacataagcaaataagtcctctcggcactccaacaaaaactgaaactgaagcatgcacattcacattccaacagaaactgaagtgcacattcgcatttacaaatcacattcacattaattcagaaactgaaactgaatgagacctctcggcactccaactgacctcacaggatgtatatatctcccaggatgtatacctcccagccatgaccacaatcaaatcaatatttagctcccagtatatacctccaatgatcaagctctgaatttatttcctaaattttccttttctgatcatttgcagattctctccgcgcgggatcctgccgcgccgtcgcctcgggacgacgagctcgtacaacggtgctgagcttgcctcttccgcctcggagcacgggtcgtcgccgtcgcctcgcgagaggacgcagctcccgtcgcttgactcaaccggggggttttttttgcataaaaggcatcacaaagacggggcaaaaagacccgctgtacgtgcccttatcccgttaccctttcgtaagccgtccaattagttaatggtagtcgagttacgaacacgtgaccatctaagaagcgagtctattccaatgtcagacaaagagaactgcatgccatccgccagttatcacgtcaattaacactactatttttttatagaatctttcattacttatatattctagacaatatgttatttttaaaatatgtttgaaccattatactgtacttaaaatatgtgacaaaacgaatctaatatcaaatatgttaaaattatttaaattttgttacttcctaatgagttactttcttccaacagtacagttatttctagtattttgaagaccttgtagcattgtagttatttctgcacaccataaaaagatacttttctctagcagtagagttacttctaatatcttatagagatatttctaattttaagagttagttccctgtaggctgtaccagtgtaggtacttcaaataccatagaaagttacttctgttctttcaaagttacctttgtaagcagtgtagttacttctaggatcgtgaaaaattactccgtacatgatgctaaattatatatgtatttttaaaaataacatagagatcactttgaatgaagaaagtatatgtatttatttgaaaatcgtccgtacgttttacttgtaaatttactgtaaatagcctcacgatataataatttgtagtgctataaagagttatttatattacagagctaagctacttctataatttaattaaattactttaaaattgatatatgtttagatatactcaacactatacttgttttatttgttatatattttgagtgaagtgtaatagtgcaaatagctcttaaaaatactatacggtttaggaaatataaatcattaaaaagttttaaaaagatatagtacgagagaataatatattgctatttttaggaagggttactcgttgacacacggcggatgaggtggtcgctctgtttaaccatgtgctgtgtatagacgtgtcccttttgttggtacacgcccacgccgcagcgcagccgtcaacgggtaaataaaccagcagctgcacgttagcacgtacgcctgcacctccaggcccccctgacctgtccccaaccgaaaaggcaaaattgacgcccaaactgcccattttttcatcgagaaaaccagcagctaaggccgtgtttagattttttttcttcttcaaacgttcaacttttccgtcacgtcaaatattttaacacatgtataaagtattaaatatagacgaaaaaaaatcaattgcacagtttacatgtaaatcgcgagacgaatcttttgagcctaattacaccatgattttataatatggcgctacagtaaacatttactaatgatagattaattaggcctaatagattcgacttgcagtatatatacgacatctataatttattttattttattattagtataaatttaatactttaaatgtgtccatatacttaaaaataaatttgccgcacaaactaatcacagacaataaagctgtctcggcaaagccaaagcgcggccgttttcccgggtgccccacccccaccccaccccaccccggcccgcaggtttccgtcccaaaacccagcggcgaccgaccctggccttgccccatgcgtcgtacagacgaaaccgcagtcagtgccgccaccagctgacctgcctgaccaaccaagccggcggctattcatggcggcaccaaaataccacccgccgcccgcccaccgtacccgcgcgcgctgcagtcgcggtgcgatatatagcaacccccacttgagctagaattcccaatccatccaaacccaaaatcggaggtagctacagccgaatcccccaacagttgtgtgcaatttcttgcttgcttggttttcttttccccccactcggatcgatctcgttgttgtgtgaggttttttgagctttggtcgatggcgtcgatcgtgctgctgctgtcggagctgctcggcggcgagagcaccagcgtaatggcggctgactggtacatgagcggacacagcctccgggagttccggcccgtggcggctgctccggcggcggcggcggcggtggccaagtgcgagcggccggcggccgaggcagcgggggagaagaagaaggaggagtcgttcgaggatctcgccgccgtgtcccggatcgcggtcgacgtgatgtggccttagagcatccgtcgccgccatctcgccggagaagaagaaaaagaaaattctattcttgagttttttttctctatttttctccttttttttggttgccaacgaggcatgtgttgtgtactgttctttttgagatcagatttgtaaatatacgaagtgattcttggatgtttttcatgtcattttgtcatcgattttctccttcactcgtttctttcactagttctccactctttttcattccgtctcaaaaaccatcacgattcgctctgaagtcttaacctaaatacgcacttgcttcttcagacaatgcagttcccgcatccagattgcttcataaacattgcagatccttttattcccaaatataacatcaattacaatcgttcgcggtacgcgtcgaacaacaacaatttctccgctgaactctcaagcatacaagagcaagcagatcgccagacactctgacagagagagatgctacgccaagagagtcccggccatcacagtgacagcttctccctggatccggactctcctgttctcgccgtccagctccaagtacaatgttccactccttggcgaagcctgacgaccatggtattgtgccgtttgtacttatcttttttttttcagaaaagtataatgttggcaacaattgtttaccccctacttgtcacaagaaggtagcaaaaggataatacctgaaacgccgtaagtttttgtttccccagctttccaccccagtaaggtgccagaacacaatgtgcgcttccacacacaggatcctgtaagagtatatccgagttgttagtgttttaaaagcctgtgctaaaaaatatactacgagaagtttcaaattttggtcgataaggggcatagagattaacttgccaagttataccaaaagtttctgaacactcaaggaacgatacagccatacagggaatcgtcataaaactatcaaatgcatgataacaagtttatggaactgtcacaagaaatcatgaccaaaataaatttcagtactcagtcaaattcacactttggtcacttcacaagtctatctaaaatgatgtttttttaattactagttgtcgataaccccttgactcaccttgaggtattaagaggttctgattctttggagagattatatcagtcatctctgcatcaatgccaatgtttttcacctagtgtggtaggaactaggaagattaaaactacgcataaaccagaactgtagagacttcaaataaaaaacaccatattatatagagttaagtattgttttcttttatgaaaggagttaagtattgtagtaatcatgcaaggtgtaatcaatttatgtctctgattgatgaaaaatagcttgtgatgatttaacaattttgaatttagacaagcaacattggtaacatcgtgacagcagagaatccttctgtacccatgcaatgactaaaaagtgtaccacatatgagattatatctacatattctggaactaaaatggccatttttaacttaacaagccacattgtctgcataaaaaacttggttgttgggtggaaagaatcggcatacctcatctatcccaaattttgggcagaagaatcgtgaaaagaagtcataatcagatccagcaggtgctggtcccgtaacaataactcctctaccatcacattttttaatttcattaatgttagggataatatcagcaacctcttttccggaagaaagttccacctgaaagccatgccagaatcatttagtactaacaaacaaatgaacaattccaactccttcctctccatcttctttttttaataaaaaaaatccattataaattttccatcttttcagaaaagcttaccaactcctcatttaatattagcatccttaaaagattagcaattctttctcttagggaaataatcgtagcggtagcattgccatggttcatgacctccattttaatctttgaacagacattttttaatcattgacaatgttgactcgcctaattaaatttggacaaataataatttcaaagctattctactttgtaggctaaaaataaaattgtaagattcattccatattactattttcataacagtgcagagttcagagtatttacaaatttattaccaaaaagtagtggtcaaagtgtgtataattcaattgatgttgccaatcattttaaccaaaaaaaaaagacatggtaatatccaaatgtactagttatgaaggcaacattcagagcagcatatatcaaattttgccaaattttgccggatgttgtaacttgtattaaggggatataagaggaagtacgatgaggtcaccggcggttgatgatttccaaacactgacgactcgggcgccattcagagtctccggaatcgacagcgtctccgcggaatcgtactccacgagatcgatcatggggaaatccagctcgatgaacagcttctcctcacccgggacgccgccatcgttcgccggaggcggcggagcaggaaccttcttggcggtcaggatgccggacctcgtcacgaactcgaccatggcggcggcggcgtgctgctgcttcgcgaggacggtggtgaagaggaagtgggcggatgccagcgtcgcgtggccgcagagattcacctgaagacaacgacgacgacgcgtgcggatgaacacaggggagacgagtaagaggaaacctagggttggggggaagggggaggcgacctcggcgacgggggtgaaccagcggaggcggaaccgcggggcggcgtcggcggcggcggcggaggaggaggggtcgcggatgaggaaggcggtctcggagaggttgaactcggctgcgacggactgcatccaccgctcgtccgccgccgccgcggcatcctccccttccaggaggcatacggcggcggggttgcccttgaacggctcggccgcgaacgcgtccacctgcgacgaccgcgccgccgtggcgccaccgacacgtcagcgtcagcatcagcatcgcgcggtgggtcaacaagagaaagggcggatagtgtactgaccacggcgtactggatggcgttcttgaccatttccggcgaggcggcggcgacgacgacgactgcggcgggcggcggcggctgctccgaattcgcgcgcgtgctgaggtggctgcgcaggcggggcacgtttgtttatactttatagagagtgaccagtcgtgctgcaggtgaatgctggtgctgtgttcatcagcactgacgacatggagcttggcggcttatattccttgtaggcactgccgcaccggacaagtgtcactgacaagtggggcccatggacaagtggagccctcggtgtgggagcagttggaaagttacaaatttggaaggcctctcaccaatcacaaaaattttgaagaaaaagttgggaactaggggtgtgtttagttccaaagttttttttccaaacttccaactatccatcacatcaaacctttcatacacacgcaacttttcagtcacatcgtctccaatttcaaccaaatttcaaactttgggtcgaactaaacacagcctagacaaggcctaggtgactggagacagtttaatactactagcatatactcctcccataataccaaaatatagcaacatggtattatattaaaacctacttattcagatttgttgtaatataatatactatatcatatcgaatgtatttactggtgagagtaacttggtactagtagaattctccattcagtcaagatggaaaatgatcaatcagttcggctcccatgacaaacccaatagccaacttcatcatcagttcttcacctgctcccttcttttttctatcctcatatttctgaccagctaaaatgatagtcaaggacagagctcaaccaaccaatttggtaatccagttgaagttagagctcacgtcaatgctgacaaacatgttgcccggcaagctgatttgtaacaggaaaacaaatattctgggcgtagcaaggcagactacaaacatctttacatggatactcgagtagtcgagttttcgtttatttactacagcaaaagcatgcatgctgcatgagaaaacaaacaacgacagaatttcgttactcggatcagatttggtccaagatcacctcggcaccagaaaccttgaagtcagaaggagctacctcaacattgaaagccttgatcttcccatcgtcaacaaaggctgaccacctaaaacggacagcaatacttttagaagagaagtaagaaaaatctatccattaaccagtcacatttcacaatctcttaaatgacaaaacatgtaaattacatcctcaaaaaaaaaaagtgtaccacagcatgagctgtccatggagattatggaatggcatttcaggcttagccaaatgcatacattgtgtcaccagagtactatttacaacaaatgaaagggggcacacaaggaggttcaaaagtgactcaatgttgaatgatgttcaactttgcggaatcacgcaactacatattccttcacaaaaaaacatgcaatacatgcacctggtgaaccataattatgttccaaatatgcacctcagctcttttgtttgaaatttcaatgcacccatagatagttgtgcagctaacaagggcatgctaaagtgcgacacttaggaagtggtttggattcatttattggagtcttttgagaggttagcctcagtgcagtaaattttgtcacaacaacagcaaaatccattggaaatcgactgaataagactcacacttaaatcatgtataggcatgtgcatgcagcttgaagtaattgatcatttacagtcatgaatcatgacagtttaacagtagggaacatgtgtagattagcaatgccgccaatgcagaatgtccttgacaacataaaacatgctcaaatatgataatgaatgcaatgcactttgaagggtaaagctacagtaaggaaaaggagtacttgagttaacccatggtaagtaataagtttaacacaatgatttaattaaacaaataaagcaaaaggcaactgaaatacgttgttttatgttcaattgtaattatataaaacaggcagcagttttaactttttaaggacataaaccaagttaaccaaagtaaaattcattgacctgtgggaacggcggccaagcaaagcagcagagaggtctacttccaaatccaagcttttgtggaaactcccatcaaaatcaccataaaattcaatctggtatcaatattacaaaatcatagcagatggttagatttgaatattatgtgattgtgagcaagtttgatatgaactatatctgcatggactcatgggacaaacattcataaacaatagccatctacaatggtacgagactatgatacgctggtccttattatttttaaagtatagaatatataactattatatacttgaagaatgtttatgtttcttcttacattaaagtgtacattaaacaaatcagaagaaaaacataaataaatttaggtgaacttgaggagatacatgaaattagctttgcaatttactgttttacaggttatatgatgaaataagcacattactggcagacatgtgcagctttcaatcattacaaagtactgaggcagggagagaatacaatagcattcagcatttgtattatggataaagtccaccaaacacaaaggtggatattaatataccatgcatgattagtaaatataattagattagcaaaacatacagcgtgtttaatgcatttcttactatttaagcatatagaatggtaactcacagcatcttttgcctgtagcttttctgcccatccattcagggcataagggtcattcacagagacacagataacagagtcaaccccttttgctttcaacttgtcaatgttatttttataactagggacgtgtgcctgtgaacagactcctgtgtatgcaccctgaaatatgtggtaaagataacagtcacctatattatcagatcagtagatcattcagaaagagaatcgctccaggatataagaatttggaataaacgatgaaaaaatttagacaataaacaaatgatatcaaacatataaagcttcataaatactaaaagacagttagaaatcaactaggaattttgatagaaatgccttattggctggctctgaaagcagaattgtgtggataagtaacatgaaatttttacctttttgtttttactattgcaaccccaaaccatattaccctcactagattgtttgattagatgcagcaccctgtttgctgttcagagaatagagaagaatcgaagaaatggagagttctattaccatttcacctgtgggcaccacgaataccaggctttctaatttctgcactcctaatccgcaaaagaactactctcaagtctggcatttcctactccttaacttcaaatgttggaatttatcttgaaagttgaagtaatcgatgcccaaactacctcttcgccatggcccatggctaatgtatgtcactgtaatgacagaggctacaggaagacgaatccataatccccaatgcgcattcaggatgagtgtatccacacaaaaagcaacaaaccgaaggtcctcatctggtatccgaaatgtatagagtacgcatgaatttcgggaggaagagaggaggggagagcttacaggcaggccgaagatgaccactttcttcccctgcaaaaacacgagggatcatcagaaaagcctggctgagcagcagagcagacgaacgtgggtagtgtagggctagc

SEQ ID NO: 79401 - DNA, 94641 bp, Oryza sativa
  unsure (1)..(94641): unsure at all n locations
gaggaaggtttaacaaagagaccatttcaaaatatcatcgacaagcgtaccattcaaagaagaatcattgacaaacccatctttccgataatgatattgtacaagtgtttctgcccgcccgcaagcgctcaccgcggcaagaagcccggctccggccagcggtgggggctgttctctcgtgactgcccctgcgccggcaggaaggcggtcaccgtcgacgtcgcctccgagccgaggagcccggcgacgccgagaacccacgcgaggtttgaaaacagccatgtcgtcgccgacagcacgatctttaaagcgaatgcgccgccgccgccaccgccatgcgaggaggagcccgtcaagatgaagatatctccggggagcagcacgtttcctcctcccctcgcgaacagtatcttcgcggcggcgccgaacaggggcggcggcggcggtggcgcggcgccgttcgccgctttcccggcgccggacattgttggccgccgcgtcgtgagctccggcggcttcacgttcccggtggccgtcggcgcggcgaaggtggtgagcaccgttggcgacgagccgccgcgcgagtcgctcgaggtgttccggcccatagacgaggagtcggtgctcgccgacccaccggccgatcacctggcgacggtgggcggccgcggaggaggaggaggaggcctcgccgcaggcttcgcgcgcgccccaggggtggcggcggtggcgaccgacgaggaggcaatgagcgacgcgagctcggacctgttcgacctcgagagcttcgcggcgtcgtcgtcgttcccgaccacgtgccgcgggcgcagcagccggcgcaactcgcgggaggacgacgacgacgacgaagaccttccgtacggcgccgcggccgcggccgccgccgccgtcgagccggcgctgagcgagtgcatgtacgcgccgagcgaggtgagcgtggtgtggagcgtggccacggcggagggcggcgcgttcgacgcggccagcgtcgccaacttctccagcgcggcgtccgcctgctgcgtcgaggagttcagcttcgtcccgccgcctgactccgccgccaccgctggcggcggcggccacgagggcttcaccgccgccatgtcgcgcagcgccgcccgcaagaaaggcggcgggttcttgagcagctgccggtgcgagaaggctgtgagcgtcgggccaactcccgtccggatggtccggccggaggtgaacgtcaagaccaccggcggcggcgcggcacggtatcaccccggccgcgtccgcatgccggtccggacgtgaactcgccgccggtgagcaccggcgacgtacatacgttcaacgagcgggagaacgcgaaggcgtgcgctatggtttaattagttttgatgtgtaaatttgtgagtgagaaatgtgttggtgtaaggaatgcacatttgtgttgtaataaaccaagacttttaatttctctatacagatttcgtacgtacatatcccttcagacccttcacagagaggggagggggggagggggggttcgctccgcctctccctatacgcttcttcccttcctcctctccttcttctcttcctacaacatattaaaccataaaaaaattttaaaaaacaaatagttagaaaaatttatgtatagaaatactatatataaaaaatttgaattcaaattcaaattcaaattcaaattcaaatttgaattaaaatttaaatttgaattcaatttgaatttgaatcgggtatgtaaacttttgacttataaacattggatctataaactttaggtgtataaactttagatgtatatagaaaatatttgaattcaaatttaaatttgaatcggatataattcaaattcaaatttgaatcgggtatataaactttagttctataaactttaggtctataaacttaactttaggtgtataaactttagatgtatagaaataatatatatgaaaaatatttgaattcaaattcaaatttgaatcggatatttgaattcaaattcaaatttgaatcggatataattcaaattcaaatttgaatcgggtatataaacttttgatttatatactttagttctaaaatctttaggtgtataaactttagatgtatagaaatattatatataaaaaaaatatttgaattcaaatttaaatttgaatcggatatataaacttttagtctctaaactttatatgtgtaaacttgaggtgtataaactttaggtgcataaataaatttactaaaataggaaagtaatgcggtgccaaaaaggaaacaggtggagggagggaggggtgaggtggggagcgaatctgatcgctaccccttccccagggcgagcgatcgccaaacagcatttctgttcacaagttggtttctttgattatagagaagatgtaacaagcacatgcatcatccgtaaatgcattagaacgatcaggaagaaatactctctccatccctaaatatttgacgctattggtttttttaaacatgtttgattgtttatattatttaaaaaatttaagtaattgttaattctttttctaacatttgatttattgttaaatatacttttatgtctacatatagttttacatatttcacaaaagtttttaaataagacgaacggtcaaacatgttaaaaaagttaatggcatcaaatatttagagacagagggagtagcatatagcggttggctgaacaaatccgtaaattgacattgttatggattgaaattttgttgaacagtcataaacttgcaaggatttgaaatgaaaaattgttaatggatggcctttgatgtcatatatctagacaatcagataggccaaccgctagttttcaacagtatagatttctacaattagtgatttggttttatagatagaatatgtactacaatgctatatatgatagtattaggttatttgttggaccgtttattggttaacatttacacaaatgcaagttggacttttaaaagaaaattaatcatattagagatatgtcgctatttttttgtttatttaaacatgtgttaagggtgtatctatgaatgtgtgggtgtggtattgcgtgtaataatggtgtatgtccgtatcggccatatatttttttgaaaaaaaaacattgaagattctcttctctacccctctctcttcagctccataaagaaatatatatgcaatcgagaaaagttttaaaaaaatagtatgtatattcttcctttaggctgacgtcaccctacgtccgtacaattatataaagacaacgaatgtcttaatgagattgctttcctttattgtgtaccttctagataaacttatctcttttatggccttctgatgcacttgatttgtcaattcaacatggagacaattaatccaaaaacgggatcaacacgatgtgatgtgtggcaatgcccatgttgagtgtgggaggcaagtacgttgactgtttagcatctagctagacgtccgtgtgtacttaactcgtgcaaattaagccccactgtatatgagttgttgttgctttgttgggaccacatttcatacacatgactaattagtgctataaatctacatttgcattaacgttattagacggctgttttgtttttaagttgtgcttgctctctaattatctgaaaacaaaaatggaacgctctacattttatttgacaaaaaaaatccctagaactttttaaatgtcaaattgtcgaaatactctaagatccatacagtgctatggtgtttccaccttgccctttacccctgcacgaataactccggcacgacgaataaaatgtagggtttaattaactctgaaatcctaagtaaacactaactcgtcttgctgtcaccgttgctggagccaggggcggatctacagtagtaccaccagtgtcaggtgacaccgacgacttttgataaaagctatgtttaaactgtctatccataattataacactatattctaaatataattagtatgatatgacaccgataaacacgttatgacaccaatgaactaaatttctggatccaccactggctagagctgaaggagaattgagctacagtcattggagcacgaatctcgaattaaatcccaatattagaaatttttaagacttgggtacaaattttctaacgaatgacatttagcaaattttttttaaaaaatcaccaatcgtgagctaattagtcgcgagtagattgcaacatatatatgccatatcatgtccgcgtcatccgtatggggaagatcgagctagcattctggagtttggtttctcatgaagctttctcgccgatcgtttctaagcaaacatgcataatgtacaaattgtacatcatatgaacccatgcatgcgtgcgctccaaaaattcaaaaaagaccatatacacgaaagcgagacttcacataaataacgtacgcggcattccctcgtccagcaagtgcaaattgctacagtgggctagcaagcaagccaacgagctagctagcaatcaggacacttggattccaacaaaaggataagccggccggcgaccgatcgatgaatgtatcaagtttgtcacccagtgcatcaaatgaatgtatcagaatactaagaagatggatttttgcctcgggagggaatgtcccgttgtttctgataggtctcctaaagttgttatgattttctttaaaaaataacaaaattgataaagatgaaatatatcattctataaacacataggaggaagattaacaaaattgacaagatcaaaattgaccagacaatggacttcgctgcttaaggaggaagatggccaaagagtaaaagatggttgcatgatattggagaagagagtttctagtttctttgcaatgagagggtggaacttaagaagaagattggaagtttaatgctctcttttctttgcaccatggggttttgttgtcttaagtactgttttggctaatctctgtcattgtctaagtgtccgtttatggtcactcgaatttgcgttaaaccttttgtaagggtgtgagcctaagtgctcgtgtaagagacttttaggctgtgtacattttttgggtgtagaggccggtttaatctattatctaaaaaaacacataggattaaatttaacttctaccatttgcaaaaattaaaataaactctactagtatatgtatatttacagttaaattgttatatttatcgcaatttataaaagttgattttttttatattataaagagagagcttgtattattgatggaaatagggattgtattcctggtttattataaaagtcgaattgaacttgtgtgtttgtagaatatgtgtatcacatactagtttatctcattatatatttttttcaaaaaagaactcttaactatttagacgatgatatccatgtaactcgtcgatcgacagatattgaaaaactttgtggactaccaggttcatccatacccctccggcagctgacgaagctacccatgctttgcacgagcacacacatgacacactgtgctcagcttaacctacatatctgcatgcgctacgtggcctcgcgggcggccacaggctgcgtcgccaacaaaattcaggaattatttctggataccgcctgtttccgatgagctacagagctagctatgccgctgctagagtttgaagtgggcaacatgcagcagcaagggatgggggcggggtggccatgtggaacgcgtgtgggcgggcgtcgcatgatcgatcgatcgctgggtattgatttgtgaacaaactggccagcggcggcggcctagcctacgacgcccacctggaactaagagcaagtttaacagtattgtcaactactagccccaatttatctatagacaatctaatagctcatttatacaataattatatactatatacttactattaatacctggtcctacctatcatacacacgctgcgtcttgagtccgtgctacagctggctacaaatttgtagtccgctgcccttctctctcattatttatttccttaaaatatgtttgcagctggcttatagcttgctattgtacctgctctaagagaaacgttgtaaccagctgtagcacggacttcaagatacagtgtatgtattatagatgggacaatgtattaatagtgtactccctcccgttttattttaattgatgttttggacaatgatacagtcaacaaaatatatgtttgatcttatttttctaatataagatatataataaataaatatatggtaatttacttttcttatagtgctttgaaagacaaatatatatttattgttctagttcctttaaactaaacatttttaaagttattgatggtcaaagttataaaagtttgatctcaaccatgtctaaaacgtcaattaatatgggaccggagggagtagtatatatatttatagataactattgtatgaattaactattaaattgactagagatgatttaaagctagtagttgactatacttaaacttggtcttaacaaagctgcaagtatggaacggtggaacccgaggtgttgtggggcccggctgcatgaggtgagaggggcgcgtgggtccatgagctgtggggctcacatatcaacccctcaaagttagagggtagtaagttagagcatctttttacaaggcgagagtatggtttggacttaagacgtacaagaggatggaataattgttgggcttgtttagattagtgtcaatttttttttttgaaactaagattagtgtcaatttttgacatgctagtattttgaaagttttgaaagtttcgcaagtttagacactatcaaattaattggtagagctgagttggtattagtttaggcaaaaattggtatcaaatcaatttgttatttttaaagttgccaaaaaaaatggttgggcagaatttggcactaatataaacaaacccgttatctcccgcatgattctattaacatgcccagcatagcttgattgttctgaataagatgaataataggtgatatgttatttgattttgcgatggtatttgtgggcataaacgaattatggattaactgttacgaagttaattggttgtttttaaaattatcgtaagcaatttatacgtaagcttttctaaaaatcgcacagtttagaatcttgttaagcatcctcgtgatagtatatgagaggaattagggcctaattctgaactgcacacaaaggaaaacacggtttatttactactatttcaatattataagtcgctttaactttttttaaaatttttttaaaaaatggttaaatttgttgaaaaatatagtaatattttttaaaaaatattattaaaatatatttaattttacatttaatggaactaattcagtgtgttgtgtatgttgctaaatttttctatagatttagttaaacctaaagaagtttaattagaaaaaaaaatcaaaatgacttataatatgagatacggaggaagtagatggcaacttctgcttatgatgggcgatctgatcatcttattcagaagagccaatcggaccaaatggtgcggtggatctacaaaagttttagaccataggcaagtatagttatatcaagtgtttactaaaagaaatttatttacaatactataagtaacgctcaaattatattgcatgttcgccaacaagttatgacaactgtccaaggtcgtcaattggtggatctatgttaggtttgcttcgaccttaaaacacatattttcttagctgaagctttgaagacacatcatggatagtagaatggggctgtgtggttgtagccacagttacgacaagatcatcttaagcttgccaaggtgtcaaagattttgacaatatagcagtttttattgacaaattttggtagactgatacactataagaaacgtttaggggtctttccgactagctttacaaggtggtgggttttggagctagccggtctggattcgaagcctcgcttattctatttatttgatattaggttatttcttaataattgcggtctctgatacactaatacactatgagtatatgactaacaaacaaacaggtacatatgccacttagcaatcctcaagccaaaaccgagtgctaaaggtaaaacacacacatacacaaacaaaaaaataataattcggtagctcaaacaagtaggcccgtgaacaccagatctgacagatatacttgcataaaacataacatgcatgttcccagatatcccttttgttttcgtagtctacgatcgatttgtaactctggaaagttggtttctttaaacgaggcatgggtgacctttttgttccagagaaaaggaattcaggagtgctcaattcatgcaagttgaagtgtacatatcatcaaattattctgtgaggaggaatgcaacatgttatccattctgttttcttcccatttattatcgagagacgagtgattgcccaaacttttctcacggattttcaatgatatcatgaacagaagatatacataattaattattatcctccagctcgtaaactggcgaaatgggtccaaacattcattcaggtctctacacctactcctagctgactgtcattgacaaatttgatttgtcccatctctcaagtctcaaccgagctaatgctgaagtagtgttctgttgtaggaatgaaacacaactgagcttgaccattttaagggctcctttaaaatgcaacaattttataggaattagcccaattcccataaaatttgtttccaaatcccatatcttcaaaggaggcctgaagatgtacatcactgaccagccatttcctttctagcacagcacgaaacaacacaaatgtccaaagctagcaaatattcagatgcacaggaattgaacgcatacaagtacacggcacatcaaattatttattatggaggaatgccacagggtatccatcagaattttttttccgccgggccagcagcaaagaaatgccccgaccgaatttatccatcagaattttctcatttatatttcaggaagatgtcaatgcatcacagccgatggtccaaacgttccatcctagttagctaactgtatatattgacctatccgatattcccaacccatgactggagcaagcaagcagttcaactcagctaagcacgaagagggaggagctctcaagccagtatgctacctccctcttcgtgattcggggaatcagttccactatagaaggaggcctcacttgaggcgtccgaaccgccaccattagcctccttgtcagcggatacatgtgaatggtcctgaggcagggtgatgccgtttgatttgaatgaagaacccatcttaatgtcatcggctctcatacgctcagcatagctattgtattcgaaggtagctggattccttcctccgaatgctgagtcgagcttgtccaagtcaaagacgtcagccattatcttctggctctctttatcgctggagtacacaaatttcaccttcttgtaggtctcatggtccaaaaatggcttcactatctgccaacagtaactaatgttaggctaccttatctcatgacaacagagtaacacactaaaaatagattaattttactgtccttgagaatatgcacactttgtaatgttaatttgtggttcagtacctcaacattagggaggtaccaaaacaatacactagcaagtgtggttgaacggtaaaaatcctatatggtaaaaagacggaagaaagaataagtgaataactgtactctcaagatattttaaggttgttctcaccttccagaaggactcaaatatcctaggaggattgtaaaggattgctaacccaagcctctcagggtaacagtcttgcaagacgttcacagtctctcgggtcactttcagcggtgtgctccccaatgtccaactctggaagtctgtcagccagaccatcttctcttgatcttccgtcaggctcataattgctttctccagacagtaaacaagatatttgatctgtccctttcctgaagtagtgttctgttgtgtttcaaagttaaacatgtaaaatcagcacatagcatgcaatcaaaccagaaactgttgtggcatagctgtcacaaaatattggttcataacaaatgatctaacaatgcacacatgcacacacccaattgatttgagaaacaataagaaaaatccggaataataaaattataaccaaagagtgagattctccttttggtttttccaaatgctgattgacttcaagctaaaattgtaaagatgtatgtatccctccgttatccacatggtcgatttgattcatagcaggaaggataacatgatagcattgcacacattgtatggagaagtaattatgtcccttttatctggaaggtataatcccaatctgatttcagagcatactagatggttggcagatgtacaactaatgcagatgagtagatacatacaaagtaaacagaaagcacgagctatatcaaaacaagactgttatgatgttaatgtattcctttcttcctgccgaaagtgcactaacctctaagcctggcctcaggacaagaacagttcttccatgtttgtccttgtagtcagccctatatatctttcctgtctctgcttcatgtgcaacatcatcctgaaggttgaaaggacaataagattacattatgttgtaaacctgaaaatgcagttacttcctaagtatcaagaatgttctgctttagcatcacaatgctttctccccaatgattcatagaatgctatcctcctattagcacaatcctgtctaaattgacactaacagcagttattcctcctgtctactccctctttccacaaaatataagaattccaagcgtaatttgtccataaatataaggattcctatagtgccacttgaccacctctcattgaaattacttcccaccttactcccaactactcttccaccccccccccccaaccatcccccatttagtgaggggcaccaaagtcttttagtcttaaccttaatcccttctaaacaacctagaaattacctatggctctcagcatcaccaatgtttcagttataatgctatttctattacagcccataaagaaatgcatattcaattgatgattaacacaagcatacccagttaatcttttgtggcatatatgacacccgccactttacagctgacttcatcattttacttgctttctgcacgttccagtttcttgctcgaagaaatctcaggcacgaggcatctgaaaggaaatcttgtatttcttctgatgagtgttcaccaagctccttacgcaagtcatttatctgttcatcagtagatagcacaacaacaaagtaaatggttcaaagcgagagtaactaaattaaattacgaagagatatacaatcaagggatttttttcaataccttctcctgctgctcttctagggtcaagtttttctctgttgtagcaccattgcttgacttgaatagaaaggacattttagtacctcgacagagaagggtccactagatacggaactgaaaagcaataaatatcatcagacatctgaagagtactaaatatgcacgaactactttctgttcagcttccttgtatgaaggcaaccatctgaactaaacaacagaataacagcttatgaggcaggtgcgagaaaaaaacttgccgttaacaaaaattcagtttcatacaaaagataacagaaagtaacaacaaatgctactttaaactgatatcagtacatggttagctagctgctaccgcatgtaattcatacgtggctggaagagcagtatcctaaatgagaagcatttcacagaattcagaaggccgtgcttctgaaaaaccagccgattcagttccacagaagacaaaattgcgacccgaaactgatttcttaagttaaattgaccatccaagatgtcactaagttaaagtagcatcaccatataccgtatgagccagatccggcaacgctaagtttcttgcagattttacaagacaagtagccgagtcaagatcacgtcaacgcaaacaatcccggtggcaattgctactactacatcttcaatcctagtagcacgacacaacacagaacgaacacccgcaattcgagcacgaacagtcacagatcgccgccgtatacctaatgctcctcacatcaaagattaggtagtagagaaatccgatctttggccgagtagaagaaaaccaacctggatcgatgcacccccagcccccaacaaccggggaggctcgcggatcagggcccgccgcctgggcacgacggcgagggctggggtggggaggtggcgccggccgaggtgggagagtggtggtggtgggggtgggggtgacgtgaggagggcgagagtggagacgacggtggaactggagggtgagggtgggtggggttttcctaggaaggatggtggtgcggtgcggtgcggtgcggctgccgtggcgtggtggtggtgggcggtggtgcgggtgcgggcgtgggagacgggacgcgcgccgggtgccaaaggcaaaggccccccgcgtgtatgaccggccaaagatgccgggtcaagcgcggggtcggggtgggggtggttaagtatgatgcgcgatcacgggagcgcggagtgtggactggaatggagtgcaccacccaacgagatattaccactcttaggacaagtactatgagcataaagcatagtctcataggtgtcacataagctaaaatagtgaggtggaggagagaagagatgaaagagatatgcagccacctctcagagcatccgcaatggttatctataggctctctacaagatatccaagtcagcatattttcctatttgaaagagattaaatgaagagagagagtaaaactatctactaacctggagatagtctatagaaaaaaacgatgcaatagattagagagatatagatacccatatagacatactattaaggtgatttactattaatctagtctattgctgagatgtacatgttttatagaaagcaccttactttactattgcggtggatctcatgcaagatgcaaccaccacacaaaattcaagacaaaaggagagagaggaagagtagattaggcaaacaaacattggggctagtgtattagaattagtatagatgtgatatattgtacatattacctctacatttattagttgatgatgtggtcaagattagatgcaacatccacctcttttataaaacttgcctttatgctccgttcggtagtacaagttcccagctcctcctcctcgttttccgcgcgcacgcttttttcaaattgctaaacggtgcgtttttttgcaaaaagtttctatacgaaagttgcttaaaaaatcatattaatccatttttttaaaaaaatagctaaaacttaattaattacgcattaaaacgctgtttcgttttgtgtgccggggagtgggctcaggcacagtagactataagctaactttaaacatatatcgataatataaaagaggagggagaagagtaggctacaaatttattcagctgaagcacgaactcgaatacaagtatttgtatgacaggtggaaccatataagtatatgtttatagataactattgtatgaattgactattaagttggttataagtgatttggagctagtagttggctatactattaaacttgctcttacatgggtaattattaaagatttatcactgaactacgagtaataaatctttaattgttatatttaaaagtggcaaataaaagagtgctcgcacaagatttttttttctaaaactagttttacatgcaatacgttatacgtgatcgtgagatttttttttctttcacttttcttgagagtttttttaagataggtttttaaggaaggaaggagaacaactaagctggtggttttttaagttccttttcttaaaaaatataaagaaatatagcggttttttaagaaacactacgcttttaaactacttcagttgcctttgtttttataattttgtagaaatacattatgttttaaaaatatacccgtgtcaccgaccaacgggagattaaaacatcgattttgctatatatatatgtcgacaaatttttccctaaaaatttgacagatgtaattacagtacaatcgtagtgtaattacactgtaacttgcatgtaattacactgtaactatagtgtaacttgtatgtaactttcaaaaatctctctgtaacatgttatttcggtaaaatggaggtcgtgggaacaaattctttcacatacgtgtgtgctatgatttgttttcttcctcaccaaaacaaatcttgtaatagatctaacgattcaaaattatgtgaaacttacatataagttacactgtagttacatgcaagttacagtgtaattacatataaattacagtgtaattacactacaattgtactataattacatctgtcaaatttttggagaaaaatttatcgacaaatggataggtagtcccttaaaacattgttacctcttgatcgagcgacactgggccatgtcgtttctcaattgaaaaacagcataactgacactagctaagacggcaagacgcaacaggcaagtgagcggaggagcacctagcacaagcatatgccagcaggcggtggtgcggcgcgtgcgagcaaagtcacattgaggacacagtctcacccagtaatccgatgtatgatatgctctgttcaggagacgcaaaacgaagtctctattattgcatgattaattgagtatttgctttttttaaaaaaaaatagattaatatgatttttttaaagcaactttcgtatagaaattttttacaaaaaaacacaccgtttagtagtttgaaaagcgtgcgtgtggaaaacgaggaaagggggttggaaactactactaccgaacgcaggaacacgaggatcgactcctctcaatcagcaataaatgtagggcttgttttgcgtcggtaggacatgaggatgtttgtttgttacaaaatttctgaagatatattcatacaaactagtgtaaaaggtttattttctccatttttaaatatttgcactgaggcactattgatacgtgctttgacaacttttttctttaaaaacataaatacttagaatataaaacatcttcttttgtcaaagtttgttgtgcgctgaacatcttagctagtgaaaagtaaattctaaaatgcttctgggatgagccacatcatccagtgaacaatggttattgcatcaagaaaaagacaaaataaaagagaagagagttgagccatcaattataaagggaaaaatggatgatgaatttctggaaccttccaacaatttggaaatgagagagagaaagagcaaagaaagaaatgtagcattggaaaagagtgggggagtcagctagcttatggcatgtgataattttgcactatgcacactcagtagaaattatgttataaataaaatctcatcctttatttataaataataattcgaatttttttataaatggactatcggcttataggcttatattttatctatagataatccttacaacctactaattccaaattactgctgtaacttgaatgtcacaatatcacataacatactaataaaatttgctatgattttaatgttatactttggttcacttctttagcataaaagctaataggttgggcttaagaatgagtgtttcacctacagatacgctttcaggttatagctgatcaactacacttctctcaacacatacttaacataatgaaacgatgtttattgttgccaatttaaattacatgctcatgtacacatataacatgatggttaaagtcgcgcgaacaagcgacattatatgctagtaaagttgatggatgatttggtttgaagccaaaacttgcataccaaaatattggcattttaaacggtcattttggtaatgtttggtttgttaccaatccttgccaataccacataaatattgtcaaaatattggcattggcaaaaacttacctataatttggcatcgccaatagtttggcatagttacaaaccaaacaagacctgaaacttttgttcattgtagcctacccatcttaaaattactattaggaaaaattgaaatatatagtaaaaatttgaaattaccaagtaaacgctaccggagggagtatgtttcttttttttaaaaaaaaaaagaaaaaaaggaaatctccgccagaacgccacccggcatcgtctggactctggatcctcctggatccatgctagaggcctagagccatagattactgatttattgtacatactttcaacatggcagatgttcttctcgaatggctctcggcgttttgttaacacaaaggggcgtaatgtgtcatgtcgagttgtcaacgaagatggtagagggattccatcaggctgagcgcagatcggaatctatctatgagtataaatgataatgatgtggatacagttaattactaatgacgtggacacgctttaagatgctctagtctctttcacaggtcaaatctcgtgttcaatagtactataggagtagcagccaaggagcagtttagttagtattatgtactcctccgtcttaaaaaaaattcaacctaggactttgatgcgacataatatagtacaacgaatttgaagaaacctaactcctcttttttttcatcctccttttttttctcttccaaatttctctctccataaatattttcattttgaaattatcattgtttaagatgtgtagcggcaagtttgttctcatgcaaatgcttttcatctacagtaaaaaaaactttcactaattgaataatcaaaatttcaatttttggtcaatgaggtatagcaaaatacatatgcgacgaattatggaatagccactcgatcgattttgtgaggctattaaaaagtgtacgtaaaggattctccgtgtgatgacgcatgaagcaagtgtaattgggctcaatgctatatatgatttctgactttgttttgccattattttatttatcttgtttcagtttgtcatttaaattggcagagtttctacccatcgtaaaaattatcttcaaacccaacgccatttttgctagttataaacttataaataaagaaagcgctggcctgcacctgtctggcccaatcggctgggcttgcacccactcttgggccttgggccagtgggccgtaagggaaagagagaggaagacacgagcttttctcctcctcttcctctcccttcgcccgcggcgacaaccctgaaccctcctctctctcctccaccacctcccctgcgaccagcggcgcgcggcagcggcaggcggccaccgggatggcgtcgtcgtcggggacgagggaggtgctcatgctggaggccccgccggcgccctccggggcgccgtggcgcgcgccgccggacgcggaggccgtggacgcgctgccctacatcgacggcgactacggcgacccggcggtgaagcgggaggtggaccggatggtggaggaggagatgcggcgcgggagccgcaagcccgccgacttcctccgcgacctcccccccgtccccgccatcgggttcgaggtagattcgcgatctctcatctcctctcctctccttgtgggttcttggagcagctctagttcagcgtcggggtcgttgcgttcaactatcttttcaggcgaaaaaaaatagaactgtatcttttctttcgaatgtgattcgcgttagggttatagctacttgtaagaatgaaacgggttagaggctggggggtgtatagggttagtagttgtgtactcgaaagtgagagcacattgctaaatactgtacattatcctcctttagaactgtgcttataactatgttttggtggcggaattttggattatagttgagctaattaactgagtatatgtggcttgcttggatttgtatagaacttttttttttgtaaagcttaatgttttgctctgctataatgtctgtatgttaacgttgatcctgaaaagaacaagagagtatttttttctgttgccacatgcttcaattgattagctcgtatggaggacagatgcctgatggtccgtgccttcaaattttctgaaataataataattgatagttttgactagatccaccctgctgcaaacagaaaagcaacatattttggctgcaaatatttaacttttttacttagcaacatttcttgaccaccaaatgaacctattgatttgatcggttacttgaaattaagtatacaatttgaggcaccaagaactgaaatataagctcttttccatgttctgtgtgcattgagctaaaccgacaggcaatttgaacctgtggcagtcaataatatgacctaaggtatcaaaagtgcacacggcagtcaatgaagaatagttattataagaaaaaagaactaaattgaatgggcattcacgctttgatgatttcatctaaataattcttatgagatgtaccagtctaggtgtttgcatcatattaactctgctccataatagttgtcttagagctcagagagcaaggaaagggttaataccttttttttcacaaagtttgcccttttggatgatataatctgtgcttatctgtgcaattgagtcatatttgaagatacatacagccatttaattcgttgtaggcttgtattgcttattgaaattatacaaaatatttgaatcacaatttgggtttcatttttttagaacttatgcctcatcatgtgaatatgtttacaaccttatgagtttttattatttgatactcattttgcacatctgttctagaatcatcctatgcttgctaaagagtacgagcgtgttagagctgggaaacctcctgctaccatagagatgtcccgctatggtttggagccacccccagcgaacaagaggaatgatgttgctgcatggaggcaggctctaagaaatgctcagagccagctgcaccatcaaatcataaggtaagagtagagagccacagggtactgaactaatgaaatttaccatcaaaggtgcagtatcgttgaacgttgtgcatttgattgtgataggatcacagggaccagtgtcttcctgtggcatgtccttttgataatttttcattaccataatagcttttaagctttccctggtgtggaaaacatagacttcgagaatagtatcagagtagataggatgggctgcttgacaaaggtttctgcagtctgtttaaaataacaagcagtattattttgataaaagagcatgttttttggatacactgacaatttgtaaattggaggattgtataatgctcatagcagaagacttttccttgtactttactaaatgtatcttgggtaaattaagatatttgatcatgtattgcctaatatcagcttcaacagtttacttgacaatgggagctcctaggttagttatgattgaacatgtaaagcttcgatcatgttacttcagaattcgactgctgtacgcactgtgtaggatatactgcttttttctgaccatggtttcttatcatctatggagtcagcatacttctatgctattattagttttgaaataaagttaatattgcaggatagagaatctggagcttatgctgaagtatggtgttgaggtttggaagcttcagaatagacaaatggaatcagttttgtctaggtaggctattgtgacataagtttattatctttgaatttggagctacgtatcctgtgttattcatgagattcatttagagccatttcagtactcctgtttgtagactctggtctcatatgttgatagtgtagcttagctgtttaaacttccagtaaagcacttattttgatatttgaagcacttatttcgacattcttgtaagtctcaatgctacttatcactgtaacaatatggatggtagattatttttatgcctgattgcatggtatctaagatgtcgaatatagcatttatcattctagcagcatatgatgggttgatctctttataggatgcaaaagatggctgtcgaatacaatgagaagatagaaactgtcaaccgcgagaggaaatttcaccaggtaattatattactcctgctcttgttcttaaccacggcatatttcacagccaagctgatcatttgtgttttgatcagcaaaacactggtggtcaactccatgccttgacgacggaatggcaggagctgtgtcagaaaaatatagctattcaagctgcatgtgttgatctgcagaatcagattgatcagcttaaacttggagctaaagaattgtactccccctctctccctactttcctccctctctctccacatccacatgactaacagattccttaacaggggaatgcccatcgatgacagcaccggaactaatcagcaagcatcatcagccatttgaggtactatttgttattttgttctcaaagaaagcagtattcttaggagtattgaagttaagtcaagagacaaaatctaccttcatcatgcttacaagtttttaccacagcacagatacataggtagcaatggaggtgagacaattccatgagatgggagctggaggtttccatcaaggcacatctttttgcatgatctgcagttgccaaatccaagataacaatctaggcgattaccttgacaacccgcacttgtgattgtattccgttatccatttttcgaggacttgtgtgcatatggagacctgatagagaaacagatcgtatgcatgctgtgtttctgttccaagtgatctaacctgtgtgagaggcagaaatctcatcactgaaatagaatgtaccttgacattgaagcgtcagttaaggtttttgttatttatgttgacatgtttgtgtactcttcctgctgttaccatacagttttactaaacatgagttgtactaaccatggaggttgatatggaaataattactacctccatcctaacatagaagtaccgacaggatctttgttcagatcactagtaataggagatggtccattccatccatccggttttaggtttttatattttgaaatggacgtagtattatacttagcatgtcatggattgaattattgaagtaagcccccaccttcctggtcggcgtagtcccttgaggccatctctaagtttgtaatgaaaaacaactatagttcacctagagcgtgaatactctattttgattttatgaaccacacctcaaaagaaaatcttagttttgaaagcactaaagcaactagaagttcattttccggcatttattttttttgtttaaaaaaatactccatgtaagaaacaaatcttcagctttaaaaccaaacattattcaactactataaaagctatcaaatttaaccttcaacatggtttcttctcatgttgaagaaatgtttttgagttattttaaaacacagatagatcatatgatccaattaaccctattctgtgaaagggcatctagcctaatggttacaagagtctcagtagcacctgagtaggggtggaactgagctggaaacaagataaaacttgagctcggctcggctcatttcctggctgcaagccttcttattgaaacacctcttcatatatattttataattattagaaaaagtaaaaacaaatcatcaacatataaaatttaaataagtttgtttattcaattcttcaaaatcttaatgataaatttcaagttgacaaataataacgccatataaagtaaaataatcgatataaacacacgatggcctaggctcacgagccaaaacaagcggctcgcgagctagctcggctcggctcattttcagcaacgagctgaaaaggaggcttgggcttggcttgtttggcttacgagccgagtcaagccaaccaagctcgagccaagcctaagctgagctcacgagcctaagcttttttttccacctctacacctaaggtcctgagttcgacaccccatgggaacgaattttctaggatttagcggcgctgtactttcagtggtaggcgacgtacccgtcgacagcgaggtgctgacttcatcaatctctccaggatttgccggcctagtcttcgaagatgctcataggggtagggtttgcgtgcgtgtgttcatagggtgagtgcgcgtgcgttgagagtttctgcgttgtactgtgtaattcaaaaaaaaaaaaaccctattctagctacaaagaaataagcatcgaaacacaaaggttcatttgaaaatctctgaaatttcatcaaacacccctgtccaaaattcataaaaaaaatttgagctgtggcgccatctcccatcccacccagcttttgctgtaccaccatgccgcgaccggagctacactccaatctcccactcgatccccacaaaaacaatttgggtaaattcgacaacgccgctacactccaatcttccactcgcatctcatctcgcatcaaccatggccgccgccgtcgccgccgccgcctgccactccccggcgcgcctcgtggtcacctgctcgagctccgccacgcccgcgccgccgcggcgcccgctgcgggtggccgtggtgggcggcggccccgcgggcgcgtcggcggccgaggcgctggcgtcggcgggcgcgcaggcgttcctcctcgagcgcaacccgtcgggcgccaagccctgcggcggcgccatcccgctctgcatgctcgacgagttcgccatcccgcgtgacctcgtcgaccgccgcgtcacccgcatgcgcgtcctctcgccgtccaacctcgccgccgacttctcccgcgcgctgcccccgggcgcccacatccccatgctccgccgcgaggtgctcgactccttcctccgccgccgcgccgccgacgccggcgccaccctcgtcccgggcctcgtcacctcgctctccctccccgccgaccccgccaccgacccttacctcgtccactacatctcctccgactccggtggcccctcctcctcccggtgcgtcctcgaggtcgacgccgtcatcggcgcggacggcgccaacagccgtgtcgcccgcgaggtcggcgcgggggactactcgacggccatcgcgttccaggagcgcatccgcctccccgacgaggccatggcctactacgacgacctcgccgagatgtacgtcggcggcgacgtctccccggacttctacggctgggtcttccccaagtgcgaccacgtcgccgtcgggacgggcacggtggccgccaagccggagatcaagaggctccagtcgggcatccgcgcgcgcgcggcgggcaaggtcgccggcggccgcgtggtcagggtggaggcgcacccgatcccggagcacccgcgcccccgccgcgtggtggggcgcgtggcgctcgtcggcgacgcggcgggctacgtcacccggtgctccggcgagggcatctacttcgcggccaggtcggggcgcctctgcggccgcgccatggccgacgagtggcggctcaccggcgcggtgacggaggccgggatacgggcgggatacctccggcggtgggacgacgagttccgccccacgttccggttcctggacctgctgcagcgggtgttctacggcgggaacgccgggagggaggcgctggtggagatgtgcgccgacgagcacgtgcagcgccggacgttcgacagctacctgcacaagcggatggcgcccgccgagccgtggggggacctccgcctgctgtggcgcacggcggcggccatggtgcgctgcggcgtgctcggcagggaggtcgagcgcctccgccgtctcgagcagcaggccgccgaccaggtgctcctccgccattgaagatgtgtgtactgctctgctctctctctttctcatgttttgtagtagcaactctgcatttgcaaattgcaatagtatcttacataaagatgctgctgctagtaataagcatggtaatttttgggatgctttaacttctaagcaataatatgacatttttattcagtttagtggaaatcccagttgtcatgaattcgtgatgattgttatgtgtaccagtactcaacacatagggaatttagtgggcattagcaacgattaattgaggaaaagaactgcattactcgggtatatcgtatatgaatatatgatatagttcaagctgacaattagtctcttaataataccggaaggggttgtagagagtagctaggtaacataacaaaccagatctgaaaagcctaacgaagaaatacaatatattcaacgaacactccagtgaaataataatccaaatctcagtatcaaaatgaccatctcctccgttctccagaaaatgcaactgctatgtaatgtggtattctggtcatccaatcaggcctgcagtcaattgaaagatgagagcgtgacagatactgtaaaaagaacaaaaccaccaatcaaattttatcaatataacaaaactttggaaaaagagttggcatagctgtgttcgggaggaggggttggtcaccggcacgcaaaacaaagctcgtattgttgcatgattaatcaagtattaacttttttttttgaaaaatagattaatcatatagaaagtttttccataaatcacaccgtttagcagtttgaaaagcgtgcgcgcagaaaacgaaagaggtgggttgggaaaatggggggaagaacacagtaagcttcaaaccatgtaccaccatctttcaaacaccctcatggtacaattgcatgacagagtaatgtggtaatggcacataggaactaccttgtttgcaatgttgctcgagagccagtcaaggccctcatataaaccctctcctgttgtggcgcatgtactctggatatacctaaatgacagcaaaatccaacaggttatgatatgtaaaaatagcataatattttcaaggaaaaaaacgaaagttattgatccattgttaaggtgattctattcatcatgtaataatgagccacataattgtataggtgaacatcactaaaaagttttatagatctaggatggttcttggtgaaaatatgtaaatggcataagatacatacggagtaacacagttattcaccccctatgactatttagttgataaaaaagagttgaaccacaaagtggagtaaggtaaaccaaaaggctgattcattaaaatattaaaacataaagtttaaaattgaaagatagaaatcgacaaaccagaatacaagaccatcaaacttagaacaaaaataggaatggatgagatgagaagtagacagcctacaagtgacaacaaaagcaaccatatattaccagtggcgttggcgcagggaatggagaccaagcttatctgtgatctcagcagcattcattgcattaggaagatcttgcttgttagcaaaaaccagcaacaccgcatccctcaactcatcctgcaaatgccatatgactgaatgcttaaagcagtgattgaaaagaatttgtatatgtatgtaacatagtccaagtgtatctgaaagcaaaattcaggattctaattgcctaagaggatagattccttaaccatatggaactaatacctagcaacattttgcataggcatgtcttaacttttaagctctgaaaagcatatgctatgtgtgtaatagtgtgtattagcataccatggcatattttggacagcatatatttatttttaaaattctgggcaaacggtatagtaacaaaaaattatgaggatatgtcggaagtgtaggaacatgcccaatatctctattgatgagttaataagtattgcaagcttaggaaaaaaacttaaacctactaccacttatgaggttatctgaaaaaaaaagggtacttgtgtatgaatatgacgaactaacaataaaatatgtgacatcagaaaatgagtattttatgatggtatatccaatttactcattttactaaatgtcatggaatggtgccatactatgttgtcttgtgaggaaaaattggctgcacttaaactaaaatcagtatgcgttattctgacatttataaatcaagtcactgatgatgcatcctgctgcacaaactatttggaggtggttatatgcttaacaagaaataggatgaagttaacaaaaccaaaaggcatgttcagcatacatcttatatgacagaacaaagttatccatgtaacaggttaagccagaaacatgaacatgatccttaaacaaagtttacctcattaagcatcctgtggagttcatcccttgcctcaaccacacgatctctgtcgttgctatcaacaacaaagatgagaccttgagtgttctggaaatagtgcctccacaaaggtctgatctgtagtttagaaaacataatgttatgagaaaaaaagtttctaaaaccctagagctgtggccatatattagtatgaagttcatatattccctactgtctgatgtgtttaaaatagtccaatacagcacaatggaaaatctactgctgattgcagaaataccttctgaagcgaaaagtgattttggttacaaaaagcaagaacgaattggtttttaccttgtcttgacccccgacatcccagacagtgaagctaatgttcttgtattcaacagtctccacattaaaccctagacatcaaagaaaaacagtaacttgatttgctctctttacaagcattatttcaaaaatgaaaaactatctctcatctgtctaacagtaatattttgcacttgcacatagagccatacaagcgtgcaaccatgtttgttcatatttccaacattatcaggttgcaatatgaaaatggatacaaaataatgcaagtgagccactaaatacaattgtaaactaagacatccaccaagccaccaatggaaggaatccagccctttttcatacaagggaccttacttctatgtgatctgtttttctttttgactacactatagtttgaacccaacttaccgacaacaaagtaggagtatttgaatgtacttaacagacacatccagtcaaaacatataaaatatcaaataggtttttacctattgttggaatggtggtgacaatctctccaagcttgagcttgtagagaattgtggttttaccagctgcgtcgagaccgaccatgaggatcctcatctccttcttggagaagaggcggctgaaaagcttcgtgaaagtgaggcccatcttgccgcagttgtgcaagaccttaaacaatcaagaatcaatatgagatatgatacaaaagcacatgcagcaaagttcttaaatctcagctcagataatgtaagaccaaaaccaaaatgggctccatagttcagttagttaaatcacaattcattcaaacgaaccagatcttttgcaaacgagaaaagtatataaggatatcgacattaagaagtactcccgtcatgccgttgtcttttaacatgacgtttgacatcttactaaaaaaattatataaataccataattttgttgtaacttgttttatcataaaaaaactataatattaacttagtacttttacatatttatactaaatttttaaataagacgttatgcgaaaagtcaagagcgtgcgttatacataaaaacctgaggtattatttgaaacggcaccgtgatccctcaggcaatgcaaagaaaacagcatctacagactatgatttcacatcccacgagtaaacaaaattcacagaccagtctgctgtgcgaaggatctatgcaatgcaacgcaacgcaacacgatgccactggaattaaaatgaacaatatacaagtctaacacgtgaaaaggggtcggcaatggaaacggataggcgatcacctcagccaaagcaaacaacggatcgccgaccagaagctcatctacggactaacaattccgcaccccacgcacgaacgaattccgcggacttgtagaggcctcccaaggatctacgcaacggaacacaacacacagcaccacgccattttctcgaggaaaaaaaattctggatcgaaccgaacgagatctacacacgcgcgacgccattggaagtttacgcaccacacgctacgaactcactcggctacacagatctacgcctccactccacggatctgggcctgggcagcagcagcagcatcgccgattcgccgccagcgccagcgccaccgcatccctccccagcaatgccccgagggcgaggcggagatcggagaggagaggagagagggaaaggagttgggcgtaccaaccttgctggagatcgatctcgtgcgcgcgcgtggcctctctcatctcctccccacctcgtcgagccgaagaaaaaggagacgacgcctcgacgcgcggtggttgcagcggagggaggcttcgagccgccgcggtgggtggacgcggtctacgtgagccgggtgtggtggactggtggtggtggtggtctaggtagagtgcggtgcacgtgagacgggtgcaggagagagcggtgcttctcatttgaagcttcaacgtgcaaccgacgctttctctaagtttcattttttaaaccattttaaaattgagggagcttctaacttctcccagctgtcccaaatagtctagattttcatttagatttcaagaatttgtaattgtagaatccagaaaatgaactaaaattctcataagttgactaccaaccagttgtttcttagaatttttaacttttcaatcaggaccaaaaccaaaaagtctacaatgtcctcactttatcaaattctaatataattattcatctgcaattatttctcattttttatttccaatacaattattctttatgttcacaaactccgatgcaatgattattttaaaaataaacttattatggaacggagagagcatataagcatgtgtacatgtataaagtcgtataaaattcaaatgtttaaagtcagggtggaacccttggccatgataccaataggaaaattcgattgggctgtgtacccaaaacgttggggcagagctgcaaatttattgtgaagatgctgttgttccgctagtttgcagtcacaattcattcagacgacccagatcttttgctcgagtatacaagatgtacacatataaagtcgtgcagaattcaaatgtttaaggtcagggtacttgggatgtaaagtgttctctagcacaaaatatatttggcatgtgcgcgttggaaatacaaaatattcactctgctcataagataaaattaaatcaatcaatacctaaacacatgagaaaatagttcaattctccaacatcacttccccacaccttgaaaactaggaaaataaatacatacgatctcctaaatatcaaaaagaaaaatagatacattctcctctccctaaactgtagttcactcttttcatttcatctcctatatttctacaacatactattataaaatataaaggcgacgaagagacgaactgaagaacatgaatcaagtcttcggactgggattcacagcatcagaatcagcgaccaggccaatctgcatagggaagatgccatttcagtcaccagggtgctccacagcacctcatatatctgtctgtatggtataatcctgatctttttgaagaacttatgatatcaccaaatacttgcaatccaataaataagatcttgtagggttaatgctcctgctgacgctatctaaagccatattgccactaaagaaatgaatttactgtcttgtttgcttctaacgccgcctcaatatccggcaaagcaacagaatagatgtgctactattcaaaccctagaattggccccaagaaatgggaaaaccaaacaaaatgcagcatgcaaagaggtcaacttttccttagctcattttctcttgattttcttgcattagtttctccagttccttctgcccagtagatatcagtgtcttcacagtatcgaacgcagtcagtttaatactgcatggattgaggaatactgtgagcaatgagaagttacgtgccagtaaacatactattacctatcagtgttgccataaatttaaatatatagttgaccaccactgtgaaaagaaaaggcacctgctatttggtagattttttaatgcatttggaacaaaacctctgtatagtccaattagaccatcacgttccacaatgcctgcattcagcagagacaaatttaagaaatgcttcagtttagcccataaaggacaagaccaagctacaagtgagcatgtagaactggcatctgagagctgaagtgaacgttatgcagtaagtaaaagatgatgtttatccaacaccagaaggactatatataaatcagctacctggaatagcatccaaaaccgtgttgtagggtgatcctttcatttgcatctgccttctaacagtgtccagaggataacacatcaaagttgcaaatgttgctgaaagaagagcagttgccagagatgtctctggtctactcttatacttctctggtacagatttcttcattcttacatacagaaaagaatagagggtgaggtgaatatctacttttgagaccaacttttttatatgatgaggtagaaagaatctcacaagtcaaaaacacagaagttcacagcaatgtaaggggcgattcctataagagacggacccaggcctccatagaaggaggccaaaccttcgtctctcagcatgttcatagcaacctaaaagttaagtcatcaggttacattaatttccagaaacgaaactcaagcttataaactagttacctgagacatagtactatgtccagattgaactgctagcctcagccgaagaacatccagtgggtaagttacctatcagcaagtagccaagtatatatagaagtttcataatgatcagaacacaaacaaacaaatcaaactagatataaggacaattgctcaggagtaaataaataaattacaagtgtagatgtcatgcccgcacaagcaccagcagcaagtctcccaaacacagtaagctctccgtcctttctccggaaaaatttctgaatgcaaagcaggtacatggaaattgaaatgacaggaatccaaaataggtaattgactgatgataaagagttggcgttatcaccttgtaaacttcataagaaaacagttgcaccgcactgtaaggaactatgcggataaccttaagtagtttataaagaaactaagtgagaacaggaccaacagaataaaataaaccatgcatgagccacaatctgcatgatggggaatatcaagcacctgtggaagattgcctttccagtaacccttcaagccctcttccttccctatctctgcaatagcctgcataattgtagatgtatcagattagttatgtagtaccagatatacaactctaagtaaaatctatgaaaaagatagctatgcttctcctccttgtttgaaagtggaaagtgcaagttcatatatccaagagaaattagaaacaattatgttaagaagtcagaccgcacatagaaacaacatgttaaagcatatgcgaactggcagtactttgtgtctaactcatcaacacatgaagcaccagcatggcagcatctgatatcatattaaaaacatctaaacgaacaaacatcatgaagccataagtaaaacttaatggcatgccactgcctatttctgaaaaccattgttaccctcatttctgaaccatacaagaagcatcatgaattcaggacacagtgagtatgttacagtgtattataagtatattggaacaaattatggctttccctcagatagcaaccacgaattggtagtggtgaaacacatcagtttcatgactcacaggttcttttttaaagaaaaatgctccatgcctcacgaaagcctttttcatgatatgtttcccagaatagttttcaaatttctaaaacgtaattttgagattgtgtgttaatttttagtaaaccacgagtttcattgttccatatcagttcacatacaaccgcaagaccagaatactgcatatttgtagtggagagaagagtaccccattgttatgttcaacaccacacacacagacagaactcggttcgttctaacttatccctgatgtattcggaagctgcacttatgaattcagggaatttatcatgcaattgcaaatgacaggtactaaaatagacagggttgggatcaactccatggctagatggaaggcattttatagcaacaacagattgacattgttgtcatgaaaatcgcagacgatagtattaacattactaaaatagacagtgttgcatcagctccatggctacagaaaagccattctatagcaacaacagaattacacactcttaccaacttagaaatttatagcaaactgaagagaagaggtggaggacatcatcagagttacctcgaggaatccgatccctttcttggtgctctcccccaccacccgcacgctgtgcgtctacaaagaagaagagcaggaaatgcagtgggttacagaccacgcacccacaggccaccccacagcaaggagagggagagaaatcagaaacccccgggacgggaggggcggggtcatggtgtgccctacctgcatgaggagcttgacgcggtcgagcggcgcggtgatcgtcttggcgacggcccccgcggccgcccccgccgcgaagagcgcgacggcgttgggcaccagcgccagcatcgccagcgggtgcctcaccagcacccccgccgccggcagctgctgctgcttccccttcccntcccccacctccccctcctcccctccccctcccccctcccgcacggtgagcgacgcgaacgccgggccacccccacccccacccacgcggagggcgagcgcgcggcgggcgtggggaggcggcggcgtgggtgggggcctccatgagtcgcacgccgccgcatccactcgccggtggctcatcgtcgtcggtgggcaggcggtggccggatctgcttggccgcgagaggcgaggcgaggcgaggcggaatggaagagagaattaatgcggaggaagaagaagaagcgaagaaggaagaggggataagggggggaggaggattgatttcctccccgttttatgtcgaagctcgagagagcggtgaggaggggggttggttgtttaaaccctcgcgcacgccggacacgcgggcaatgcactcctctctcttttttttctttctttttcgttttcttttcttgagaggattaatggtgtatgagtgtggcacaatgaaagggacgtgtttcggttcttgccacaatgtcagcaagtaaatgcggttttggttgcccgtctgttcggcatttgtgccgtacatggacatgggaaccgaatcgtggaagaagggacagctaattgggtccgttttttttttttttgacaaattgacccttttggaaaacttatttcgaaactaacccctgccaaaaacttcaacaaaaaataggccgtcgcctcagcgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagcctgctggatggcttgcgggctgggacctcagcgccagcccacctggcgctgaggtgggacttggccgcaacccccaaggcccagaccagcaagcctgctggatggcttgcgggctgggacctcagcgccagccataatggcgctgactattggaaactcagcgccagcccacctggcgctgaggtgggacttggccgtttcggccgtggcccagcccagcaagccttctggatggctgggctgggacctcagcgccaggtgagccctgctaaactttagcaaaactttgcacacaacagaggcaaacatcaaatcatagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatctggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtaccccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgaccaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatgaaaaaatcacaatgagaacggaaaggaggacaacagaaagtaaacattgatgcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgctaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgcccaattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaattttaaacccatgcataaacattaattacttgaaaataatatgtaattaccattgcaataccaatacttcaaaagctaacaacatgtctaatttttccaataaataagtacattactcaaatactacacattattgataaaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacagaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcgaattaagtttttgaaaagggtcaatttgtcaaaaaaacggtaattgggtggtaactagaaccaatacgtacttcatatgtacttaaataatacttttaaatattagaatctacgatactatttaacccatcctataaacaaaacctccatacaaatttataggatggtttaaatcttgtagtaggttgcaacattttgagacatggatagtatagtaatatagtagctggattagacctaacctattactaatcttatctagatcttgttatacccctctaaattgatttgaagtactaaattgtgtctaatctggtttttcggtactaaattgctatattttagaatgagattcattcaaattctaagtaaatacaatccaaaaaataaactaaaaaccagaacagattctcaaaaattaactaactaccaaccaaatgtttatcagaatttagctccctaataaagaagaccaaagagttgttgggtggatggttggattgagcgtggtgcatagctgcatatcaaaggctgacatcatttgcagcaaacgcataccacaataatactatgcatgtacgtgaagtgtttttttcgtgaggattattaaaagtttaagttttttttcctgaatgaacgaggtttattaaaagttgagttcaattatactagcacgcatgtagttagtctatattgagtaccactagagcaatgatccagctagccaagctaaaacgacatctagatcaccccaagtaaagcatataggtttagaaaccattcggatacacagcaaaacaaaaagaaaactcatgtcccagctattctttagaaagtccatgggataaattggagcaagtctatttgcttttcccttttgctcttggaaatttgcagatcaacggtaagattacatatagggcataaattagttgactttctttgccaccttttgatgtttgttattcacaactgagcactattaaatatgatatgtccacggtgtgttttgtttatttcttctcatttcaggttttctacaatactgctcagtactatttaggattctcgtgtcatattgattggccttcttctaattattttagcatttcaatacataaacagttgacaggtatgtataccgaattagaagtatttatctatgtcaaggttcttttagtaattgtatgatgtccataatgtttctttcaaaatataggatcatgtcctgtccccccaacacacacacaaagagataaaaatagaatgtggttattcttaggtacccctctgttccaaaaaaaagtctaatccttgctaatccttggacacatgtgtgtcagattcgtagctagagtttgcctttttatgggacaaagtagtaggaactacacttttttgttgttttgcaagtttgaaatttgacatttcattttacatttattattttcatgtagagggattgaactttatttttccaagtctttgaaatcacttcttacagaattaagcatttcatgttcatacattctttcgctctattagctcaaaagatattttgttgcgatggttcctacaaaatgttaagagttattgcacctgcttcaccttttgtaatatcacatatattgtttatatatgcgtgccaggcaaattatatgtgtcaaccgctatttatgtgatatatgctcctttttttcgttatatactattgattagggattcttatgtatgttttatatagcaggttgttaacgccaaaatttggtaagattttgtagtggattcggttaaggaaaaaacacaatcagccgatggaaagcttatccagaagagtccaagttcaaggagtcatgaataccatggcgtggcagattaatttctatctattaattaggtagagtttagttattttcccttatctttaggaagttttgtctagtgtccgattaggacttgtatctttccttgtctttaggaaacatggtgtcgcgtccgatatgaactactatctaaccatgggtgtttctttgtaaaatgtaatctatctcttgatcaatacaacttcagcgcatatcattggacatctacttcaacatattatcatcggtcgattggattgattgtctttatatcatatttatctaagcgttaaaatttagatcgggcatataacctattgtttaagaccatatcgacatcggctagtactgatacattggcttaatggttgatcggttctttgaacatcaatttatctatcttgtcaattacaggatcaaactgactggcacacccaaacctgatattttaggacttgcactggagctaagcaaatctcccatgacttcaagtgtcacgaagaaatttcacgtcaacacatgcccatatatagatggatgtttgttcctcctttttgttgcaagttttctgtgcattatattcttattagacactctccaggcccattcatgaatgatcctatgtacatgtaagcttctctattgcctttatgtgtacatgaagattatttcgtataagccttttcaagtcttacttcgatacctcagttatcttgtatagttaggtataattatgatcaataattatttaaaaagtctatgaatgatatcgtccattcaaatatatgatccaaatgactacaattattctaaaccacaatagaaataatgatgtcggtatatatatatatctctactacctaaaaaaatcaaaacgtttccttcgtccatcaaaacaaaaaaaaggaagaaaataactaaaaaaaagtctgactcccctgcgttcgtttgccagggctggccctccggtatggaaaacggagcgatccattagcgcgtgtttaattaagtgtttgctaatgtctttttcaaaaatggatcaatatgatttttaagcaattttcgtatataaactttttgtaaaaagaaaagaaccgtttagcattttaaaaaacgtgcgcccagaaaacgaggaagaggggttgggaacaagcgggaacgaacgcagcctaaatagatcagattcccccttaaaaagagggaaaatatgagaaaaaatagcgaacaaaacaacaacaaaaaaaatatgtttcctttaagtggccaaacaaaaccgtagatccaaacgggaaaaaaaaatacgattcctataaaaggcaaaaacaaaaaaaaagtggtgaaaaaaacgctagatccgattcctataaaggtgaaaaaaaaatccaaaacatctttaaaaaaaagttcgtccgattccctaagaaagtggcgaaaaaaactgtttgtaaaaaataaaaatgggttcgtataaaataaaaaatacacacgagaaaaaaaaagggcctaaaaaagtttgatttctattcgttttagtagtcagtatatatatcttctttatctctaatctaatctaactatttaaaaagagaagttttcatcgtacaactgaaaagaaaaaatgcacaataaaataaaaacagttcaaaaaatacgggagaaaaaagtcataaaaaagcgcaaaaacacgctaaaaaggttttccatcttccaaaagaaataaaaaaccgagcaagaaaaaaatatttccatcgtcggtaaaaaaataaaaaacatgcgaggaaaaaactgtcagaaaaaacgcgccatttcaaaacaatggtttgaaaaaaccgcgcaagaaaaaaacaccgtctattaaaaaacaagccgctctgaaaaaattatcagaaaaagcagtaaattgatgcacgcttgagtcggaaaggatccatcgattttttgccatctaatacacggcttttgtttcgtcatctattctcatgtattggaataaaggaaaaagaacattcgaaaaaaaagagcaaacgtgcgagaaaataattgtcagaaaaaagggcaaaataacacgcgagaaaagaaaagcaaaaaaacatgagagaaaaatacggttttcgtcatcagtaaaaaaaaagcaaaaaaaaaacatgctaggaaaaaactgtcacaaaactgcacaagaaaaaaacaccgtttataaaaaaacgagtagaaaaaacaatcgggttcaacacgagaaagaaccgatgtttctaaaaacggttcgagaactctaacgtaacgcgagaaaaaaaaagcatcatttctaaaaaaaggttagagtaaaccatccgaatcaacacgagacatacaaaattgttgtttatgataagaaccgctctggaaaaccatcggactcaacgggagataaaattgatggacgcttgggttggataggatccatcaatttttttctatctcctacacggtttttgtttcctcatctttctcatgtattagagaccctgcacgtctctgcacgtatctgtatgtagatatcaatatttgaataaagtggaggaggaacctatagaaataaacatcaatatttgaataaattgatcaaatatttaaaatattaggatgagataactaatttaccatttattttagttaattacaacactttgagttcacagatatcacttgaaagtaaatagataacaggatgacaaaaacgaataatccaaaataagaattaacagatatcacacctaaaaataaacttacacaaataaatataaaaaatgcattatcatttctagtgtaaggatatcaaacttaatatgaaatgcaatccccagcacaagacgtagatgtgtacatagtccatagtcctaacacaatcagatgtagagtacatataccatcctaatcctcaacacgagaaatacgtgtacatatagtactatgtatagttttaaaaaacctcctacttctcggcacgaggaaatcagggcatgagaaaatcgggatcgatccataacatgtctagtgacttgacaacgctagaactccaacaaacactgctagcacagatccaactaggaaccgtgtgcactcaaccacgcttatgcaaagatcatgctgtctagcaagcagggcagtgcttaaggctgcaattccccccacctcacatgcaacacatgagcacatgcattaacatagatataacttaatcaaattagggagcgtttgttgagggggaaatgagttgtaagacctcatttgcatggccagcattgagtcccatataaacaaagcattaattaactctatccatttccaaaatatagtcagttttataaataattttcatgaaactgttccaaagccaagtaccatcatccactgttgtttaaaaatgtatttgctagtactacatgatgaggaaagtagtaaaatgctagtagtgctttactacttcatttattgccaggcttatttttggtccattattgattggggagagatataaggaaaagatattaaaagaatttcattttattctcaatttttgctacacaaactagtaatagttgtaccttgaaactgagagtataatttattgtttattgtcatgctctatgcatattaatcaggagagtataaagggactatatggcacagctccagcttcacccctcctagagctagagctcagccaaatgtttcagctccacaaaaaataggagtggagctgggtggagctctctcacaaaatggtctagagttgtagagctgggtttaagagctggtgtgctaattcaaggagcaactcaggaactccaaagcacctcaaaccacatatccaccgagcaactccagcatctccaaaacaccgcaaaccatatatccaccaagacatacctacgcatgattctttgtagacgagcacagcgcgaccaactgctacgagtagcgcctcttctatcctgccctctccgcaccgtcgttgcaacgatgtaatggagcgaagcccacaaggaggcaatgggggcacatgcccccttacgctcatagaacaaagcgtaccttatagtaataatagttgatctccatggttgtgggttgctcatcatcaccaatggagcttaaactaaagtggagggagaacctatagaaataaacatcaatatttgaataaattgatcaaacatttaaaatattaggatgagataaccaatttaacatttattttggttaattaaaacactttgagttaacagatatcacttgaaagaaaatagataacaggatgacaaaaacgaatcgtctaaaataagaattgatagatatcacacctgaaaatcaacttacacaaataaatataaagaatacattatcatttgcagtgtaaggatatcaaacttactatgaaatgcaatcctcagcatgagacgtagatgtgtacatagtcgtaatacaatcctcggcacaaggagattatttgagccagtgaacatatcatgttgatcatgaccatcgtgataagtagggtagtggatatgtgtctcacgccacaaaagaattggtgtgctaattggagaagcaactccaggaactccaaagcacctcaaaccacatatccaccgagacatctctgtaagacaaatccagcaacccgaaagcaccgcaaaccatatatccacaaagacaaatctccataaggtcggtaagcatatccatcaagacatgcatacgcacgattctttgtagatgagcacaacgcgaccaaccgcgactattagcacctcttttatcttgccctctccgcaccgtcgttgcaacgatgcaacggagcggagcacagatgggggcacatgcccccttacgctcatagaacaaagtgtaccttatagtaataatagttgatctccatggttgtgggttgttcatcatcaccaattgagtttaagctaaaatggagggagaacctatagaaataaacatcaatatttgaataaattgatcacacctgaaaataaacttacacaaataaatataaaaaatgcattatcatttgcagtgtaagatatcaaacttagtatgaaatgcaatcctcagcacgagacatagatgtatatatagtcctaacacaatcagatgtagacatgtgtacaatcagatgcacataacagtacgagacatgtgtacatataccatcctaatcctcaacacgagaactatgtgtgtacatatagtactatgtatagttttatagatcctcctacttctcggcacgaggaaatcaggatccgagggtccataatatgtagtttcttgacaacactaagaactccaacaaacaccgctagcatagatctaacatgatataaaaggcatcaagtggaaatcctctatgttcaaatttgaaatcaactagttattgagaggatttacagcatgtagttgaataaatttggaattcttgtaatgaaaagaggtctatattgataaatgcgatggagaatgcaaatgatgagaaaagggctaaacagatggaacatgaactgggatagtgaatacaaatgggaaaaacataggtggcaaattattcatatcaagtttcgatagagatgagccaagagaagtttggagtggagggaatgaagtttttgtgtgctcctctttttggcctgatgccgatggatgcaggttttatgccctagcttattttgtagttttttttagtcgatctggtcgcacctgaaccaatgagaattaggccaaaaccttttaatttttttctcctgaacttaatttttttattttttttctcctgaacttaatacttccctaaaaatacttccactgaactaaagtatataaggagaaatggtgatcaagctaataaatgaaacatggtgtaataaaaaaaacataaacaaacatgtgagattgtgataaaagcaactgtgactatatagcagctcatccctcatgcggagagagagataagggggagaggggtgtttataacaaggataagcatgcattcatgataatcttaacaacactaaacagccttgactaacctggccaacagttcttgtgtgcacaatccagaggaaggcactaaatcactacatgtcaatcgatagaagagacaaatacttgggatgagcccctgcaatatgtccacaggcaaaaaagttgacagacttgcttaggagcacaccaaaagccagaccaagtaaatacaagcaccaaacatctattttgttttgtattttttatacaacctcccaatgggaataaactaagcatattcttattgatttagttgattgacatggatgagttattgaaatatttgttaaatctatattactttcaactgaaagtataataacaaaaacaaggaaggaggtttccgcatgtaaaagtactaaaaagataattcaaaacgtgttcagactttagtagtacctcaagatacatttcatcgagcagtccttgagcaccaaaaacctctaatgcgttcctcctcttccttgttctctttgtatcctcctattctctggccatagcagcagtgcacagcagcacatacatcatgaggtcaacgtagagcagaagcaaatcgacaacaaatcagaaagagcaatgcggtggcagtaacataatagcagcagcagcagcaacaacatcaacagttgtagctgtagctgtagcctgtagcggggcagcaaatcgtccctaccaagcaaagcaagagcattgaactcattttttttagcagacggtaggagcaaccgcataggagttggcaagggatgtgaagacctgaaaaaatttgaaagccttggcaaatcagttacagcaactgtcaggcgactcaagctcgtgctgccagccgttgtcgctaccatctctccccctttgtccgcaggaaaccaccgctattgtcgctaccatctttcccctttgtccacaggaaaccgccaatatccccatccattgcatctgtagtgatagatggatggggatgaacggaagacgatggataattttataagatttcatctcttcctcctcttatggtgacgacgttgcgatctactatctaatcccgctttgcttgccctagggtcgcgctcagccctcaactcatgctcactgccttccttatggcgaagatgcagagttgaggatgacgacaaatcgacagcaccgacagcggtgggcaggcggcgatgtcgagcggagttaatgtgtagcagccacagcgcactgtgttgaggggagatggcgacacgagacgaggcgatggtggtgggctaaggcgcacggtggtgggcctattggcgagccggcgatgacattggctgggggatggcagtggcgacgagccacctgggaaggaagaggggtggttcaaggcggcgacgaagtggaggcgtggggtgctcgaagcagggaggttgtccattggtttcactaatcctgctactaatccatcggctaatccaactcacaacgtaggtcgttagatgagaggatccaacggttaggaatgatctgggtatattttgttaattcattttgactttttccgtagtcaaacttaaccaagtttattaataacatatttgttttgtatttaaaatgctatgctaacttgattaaacttaaagtttgattagtcaaaacaacttataatatgaaacagagagagtagatgcctactaattgacttactatactagtaatatgaacgtgctaatgctatggcgatatttcataaaacaatggtgatagacagataaatagaatcatgttgagaatcaaacaactaattatacttgttgctcacagtatactgatttaatacaagacttcctaattcataaaacccattgcatgatcagtttcacttgagctatcaaagcgtaaggattctttgaaaaacaaaaccacagacaacagtgggagaccatagtttacagggtcaacaatcatgttttctccttttctagcctccaaaaataggaacattgattcaatagttttttaaactcccaagttactctaggaaggttgactatgaagatcgtctgagttctaaaccagagatctaccgctctttacaaactgaccaaaatcaaatctatggagctttcccccgaatttagaatggatatgttttacacactttttcaagaacacacgaatgtattgcatgtccttcatacaaaggaagatagggttagacatatcgttactatggggtagtttggatacagggttagtctctgtcacatcggatgtttggacactaatttgaagtattaaacataggctagttacaaaactaattacacggatggaggctaatttgcgagacgaatatattaagactaattagtccatgatttaacaatgtagtgctacagtaattaatcatgaattaattaggcttaatagattcatctcgtaaattagcctctatctgtgtaattagttttgtaattagtctatgtttaatactccaaattagtcagagcgttcgttcgttgggtgattggagagaaagcacatcgttttccgcgtgcacgattcccaaactactaaacggtgcgttttttgcaaaaaaaaaaaaattctataggaaagttgctttaaaaatcatattaatccattcttgaaatttaaaatagttgaaactcaattaatcatgtggtaatggcttacctcgttttgcgtgccttctcaatcttctcttttcctctcctcaaaagtaaaagagagctgaaactcactgattctaaagtttggatcactgaaggctgcaatatggactgatcacttcagaaaagagtcgacacttcaaatttatctacattgatcacacaacctaatagattcactggacaccaatctaatgacatatattttgacaaaatatgtagcagagaaagtactaattattcataaatcacatcatgagctacaaaaacaccatgaactttgcttaccacgtagagcaacaatcgacagaaagctaggcttgcactgttgtttccagcttcctatagattttcctgcaaaacctacaaaactataaaactggtgaattttcaacaccaaacatggccaatgatatgtaatcatgaaaaatcggtataaatctaacggccttatcttgttgcttatgcttatgcttattagccaaaatttgatttttcaaccttaaatttggagttgattttgtggtttttttcatcgtagtttattttttagcctttgcttttagatcgttaggaacatgtatataaaagttttattcacaaattatttctcgtttgcaaataagaataagccaaacaatgggatgtaaaaggctaacctcaataaatggaaatcttcattgatcatgatgaataaaaaacatgaccagagctacagtactatacattaattaaaaacaatattttttgataaaaaaacagttttaattactgcatccaactaacattaataggtaactcggtaaaaaaataggaacattgattcaatagaataagatgctaatagctctcccatccctactgtcccaagttactttaggatggttgactttgaagatcgtctgatttctaaccagcatcttttaaggtgttggagaggttgttgtaaaaccacagacattaaaaattacatgatttagtataagatattcaattgttaagcatccctgtcacgaaccagggggctgctgcaacaccagagtcagcttctgctcctaatctcataccatttgtcgtgatctatgaagtaaaaattgtcattcagataattaatacgaagagaggaaaccttataattccttctagtggcaggccacacagttctaatagccttcacctccacttttgcagcaatgtggaagtaattttacaaaattttaactaggttagtagagtgcagatgttcagtgcaaaattactcgtctattttaatgcgcaccagttgtcttcccataaaacaaaaaaagtagttgagccttacaaaataaaaacttagatgcagggtgttgagcattatcggtgattaggaaatagttccagttctaaactagagtgtttacaaactgatcaaaatcaaatctatgnnnnnnnnnnnnnnnnnnnnnnnntggatatgttttacacactttttcaagaacacacgaatatactgcatgcccttcatacaaagaaggaagatagggttagacatcgtattactatatctgaataataagaggatgatatagttaaagcccttcatcatgctcagaagtaaaagagagctgaaactcactgattcagaagtttggatcactgaaggctgcaacatggactgttcacttcagaaaagagtcgatacttcaaatttatctacagtgatcacacaacctaatagattcactggacaccgatctaatgacatatattttgacaaaatatgtagcagagaaagtactaatcattcataaatcaaatcatgagctgcaaaaacaccatgaacgttgcttaccacgtagagcaacaatcgacagaaagccaggcttgcactgttgtttccagcttcctatagactttcatgcaaaactataaaactggtgaattttcaacaccaaacatggccaatgatatgtaatcgtgaaaaatcggtataaatctaacggcctcatcttttcgcttatgcttatgcttattagccagaatttaaattttcaaccttaaatttggagtcgattttgagttttttttcatcgtagtttatttttcagcctttgcttttagatcattaagaacatgtatataaaagttttattcacaaattatttttcgtttgcaagtaagatgtttggcttattcctcaaataagctaaacaatggggctgtaaaaggccaacctcaataattggatatcttcattgatcatgatgaataaaaaacatgaccagacctcaattaatcatgtggtaatggctcacctcgttttgcgtatcttctcaatcttctcttttcctctcctctcaaacactccctaagaggataatatagttaaaacccttcatcatgctcaaaagtaaaagagagctgaaactcactgattcagaagtttggatcactgaaggctgcaacatggactgttcacttcagaaaagagtcgacacttcaaatttatctacactgatcacacaacctaatagattcactggataccaatctaatgacatatattttgacaaaatatgtagcagagaaagtactaatcattcataaattacatcatgagctacaaaaacaccatgaacgttgcttactacgtacagcaacaatcgacagaaagccgggcttgcactgttgtttccagcttcctacagattttcctgcaaaactataaaactggtgaattttcaacaccaaacatggccaatgatatgtaatcatgaaaaatcggtataaatctaaaaggctaacatcaataaatgaaaatcttcattgatcatgatggataaaaaacatgatcagagctactactatacataaattaaaaacaatactttttgataaaaaaaaaaacagtactaattggtgcatccaactaacattaataggtaactcagtacaattagcccagcagccatttttcctagccacaactttcaccacaatgcattttctacaattggcctcatttctgttttgaaagcaataatgagaacataaaacattgggagctcaatttaattttagagtaaatttcacaaaactacatattttatggttcaagttgcagaaaaccacacatattttgatacttggcacttaagtacatatattttggtagtttagtttcacaaaaccacactatcgatgaatggattcacttgtgatatgacgacgtggttgtttcatctagtatgaggacgtggcatcatattaatttcgtgcgatggctgtaataggatgccatgtcctcgtcctaggtgaaatagccacatcatctcgcgggtgaatctgtacatcgatagtgtagttttgtgaaactacacgaccaaaatatatgtactcaagtgccaagtgtcaaagtgcgtgtggttttctacaacttggaccacaaaatatgtagttttgtgaaatttactcttaattttatgtctggaacaaattacgacctggaaaaatcagaaatgcatttgccgaggaaaaaaaaccagtgaagctgcagccaggtatttgccatgccgctgccatagcctagcatatatggccaacataaactgtaaacataacctagcactctataagtatatggccaacacaaattgtaaatattaattaattcaacaagtatatgacagtcaatacttccgttgtagcctaaaaacaaacatataagaaaagaatgcatcgacaattatattctctagcgtgttcagactttcgatatacatattgacaaggcctcacataaatttgaaagtgagtattaaactaagttcataagtgatcttaaaacaagtaaaaaaataccatttggagtgcatcttttggaacccctgattgcctagctttgtagcatgagtcttcaaaggagcaatcaacttcaaatgtctggtccaaaatttcccctccggtattcataatatatagaaattgtgttcatcaagggataaacctagtgaattactgttgaaacacaggaaacaaattatctccagagcataaggccaatctcacagatagaggtacaaaaccttgattgagtctaacattctacagtgcggactcaatatacacacatgacagtccatttctattttagagagaaatcaaacttcattgtaaattttcattgatgttaaaaatgaaaaataaacaccagtttacaataatgcacatagaatctatgttggcaagaaataaatcattgcaacggagaagaaaccaagtgtcattattatttccatacaaaaaaagagttagagaaacatcagaaattcattgagtaggaccacatcaatatctttacatttgatgaataatatctttacattgttaatgaaagtacatcaatatatattgtggtaaaagcagttctcaaatgatttgcaaaaaaaaagagagcatatagcaccctcaaactatcaccaacatggccttgcatgacacacttctgatgttcatggaagtataggcaaattatcatggggtgtacaatataccagcaccctgaagcaccatacatagcccttgcacactctggaaacaattgatcccaataaatcccaaaagtatatgggtgaagtgattccacactaattaacagagttgtattgtataaaaaccaaacaataatcaatattgatgcagaagtacttaatagcaccaattgtggtatacatggttttgagatctgcagttaaattacagcagttacaccaattgagtttcacaaataaaaacgacagacctagctacaatgtacatctagtgtaaactaaaatgcaatcttaaaataaaatcatgtttaccttcaagccagggcagatggattgaaattcaatctttaagattcataaaaatattgcccctcaaataattcctagggtgacaaatacattctgtatacagaactaaaaaactggagtcattgcctcacatcttttttgagaaggttgaaccaacttaggagcaatttaagtaaacaatattcattcaaactcattttcttttctgaatctatgaccaaaataaacacggtttgttgaagtttagtgatccagcaatgggaacaatatttatcatgtaaacgcgccttaatgaggacaaagtttgtgcctttcttatgagcttctcatatcaacctgccataccacaaaaaaaatgccatacaaatgacaaggccctgagcttatttattttccaagacataagaaacaaagagtgatggctgaaatgcatatataatttagtatgaaactaaagaatgtagaacccaaaatttcctagcactggtgaggggataaatgtacaggatacttcaaaatttatatcacgcatagaagaacacaatattgataaagatactgaaaaatggcaagaacaggagaggttttatgcgatctttaaatattgataaataatacatggttaattgaaagtactaagaataaattaactcaacattctgatagtcctgatcagatttgtagccttatttagcaaattttaacttctttgctatgagcaagcattgcctggtggttaaagtcacagattgcacacccgtataaaaataaactgcaaaggagcagcttaaatacctctgttcatttggtaagttcaccgtatgctatatgtagtaatctccaatatgggacctttcatgatatccaaacctgaacaattaaaaaacagaagcctcccaattagctcctagaaaccacagttcacaatagtacactgaaacaacacggaaaaagttgctctttttttcctaaagtaattatttagtaaaagcttgtaatgcttcttctttacacattccacaataattggattgtcacatgctatagctaacaaattcaggggagtgtacgtcttatgggacaaagggtctatgggagcactattcattacatggtacagtcgacatgtaatataacagctataatgataatgaccttatgatagtaatgaaaaacagatgtatacttcaatgaaaactcatgagcaagcaaaataatgaatagcactaagcatggtttctcaatttctcttctgtccataaaattcctcaatttctcttcctctcccacagtgaggatgataagcttcacagcagtcccagaaagtgaattttatggcagaaaaggaaaaatcataatttgccctgaaagcaaatgcaaaaaagagcctatgtgtatattatcatgggtaaacatatatgactattcagctgaacccgttgtgtgctggaactagttttgctgaaagatggtagtgttggttatgggacctggcattcttcactaaaattccatttaaggttttataacagagtaaaaaaaaactgatgttagacactatactgaaccgatcactgcatccggcaagctgtacacggagccaaccaaatgaaattattcgtgttggccatttcagttagcctttatgtacttgaataataacaagcaacaagagctaatgatctactgtcagatgggatccaaaccgctaggcaattcaaccagtcttatcagaaagcttgtctttatcatggattgactatacatgttagcaatttctgttgcatattctcaacttggacgtatgcatcacatatcaccaacttgaatgcctacaccacagatctatataaacaacgaaatgaggataaacaggtcttaccttcacaacaggggcatatgaagaggggaatgggatcagtgcggcgtcgtgcgatccggcgcaaagaggaccaccgtggagatcaacggagacaaacggatccagaagccagacaccttgtcgattgcagactgccattgcgcgtggagaaggggagtcggcgatgtaggccaccgcggagtgcagtggtgggcccaactttttgaacctgtgtattcgaaatgggaagggttaaaaaaattgttcatacacctaaaagcctaaaaattagcttgtatagttctgaaaattaaacaattatggtaatatggtatgaactaagcaagcaagtatactaaatcaatgaattgtagttcccaatcctaaaatcttcattacaagtatcaaattttgcgattttagtcatagagacaaaaaaaggaataatgagttttatatccttactgtcgatgctaagtatatttaaacatagagaccattataagtcagtcagatgatataatactagtactctagaataaaatgtcatgaaaacttgggccaagaacaattctgttatataatttctagatgaatgaataatatagtgtactgaaaactatgatgtaccaatcaatcaaaacataaatgattcaggcattggattactgaaggaattcctgaaagttgaaaactcttgagaaataatctggtgaagtggtgatgacatgttgatatatcccttctcttttgctgatcttttcagccttcgggaggaatatttacctgctgaggaggtgctgaggaggtggccgagatggcgtgccggcgccctgcgtggcactgcagcgccgcccgagccgctgtggcgctgccgccggtgcgcccctacctggctgcctcacgagtcgcgccgcgcggccgcgccgcagttgccactcgccggctcgccgcagccgcacggcacgaagcgccggccggtcgagcccgcgagccgccgcctccctgccgcagccgcaccggcacgccagagtactggaggtagttgtgaggtgggtggcggagggaggccggcgcgaagaaggggggagagtcggcgaccacgggatggaggtggttgtgaggtgagcgggggcggggagatcggtgaggcagagggacggcagcgcgagtgcgacgcggcggaggtagcacctggcggcgcttcgtggaaggagatcggcggcggcatgtgagaaggagagaggattagggcgtggaggagagagagagagacggcgagcgtgaggaaggcgtcacacgcagaagagtagccgttggattaagatgttaccgttaggtggccgagatgtaaattgtactccttctatccgttggcacgcttgtacttaagaagtatcgtatttgtttatttattcgcacaattatacaaagtacgtgagtatataataaaagttttttttcgcccattaaaaactaggtatctgttggttactccttcatatatttacaaaagaaaaatcagaaatcatctccttttccgtaggacgtttccggcctactccttcccttttgttcctcgtgcatagagatggcaacggagaattcaccgtctggggttacatccgcgtcaccgttcccatggtgatgaaatttcaccgtccctgtccccgccaactatgacggtgctacattttatccatccttgaccttgcacggtccgtcaccgcatgtgctcatcttgcttcgtcaccgtcggagctaatgggagaggtcaaagccatggccagtagccggcaagggagagaaacggtggggtggcggcggagatgggttgcaataggtccctagctacaggacacgcgggtcaccgcgggggacgaggacggggagtggagcactgtccccgcccccgcccctgccatccccgatggtgatgagttttgcaccactagatttcctgtggatggcagatatcatccatcctcatcccttaggccttgtttggttaatcccctttagagagggattggaggggatttatttcacacctattatggtgtggaattattccccctcaatcccctccaaaccgaataaggccttaatgtgtgatttcaccgtggggaatcgatgatcgtccccattgccatctctaatcgtgcggcccatccggcatgcctttgtttcaggctgtgccctgcctcgtgttgacaagtagggttgatgggaaggcggcggtgacggaggcagccctgcgccggcggcggagctccacatccttcgatctgaggtggggaggagcggcgaacttgcagtcggatccagtgtcgccgccaagctccccgctatggtcgccgcccttgagttccgcgagctcctccacactgacgacctcctgctccccggctccccatcgcctgcccctgctcgcccgccgcgacctcttgcttcatgccactggctcgacaacacttgcaagctccaccaccatgaccttcgccatcgctgtcgagcgacacgaggtccttcgaacctcctcgctaaggtccaagtcctccgatttgcccgcgatgcagaaatgacaccagtcgacgtcgcttgctgctccccgcgctagcgaaccccgcagcgtggccgtcaccgttgagggccattagctccatcgcgccgaaaccacactgttgtcgtcgtctccatgcgacgtggggcaaaggtcgatgcggcgccggtgcccatgcgaccggagggacgactggcgctcgcagccaagtccgtcgccgccgccgtaggtcccattgccggcgtgcggagggggagagggaggacaagggggagagagggctggcgccggctctgacgcacacatcgcccatgtggtgagggagggacgacagcgctctcgcggcgtggggaagagatgggacgggcagggaaggaagtagatggatagagtttggggataggagggaaggggatagatttggttgtttttcggaaaaaaaaaaaccttgtgtttttcatgtttacagtgctgcccctaagagcagaattttctcttcttcgtgtcgcatttctttaaaagctaggggtgtactgtataaaacggaacatggtgtcagtcggtggaagtacgtgcgcgctattccgtccaaacacgaggagtctttttttttataaacaccaccatgcgtcatttactacaagaaaggttctgcgtgacacacatgcaggacgagactggcacaaccggtggaggaaacggcgcaaaaaaaatcatgtcacccaatcgaggagcttctgcacctgcaaattacataggacaactactgaggagccaaaaaaaatccaaaaagggagaaaaagggtagctctaggggtttaatatattaatgattaatgatgtaggtgaagtattttctctccttttcttaataaatttatatgcaagttacttacaatttaactcaatatatacatttccgtgcctaaccaaaataaatattctataatgattttgaggacttcacagagagagagagtgtgtgtgtgtgttttcttttttaaaaaaaacctgtcgcgtgaatgggactgcattatgtcgctgtttatgtgttgggtttggtaccacggaccacggcgatggctgattggatatgcatttagggcatacaataggaaatgtatatatggaaatagatatctactgtacttgattgtgttgtcggtagttaggacttagtacagtgtttagttgttcacttgtttgcatgaatttcacataaaaccataaaaaagaacgtatagagttacggaattgctataaatatggcgtcatatttatagcaattagtttacagtcgatcttttaccgtacaattagttcagcgatttgtgcatgtccaaaactgctaacaccatcattactactattgttgatactatacatcgatatacactatccaggacatactaatatctaatcattacggagtaaaatccaagatgccatgcacagatggtaggcaaaaggacaagaaaaggagaagccaaggaagatagagagctcacgtcaatgtctgtttttaaactgcagttacatatgtaattatagtgtgattctattgtagttacatatcacttacacaccacttacatatgtaattaatataattttaggatttacatatataattttagaacttacatatataattttgggacttacattgtaaatacactaaaattacatattagaaatttataatataaatacatgccggctatttttttataaaaaaatatggcgtcataaatatagctactccctagagtatatggagagtctataattataatgtgtagttgcacttgaacagtgcctagaagcactctgccagtcatacttgtcactgcagcacccttttgtccatctaacctagcatgctttttgttggaggattttggtgagttggactgggccattctatttttgtaagtgtttggttgaaaaactccatgggttgagttagacccaaaagggaatactatgtatatatccaggttggcttgatccgtggaaaaattggtgaactgttttgacccacctcctttagcgcagtacacatgaggcgtatgcttgtgaaaaagaagaagatagtgaaaatacacgaaacgagatgagacgttatcgcatcattaagtattaattattttaaacttaaaaaatagattaatatgattttttaaaacaactttcttatagatcattcttttataaaaacacacatacttcgggaagcatgtgcttagaaaacgtgaaaattttctactccgtgtggtgctggtgaacttgcttgagctttttcgtcgacacataaaatgatacaggagattagagtatgattaatcaactattaattattataaacttaaaaatagatttgtttgtttctttaatgaaatatatgatatttatttatttttaaaaaaacaccatttagcaatttagaaagcgtgctaacaaaaacaagaaactttcaatttggagttgataaaaggaacgcagactaaatgaatgatgacaatcaatttcgcatcctccagaagtatctaaagtatcaaacctcatgacctcatcagacaaaatggtcaagcctgggttagcttgagccttagaaaatcttattggcatgagtataccaaattagtataacaatattcacaacaatttcagatcacattctctatcgaatatcgatcccataaagattgcatcccacattcctttgaattctagtgaataacaagggaccaaaagcatgccacattcctctgaattctagtgaatagcagaacaccaaagaagcaatgctggcataaacaaatcttccggttctcttctctctccttttttttaataaatccccaaagggacacgaatagcttgtttgttagtccaaaatatttgtgccaattgtttgttttcactctgccttttagcgcctaggcaacttttctattttatcaatagagtatcagggaaagcttcttcaacttcagccaagttattaccaattatttctgccccaagggcatcaatctcatagcgcacctcctccatgtgctcgtttatgctggtcactgcctcttgaacaccttgtatggcctctttaagagcaccatcatactcagcatctgcctctgcatcctccgtgccagcagcctcggttatctctttgacatgcacacagacatgttgagccatattgcttgacctgcaatctgcatggttcaccaggcgttccgaaggacgaccagctttcttcaacacctgaattcttgccgtctgaaataatcagagattaaaaaaaaaactttgttcagtgaattgagaaatttccaagctgagacctacagatagattgtgcgtcagatcaaaccaaaacgtgattagccacaacagctagaaacaatcgtttgtcaggcttctggactagttttgagtttaattttatttagcagcaatgccatgcgttgattaatgaaattacttttccctcacaaagaaaagatgatgaaaacaaaagtatatcagaaaatagttcaatattaaatcaaggtattgctgctagttgctagacaagcaattcaaacaccctaagtaaacataacaggctaagtgcaaaatatttcaggggtcatcagtaagagagtaataggtgtagttttcaagcaggaatatgccatcctattgcaattgatactatcatgctcaaacagattagtcaatgtgacattaacctttgaatgcatatcaattactattattgctaaatcagggaaacaagtttatattacttcctctgtttcataatataagtcattttgactttttttttccagacaaacttctttaagtttggcaaaatttatagaaaaaaatattagcaacatttacaacaccgaattagtttcattgaaaccaacatttaatatattttgataaaatgagtgttttgtatcgaaaatattgctatatttttctataaactttgtcaaacttaaaaaagtttaactaggaaaaaagtcaaaacgacttataatatgaaacagagggagtattttatttgatcttagagcaaagtataactccaaaccagtcagcactttgaattcaggaatcgggatgcatgttaaatttgttaattgaaataggttgagttgctatttgtaaaacggtcagaacgaaaccataaaaacaaaaaatttagttctttgtgtgattaatcattccgacatagtagcttccttacgccacaattaaaagcaaaaaatatagtaggtaaccaagtaatttggtttttgaaaggaaatcagttttcagttgaaaataaagcataaggctgaaccatgtcaaatttcataacaacacaatggagtcatagacaggttaccagatgcaacttctctttctcgtgtgcctgcacatccttcagtaagttggcaagatcgccacgacaaatttctggcgttgataggagggctaccatttcgagaacctatagggaataatatgaaatatataactttgtatgataaaaggagatgagtcaggtgataactgcctaacttgtttcgagcaatcattgaactccgccgtaacactcgcgcatagttgttgaaaagctaattcacctccattagccatgtattcagaaaaacccctgcataactttcaaaatgagataacaaaaagaatggtcggaaccctcaaatatgacgatgctgttttaaataaaagatttccatcacagtatccaaaataaaccatgtatgcgatacaattagatttgagcgttgattttcagcacttcaagattgtatgcttgtgagttgtgagttctactttttaagttacacttcaacatgaaacagctttgctggctcaatgtagtgattatgattttaattctgtacaaaagatgagttaggttaaccagcataccaacattatttaattgctgttagcaaatacgacagtcagtgacatctttccatatgtgatatcgtattttctgttcaacatgccacttgaagcatataatgagttcagtaataccgacgcattcctttcgtttcgttgccataatttcagttattttagcgttgcataagggtgatactacttccgtgctccaggaaaaggttttatcattttgttaataacttaatatctccaatagctcatcttttctagtttaaaaacttacatacccaaaatggcttgctcttcatattcaattcatcgcctcaaaaatcacattcagagtgcaatttatcactaaaaccacaaagatcctgcctacaggaatcacatacacagcactctaacctcggcttaaaagttaccagggcaatgaaaaatccccccctgattctaaaagttactccaatcctagggttttaggggcgggactgcacaagttgcacggacccagcaagcagcgagatagtataatatataccttcggagcgtggagtacgcctcggcgcggcgctgctgcacggcgaggaacccgcggagcactccggccaccctcgcgttgctccgcccgccgccgccgcagtccatggcgtcgctgccctcagcggcagccgccgccggagggcactccgccatcgggtcgccgctggcgctggcgctgacgctagcaggatccatctccgccacgctacggccgcctccgatctctccccccttgatctcagctcttcacgaggtgagcgagatttttgcgtgctccggccggcgtcccgccctcccctccccttcccttctctctctctctatctttttccggcccagagatcgggtcggttcaggagttttttttaaaaaaaaaatcagttaagttaggaatcgaagagcaaaccgaatggacatttaacttgccacttttaacatgtgctaattaattatttatacttattgtatatgacatgtgggtccttatatgtatatgatatgtgggttcagtgacaattcttttatcaccactaatagataggagtgacaaataattaattattccgaatcatttctctcggttgttaaaaaagaaaaatcagtctctctccttgttaagccgtttttcttcttgttatgaatttcgcgtgtcaaatagtataagattggggatttatttataggagtataaattactactgtacttgtaagtttcactagcctggtccagacttaggctgtgttctttcctggttgatctgggtgattgtgagtgagttttgtttcgttttccgcgtgcacgcttcccgaactactatgttttttttaaaaaaaattatataggaaagttgctttaaaaaatcatattaatccatttttgaagtttaaaatacttaatagttaattaatcatcatgtgttaatggctcacctcgttttgtttttgtgtaacctaccaatctcctctatctcttctcctcaaacacacccttagactattaaactttatcacactttatactttatgacacagttgcttatttcgttgtcacgtggtggcttgccacagtttttttatccttcgacctgcatacacattcttgtgcaaaaatttaccaaatctatattcactaaggccttgtttagttgaaaaaaaaaacttttcacccatcacattaaatgtttagacacatgcatagaatattaaatgtggaaaaaaactaattatacagtttgcgtgtaaattgcgagaaaaatcttttgagcctaattgcgccatgatttgacaatgtggtgctacaataaacatttgttaatgacaaattaattaggtttaataaattcgtctcacaatttcttaacgaaatctataatttgttttgttattagactatatttaatacttcaaatgtatgtccgtatatctaatgtgacaactattcccaactaaataaggcctaatttgttagccacaccatagtttagcatagagaatgaagcaggggcaaaatttgctacgggttaggtcatgtttaatgtaggttaatgagtggattattcaaatgaattatgtatttgattatagaataaattaaatattttaagaaataaatatagtaaatactccctcctctatataatccagatttataatatataatccagatttataatggtaggttatatctattttaagacggaggatttgtactgatgggttatctatttttgagactattggagtagctcaaaacaaatactagtctaagtaactcagagcgtgaaataaataatccatttcaataatccaataaatgttcggtttcatatgcaaaacgatcacaacaaaaatttaaacgttaattttaggccctttttttggggtgtgggtgcttcgtgttagacttttaaccgcttgtaagacatatatatatatatataagtgctaaaattattcttcgttgctctttcattttcttccccgcagcttatcgccttcactcaaccaatcagagccttgttccgtgaggatcgaaatgagggtataacagaaattgcttcatctgctggtcctgaacatctcacgattagcaaaatgaatccttgttacattggccagtcccccaaatgataatccagcggtatacagttcgcaagtgccatggaaaaaatggctgcgtcgctgccgttgccggcttgccgcaacaacgtcgcaactcgttcacccgtccgatggaacaccggttcctcgttcctttctgggcggatgtcccatgtcgcttcttcatccatgcaccgtttggctgaccccattcctaaagaaagatgggatggatatgcatatgctggagtagattatctggcaaaccagcataaaagcaaacacaagatggaatttgcgtgacaaaacaatgtcctcagtattataacttgacctggttaaataattggaatcggcttaagtaaacaagcatgagctacatgagtttctgtcgttaaggctagataaccaagctaagataacaagctattagacaactctactatcccacatggtacaatgtcatgaatgccatgaactctaattcagtgcattatgatgcatccatgcaaaagagggaagcaatttctatttgcttgcaacagcaatgaggtgcttagcaggcaaatgttttgcctcgctgaatttcaccaatagaagccatattactggatttaacttcaaactattacagctagaaagataagtgataacagcactgagtgacagatcactaatctgaaaatgtcttcaagaataagagaaaagaaaaaagaatggaaggccggctagttaggagtttaacagaataaacactaatcgatgttagaatagaacacaggtgcaacagttcaacacaaagggcggcatgcatggcaacatagccaactaccatagcacagcagtgcaatttatgaaggaaaagcacagtttcatctgttagaaagttctaaaatgcaatatattcctgtagtcaagattacctgtatgcagaacaataatgacagactgggttgaaaatactaaggttactctacacaatgaaaaaagatcaactctttgtttagaaacatgtctgcatgacactcccatgcgggttaggataaaataagtttcgcaaatatgtaaaaaataatagaaaaggagctctgtacataaagcatgtgaaaaggtaacctgcattgggttcacaggtcaatttaaataatttaaaaggtaacctgatcttatgctgaaaatctgcacttatttagccaaaacgatgtagaaaagatccatggttctttaaatccacacaagctcttttacaataaggtcacaagccctgatggccattcgaaaatctaaatagttgtacatactgcttaattttgaaagataggattgaggaaacaaagttcttgtgaaaactttgaccactagagtaatcgatttgccagaaacagcttaaaacagcaagtttataagtgcgaagcaggaacacgtagaatcatctggccacagtaaaatagttataagcatcctgtaaaatagcaaggtgaataaaaataagtgaaatgggtctgcaaaaagttaaaatttgtatgtacaaaaaataagtttctgaaaaaatgatatacatgtactatggtgatttactagcagttaaaaaaacgttatggaagggttatgaaataactaatatgttacaacctagctgaacagttgcactgcatacgcatcaaaataaggttaggagcaaactgagtcacatgagaatgacaaggcacaacatgaaccatgcatgattgcgaataattgtgaatgactatggatagtgcatgtaaatatctttggatacttttggtaaatccgagagccagacatgataaagaaataaaccagaaatcaagcatcatttaactaaaaaagagaccagaaaagcacgtgatttcacctctagcaaccagcctacgcatatctcctattattatttagctgtacttcaatttcttttgattaatagaatatcaagcttcccaaatctttcccaagctatgcctaatatagagtatgtgcaatagaattattggaaacgattcaactaacactaacataaggcattaactccctgaaattttgattgcaaaatgcagacttcagattcttatggcaacaattgtggcattaaagaaattaacacaagatggcatgttatcctaactttcattgtgcatgcgaagcatctacctaaatagcaataccataaaaagagtaccttggctcatgcaaaagcaaactcagtttaaaagcaaccaagaagagataaataatatagcgactcataaagggaaagctatttctttaccgatgtaaaaaatgcaagatcaatttcttggcagaaaacacatgtgaaaactatttgtaggttcctatggttgggacacaatcacctatccggatcttacctaatgacccatgtaatttcttcctgggcctcctggtggagtactgccatacccaccaccacccccatagccgcccaaataaccaccagcaccaggcatcccaggcaaaccactactacccagtcctgcagaagcccctgggttaggcaaccctgaaccatttgcaccaactcccaggatgttgttcagacccaaccctccaccctgggaggcaaggatagctgtcaaggcctgccccagagcaggattcacccctgggccaccagctacacctggcaatgaagtcaaactggatactggagatggcatcacatggcccccaacagcagcaccaggcaaagaatgactatgagctccataaccaccagcgcctttcctcccgcctgaagtgccagcaccatacaaacccccaagtcctccacctttgttgggctttggtccatcaattgccttctggcagtgcagcacaaccccctcgaattgcttgtgtggctcctgaagcgctttcttagcactatcgagggtcttgtagacaaatagagcaaagcccttcggcttcccggtaaccttatcgagcccaagaggaccctcctcaatctcaccatactttgaaaagaactgcagcagtttctgcgggtctatgtctgcgccgacattgctgacaaaaattttccgctgcgtgtactccgacactggcggcaatgccagctgcgctggggctggggctaccgctggggcagggttagtggccatgccgcccggcggcacaggaccaacagaggcgagctggcaggccgtggtgcggttgccaatcttcttctggggctcacggagcgccgcgcgggcgccggaccggcggctgaagaggatgaaaccgtagcccttgcacttgcccgtggcgcggtcggtgacgaccctgaggtcctcgatctcgccgtaggcgctgaacgcctcggtgagggtctccgcggtggcgtcccagccgaggccgtggacgaagatcttccgcagcgccgggtcggcgtcggccgcgcggtggacggccgtgagcacgtcctcgtggctgagcgccgcggcgctgagcagctcaacgagctggtccttggggaacgaattcagcagcgcctggatcgagtcggcgtccctctccgccgcctcctcctcctcctccccctccccctccccatcctcgtcctcgtcgacctccacctcctcctccacctcgacctcctccacctcctcttcctcgccaccgccagcctcacgggacatcatcctctcccccgcgccctcgctggataggcccaggggctgcgacgagggggccgggtcctcggctagggcttcgggctgggaggagggctcggcgacggcggcggcggcggcggcggcggctgcggctgctgcggccctggcggctgcggacctagcggcggcgggggatttggaatcgagcttccgcttcttgcccatggcgacggcgagcgcgaggcgtgggggaaccttggggctagggtttcgacggctgtggaggggaggggaaaggggggctgtgtggtgtggagtctggggctcgcgactcgcgaggccacgcggtcgtggggctttcttggttaacggcgacggaacgggggctacacaccgtttcccacttccgtgtgtggccagtttcggtcgtttttcccaagacaacaatgccacaatgatagatccaaactataaacagtacttgtactattagaacgtaagttcatcttttctttttctcaatatataaacttgactttttgagagcggtagatatcactatacttttgtattgttaattttgtctataatttttaacaatcatctgccttgaaccattttttttttgaaaaaatatatatacaagagaatatccgaatccattttcaagaatgaaggtgttcaacaatcatagcaatataacaatattaacaatagaatatacgcgagtcgaaaaattgtgcttctttagatttatcgaacctattagtgtacatatttatctttctaaattagcgtggaatcattgtaataattaagtacggctttgtgcttcttatttgcagcggccggtttatccattatgtaaaaaacttccgtgcacttaaaatagaaaacaaaaatacaaaatatccagcaaagttgattttgccccaacgtatgtacagcagtgcgaagaacgttgaaaatcttattgtcaagaagtgtccaatccaacaagagatgtaaagattaaaagtaaaccgtataaaatatcagtaataatatgggtttagctttacgctattttttctataatggaaataattccctagcttggtgatcttttttttatttagattttcctttatttctattaacttaaatggagatatccaagacgtcagacaaaagcatagatattggttaatagaaaccattggagtggagataacgaaatcctaatttaagtttataaaaaaacaatcttccaagctccatttaacacattccatgctgtagtacaccagcaacgatttcaggcggtgaacaagctggaagctaagagcaatagttcgtctaacatgtcagtttggggatctagcttcaaaggcttcattggtcaaagtctgaggcaccaaaaaaagagtaatctggatcagcagatgagccaagcaaagggatgtactctgatcctctcacatgaacactgaagcaagctgcaaaatacataaacactgtcaaacgtctacaaacatctagcgatatagtatcccagacaactgcatatgtcaaaaaggtaatactgtactaatcaactgcggacacatgaaaaaaaatgatgctagcccatatgtaaatattttcacaaatgagtggaacccgattcacacgatacactgaaataatttattttccagctgtaatatcaagtttgtgaattttgtccatactaaaacattaaacaaggtagaacaattgctatagttcaatacggtaagccgaggcaaaatcaactactcaactacagtctaacatgcaccccccccaccccccctgcaatcattcacgaggttaagaaatgactgacgaaagtcatgttaagcattttctattttgaactagaacatttggattccatcaatccatcacattaaacacttaaacttgactagtacatgcttccaagttccaaaaaaacttaaaatcaacttagttagctagttcaagtgggggcgtccttagaaaacaaaggattcaacaaaatgtcagagttatgaggttctccgtgcatagagaactaagccggttaaaaacgggattcgatatgtcagttgtaccaaaaagaacactagatcttggataaaggaacacgtcatcaaacaaaagtgtgccattttaagaatcgggaaaatatagttagaatttagcagatatagaaaccacatctttggttggcacaaaaattattaacagtcatttactagtataaatgagcattagaaatgaagatacctctgaactaaggaaagtgcatgttaactactaatctatatagcatgttaaagagtacaagtctatataacatgtctgtatatagtttcacttaaggaaaagataatatgtttcatctattattcatgttgtgataagtattgatacgtccaaggattttatgtattttcaaataaaggtcataaatgaggactctggtataaagttgatattgttgggcatcaaagaagtgataccattctcaattttcactacactttgcagcatagtctccatcttcttcttcatctcactattgtcatccatcagaggcaccacaagggtcagctccctgtatatatcacgtacaaatgcacaaatgtttttggcatattcaacttctccatcagatatacggccaattgcaagcctcatcagctctcctgacagatcggcaacctaacatattgacagcacagaaataccctcaacaacttcaagcagacaaagaaaaggatatttagcagaactaaattttggacagttgcatttacccctaaaacatagtcgagtacatttatctgtaagggctcaacagatttgtcacccagctctagcaaagaatcattgatttcagcaagacttaataaagtgccagtcttgcaaaatctgcagaatgttgcagcttcaacatattcttgtacctgaaatagtcatgacaaacatattggatccgttacaaacctagaacagaaccgatgtaaaggaacaacatttatactaacaccaaaggtataggcccttctgagcttccagaagtcggtcccttgcagttcttttaccaacttcccaatgtattggttaaccacaacagtgagatcattttcagcttttgaaagaacctcttccttgttattcttacttatcctgaaacaaatcagttcagttataaattaagtatagcagcaaataaaattgcaaagcagtataacagagagtaggtcaatttggttattaactatgaaatcatgaaagagacttttgagatgagtatgtatagttctccaatgttgtcagatgaatggacaattttgacactaaataataacttgaatgtatcatttgcacatacagcttttatcaattgccaaaggttgagactagcaataacttctcacaacgtgccacgagatgaaaataagttcatctaaaatcttgtttctgatcgccttcgatttggaggaaacaaatactccataaagcttagctcatggagagttcctgattgtccgtacagtgagagtaataagttttgcaaaaccagaatgacgtttttacactaagaataaactagaatttactggttcattgacattccacaataattttagtatcacatggcatactaattcataacaaactaaggtaatgaatgatacaaggggccctaagaatcacattatctgtcaaggaaacatacatggataattctcttcctttatttaatgaagcaatgtaatgccactagcacaattgtttgcttgtcaaattacctgtgaacctgaaagatggcctttttgctgttcattgtcaaatcccgacttgctttcacaagcctttcccttttatcattctacatatggaaaactgatgagataatataaaaatattgctaacttaagaaagatacagcctgctactaccataactgctttcagcatgtacaaggggaaaaaaatgttcaactgaagaattacacactaagagtagcagtgccgtccatatcacacactaaaccaaatatacatatcttaagcagagctacctagcatctagttcaagcagctttgaggatcagtttggtacaaatgtccaataacaataagttttgcagtgtccacaccccgtgaggtcagtaatctttacttgtcaaaacacttctcctaccctacaccactaaccggcactccaaagtgatcgacaaggctatctcgtcaataatgcactcattagcagaagccagtgatcgcataggctcaacgggaatttctccgagcacctggcccgcacaagatcttggcaccagatcacaccaacagtttccccaaaaaaaaaatcatgcctctactctactctaatatacgacagcgtcctctttgagcgcgccgctgcaggggggaggaaatagctcgagaagagagaacgtcgtcgcacgccaaggaggcgagggacgagcgctctaacgcgtgcgtacaacgtaccagggtgttgaggtactcggcgtgcttggcgaactcggccttcatcgcggagcaccccgccgaggccgaatgcgccgtcgccgccgcgtcggtggccatcgtcctggacctcttgggcgccgagccggcggtggaggctgcagaggagggggagcagagagggtgagaccgcggagaggggagaagaccgaggaggagagggaggggagtgtccagagcgtacgcggaggagggctcgcgcggagggttttggcggggtgggagtgggactggggcgccgccatggacgtggtgggggtggtggtgatgggaggaagaagggagggggcggtgacgccgcgcagggagaggaggcggcggtggcagccgcgcaggggcaacatctgtcagattgtgggccccgccccgtctcggcacttccgtttcctttgcctcacttggtgcgatttgtatttgtaaggcataatatgcttttttttattattgtttttttagaaaactaaaaaaaaattcgaataaggccttttttaatggtggtgtttgaatcagggactaaactttggtccctgtcatatggatgaatttggagtattaaacatagactacttataaaactaattacataaatgagagttaattcacgtgataaattttttaagcctaattaatccataattagcgcatgtttattgtagcatcacataggctaatcatggattaattaggctcaatagattcgtctctcgaattagtccagggttatagaatgggttttactaatagtctacgtttaatatttataattagtgtccaaacatccgatgtgatagggactaaaaagttttagtgccatctaaacagggtcttagttctcaaaaaaaattccaaaaaacgtcacatcgaatctttggacacatgcatagagcattaaatatagataaaatgaaaaattaattgcacagtttgcatggaaatcgcgagacgaatcttttaagcctaattagtccatgattagccataagtactacattaacccacatgtgctaatgatggattaattaggcttaataaattcgtctcgcagtttccaggcgggttatgaaattagttttttcattcgtgtccaaaaaccctcttccgacatctggtcaaacgtccgatgtgacacccaaaaattttctttacgcgaactaaacaaggcctatgattaagttcaggagaacccacccaacccaagtacatcgacgaagagatacacggaaagtattgaaccgtcttatcataaaagaggctaactgaattaaagaaacaaactttctaatgaaactgaagagtagcataggagcagatcgatagggtattgtgtcatttgtcgcaatgattgcgtccttaggccttcgttaacgtgcaatccgcttgacatacaggtaatttccttctgttgcctccacagaatgtacacgcattagaggtttgttgttgatgttgcgtggtgtggtgttcatcgttaaatctgaagagcactaatcgcaaccgcttggaccaagggtgcacaagcagtctatactcaacccgaacaatgaaccctgcatggttaccgttgcatagaaaacgtcgagaaagatgttccctaaatccaaccaaccttaatcaagagagaacttggacggtggcagtagaacatctgtcttgctagatcaagctggagtacatcatatgaatattgagagaaattaacctttggaaaccttaaaccattaaatgctataacatgtagacttggttcaccacattcagttgaacaagcatgaaatccacaccaacgtcatagtcttcgttaagcaatacctatctactcacctactccatcttgaccaccgaccatcatccgtagcccatccatcaatcgagggagctagccaatgagcagcaggtttggatcaagcaactgttggttcgggcaaccccaccaccagtggaagggcgcagaagtctccagccaaccccatccaaatcaccgaaaagaggaacctgaacctagcattgaggcatcggatccatcggaatatggctgcaccgaaacaacagcttcaagcctccatgatgatttagccaataaagtcgatgaagggactatccaccatggtctagcatgcatgacacttgagatgtcctgcaacacataccgccaccatgggtcctaccaccttcagcaaacgctatggacatgacaccaaaacaggattaaccttaaaacacaagaggacttgacatggaactcgaacactaaactatactacacttattaaagaagaaggcccgacccctcgtttgaccatcaccgacggaaagctgtcggaagcaaggtggaaaaggggtcatggaagggttttactgtagctctctctctctcttcacctttgatgttctccagaagcctcccttgtaaggtaggctgtttaaatacaagaatatgggtgtggaaaaagacacaagatttatggaatatataatattgtttatggagtttttatattgaatattgttcagaactatattaactcatctgtactacctgtctaactccgtccatactatattaactcattaatactacctgtctaactccgtccatacaccagtgtatagctgtatagccataagtaactattaattatcccacaaaatgtaacgttgagacaattttctgtataacagcaatagacttatgccactttttttttataaaaaaattgtagcattataagcacccaaggaactatgtataatttacttaacaatataaatattttgcaaagatacacaaattatgagttaaaaaaacatgtgcttttgcgattttgctatatatttgtcgacaaattttctcccaaaaatttaacagatgtaattacagtacaatcgtagtgtaattacactgtaacttgcatgtaattacactgtaactatagtgtaacttatatgtaacttgcaaaaatctctacgtgatatgttatttcggtaaaatagaagttgtgggaacaaatccttacacatatgtgtgtgccgtgattttatttttcttcctcaccaaaacaaatcttttaatagatctaaagattcaaaattacatgaaacttatatacaagttacaccgtagttacgtgcaagttacagtataattacatataagttacagtgtaattacactataattgtactataattacatctttcaaatttttgaaagaaaatttatcaataaatgtataggtggtcccgtgcttttgtattgtgtttgcgtgaaaaaaggacacggtaaaacaagacgttggaaacccagtcacccacggccacagcccaacaagcccacacaggccacaggagggtccaaccgtccaagggacagacgacgacgagcacgagccccagcgaaaacaccgcggcagcaccgcagcagccgccacccgtgcatccctacccgctgctggccccacccgtcatatacaccctcatccagccggtatttcctccccacggtcggggccccacatgccagccagcgctttgcctttcccacatcccctcctaaacacaaaagtccccataggtcatctccccctcctctctctcttacctcacgcgctccacgcacgcagagtcgagacgcgcacgccaccctgtcgctctctctctctcgctctcgccctcgcctctcccctccccatcaccacccaaaaccctagttacccccaccctctcaaaaccctaaccccacctcaccaccctccccggcggcggcggcccttgtggctgtgcacccatcactccaccggataagctctagctatctatcatccaaagcagcttactagtctgtgctctctctgtgtcggaaggcggcggcggcggcgcggcggctggtggtggtgggcgggggaggcggcggtagagcggtggtatctgggcgttttgtggcgggggcggctcgggcgtcggcgatggaggagccgaatgtgggcggaggggcggcggcggtggtggcgcctgagggggcggatccggctggcggcggcggcggtggaccgggcgcccccgcgtctccctggaggaagaccacgccgccgcctgtggcgggtgaggcggtggtcatgggggccaagtcgtggcccgcgctggaggaggctaggcagaaggtcgccgccgcggaggccgcggcgaggccgggggcgggcaatgctggcggcggtggcgaaccagcgaagggggcgcaggcgcagcagccgtcccctcccccgccacagtcgcaggtataatctggtgctcgtggccagccatatgcttgtttgctatggctttctatttttgttagtttagttcttaaggaaattttagtgtatggtaaagtttgctcacttcggtagatgtttatagtatttgtctctctatacgaaataggtataggttgggtctgggtatgcattggtctactggtgagtagtaaagtaaagcttggctgtttttggaaccacgtatttcaggttcaactttctcgagtgtgttcaactgtccatgttagtttttttgcttgacaagaccgcttgtccgcttatgttcaaagtaggttacacatgcattttgcattatgatgtaagtttgctatttgtcttagaagtaatgttctctctcaagtcaaccatgccccgacagcaagtggttgatagattataggtgtcatattttgatacgtaggatttgtgcattttttgtaacctattatcagattttgtttccacacaagttgtgatccaattggatctttgtatgattttgtccactgtgtctgtagccatcacattattttaggtattgctgtttggtcgcaaacttgcaatcattccaatgctatctagacggttattcaatcttaactgaacatgccttttatagctatctcctttgtaagactgctgggatggttacctaactgactcccatggaagcactttcttgggtgctatggcaatgcagtacatattgaacttatttatcatcgtgggggtaaatataagccttgcatttgtggcagttttgtaacgatcatgatatacatttatcattgttaagatgcatgggtggtctatcccatgaaactgatttgttccaaggtccactcggtaagatcaggaaaacatcattcttatttggtttggttccttgccttccctgtaaaccaaatagttgtcaaacaggtgttttgtgtttcacatgcagactaaggataattgtatgcttttcatcaaatggtttaaagtcccttaggagttattttttttattttaatgttttatgagctgaatatacattattttgtcactgttctacacaagcattttttttgctgatcatataagcattcttcctgttctgatttagtctgatgcaaagggggaaacacttgtttgtaggcacctaatcgcacgcacaagtttgatggccatggaaatcccaacaagaataatcaagcataccatagaaatggccccaagagacgttctcctgctgcgaatgggactccatcttatcctgccgcgatgccatatcaccaacatccagggcaacctttttactaccctgttattcccagtccagtgatactacatgaatatccttacccaccttttgctgttccggttccaagtcatgacccgcatgctggaaaatctggatatgagaattctatgcctgcttatgttccagtagatcaagctggtggcaatgaaggtaaccggccagtgcctccacaaccaaggggagaccttcatgcttggaggcctcctgttggtgcaagaccccagcctggccttgaaggccgtggccattttaatcacaattggcagaatccccagatgttcggtaccagggaaaacacaagtgtaccacaaggtgctgggccaagagctttcatgagaccaatggcacatctgcctcacactctgggatacataaatggtccaccataccctggtaatgctatgctcactgtaatggcatctcctttcatgcttggtattagagctttttttgcaccaatattaaaaaatgtgttgacccagggccaatgcctcccatgtattattacatgcctgctgtacccatggagccgatgagaggtccaccacgttttgtccaaaaccaaccacctcctcatcctgttttatctcctgaattaagagctaaaatactgactcaagtggagtactattttaggtaaattcttatttcttctattgagttgggtagctattttatattgggttaagtctgatttactccccctcaattatcacaaaagtacgatctaccccccttaactctaaacaagatattttacgccctcaaacttttaaaactgtacgaattaccccctttgcactatattgggtagtttttgcataagtggtgtctatgtggcaacaaaatcagtggaccttttttttaagacctatggacccacctcccattctcctttgtctgtgttctctctctgtgttcttcctacacgagcaagagcaaccatccaaatcggagatctctcaaaaccacatccggcatggcagcaacagttccatttctgtgactcgcctgatgcaatcaataactggctttgcttgaagggatgcctcccactgaatccaaggccatatgtcatcgaagtatccagctgcatatgactgattacttcctgattgatctctctgttgagctatgatgcacacctagatggagctgctgcacatggttggagctcgtcaggtgtccttttcctgaaagttcgcgaggagatcgccagcagcttgaatgggcctggctgtggatagatcggggaaatcactagcagcttgggctccgctgtcgctcccgcctcataccagtctgccactgttgtctccatcgtgctgctacagtggagataggggcagggagatgcgactcggttgctgctcagaaccagatgccatcgcgcctaaagtccaaaggttgcaggagggagaggggagagaaataagaggggatgaagaaggtagggagaggctgacaagtgggtctgattccacgttggatgccatgtaggcttaaaaccaccatatggttagcagaagggggtaaatcgtctggcttaaatagtactttttccccaaggaagcatgatggttgatgactagaaaacaggcatttgagcatttacactacctgatagagttttcatgcaatttcagaaagcagtgacaagttagtcccattgtatgtctattgaactttggaatatatgaactacaatttgattttgtcaatttcattgttgttatcctatatgcaaacactgacatgctgcactactaaaactattttgtatgtatgtgatgcacatgggttatcatatgcacttttatcatttgtcattcataaggtcttttatttacccattatgatgcttttcagtgatagtaatctggatcatgataattttcttaaatctttaatggacgaacatggctgggttccaatttccaaagttgcagacttcaatcgggtatgtttttctcagtacttaaacttttgctatttcacctttatattatgccatataactactctgctagtttggcttgtttagttgttttgcagcttaagaaaattatcaaggatatacatctaacaactctgttattgcttggttcatttgcagcttaagaaaatgaccacggatatacaactgattgtagaagcattggcaaactcaagtcttttagaagttcaggtacgtttaatgcaactattgttgcttagatccctcttagaatgtcatctctcttatttatcttatgccttttgtataccaccaggatggtaatatgaggcggcgttctgactggtcaaagtgggtttccttgtctgggacatctcttccgagtccatcttcaaccagtatggataacactactggtgaatgtaataaggatgcttattctgaagatgaaaagaagcctcatcctcgcagcgtagattgtgttggtatgggggcttctgatgagccatcacatgatacactcagtagttcagtcacttcactgaataagggcttatcaaacattagtattgataataagcctaagagcatttctgcatgctctctgaactcacaaaaacatgaagctgcttttaggactggtgatgttaaagttcagaaagtaaacacaaagatcaaagtgcctgattctcagagggaaagaggtttctgtaatgatttcataagtgactctcctagcttcagcggcgatcaaagcacattcttgcttgatgaggaattagaattggagcatgcagagctttcacatgatctctattcgcacaaaaggtgaattttaactagtttatatatgatctgttacttcatttcatgagctataatttgttgttttattagtttgttattcatttggtagtttatagtgttgttattgtgatttgagattaaggcgattttggttgtaatttaggcttcctactctggccgaagtgattattattttatgtattcatttgtacagttttatgaaatgaaagatgtatccaggccacttatgtgagatgtgtgctatactgctacaccctccttttccatcagttaatgtcctattatttgatgaaactggatattcttctgtgttcacattttggagtgttaggcacatgtattctcagaagttcaaaaattgattatatattttttcatgtaatactgcatcttttatctactacactgcagattctagaaatggtatgcatataattgattctctttatgtttgtttaagcagggtcgatgatgaggaagatgatttttatgttgatgaccaagatgtgaacaggctaataatcgttacgcaggttagatttcaagtagtattttgtattgctagctctgtgtagtgatatacctccttcagtttgcagctccttgccttcgtaatctgaacacactgggcttgcctttttttatgcaccatgcaccaataagttttgggacagtttcaatggcgttggatgtttaactatttctaattttcatgttatgatgatttacctgatttcttattttttgtatttataatagtcttgctatttcccttgctacgaatcctatttgagcagattatgttcatgcttaataattacataacaaataaatagttgattgctaagtgaaattttatgctttatagggacatgccctttttatttcatgatttttgacttgattgagatacatttccatgtactgtgatataccattattttaacattatttgctttataatgacttgaattttctcatctctaaatattatatgttaattagcaccttagcatccatcaagcaaattttgcagcacgctatcttgtatgctttcaccatgttaagcaagtcttgtcttggtaatagtgcaataaactcttgtcaactatctgcgttacaggacggacctcaagcattttcaaaagaggaaatatcaagaatcaatgaggggttatattactatgaggtaatattttagagcataaaaagaacaagattatcagtaattggggttgtatgtgcattttaggggccaatataatgttgacacagtgctgtgttgtttgggaactgccattcactccaacgcttgtatttattattttattttaacaattacatgctcaattttatgcaagtaaataagctttattttgggcatgcaattcaacccagtaggccagtatcctgttttatcatgaagtatccataaaattaagtaaaattcctgctcaatttaatacaattgtccaggctctaattcaggttttctgttttttagattatcatcccttttctttctcaagaattgcctgcatttgatacttgatacatattatagctttgagttatatgttagaaattagaaatgtcccagtagcatgaatctttccatgtatagtgctggatttttttttttggtatggctaatcaattctttgaatttttgaatcatttgtactaaactgagtgttgggaaaaaggtacgagacaagggttatcttggagctaaatcgaatttaagtcaagccaggttgatccaaacctgagctgttcttgcctttctttatcccaaagccctttctggatttatgcttgcctataaaattacattattctcatgctaatacatgatatttattcttgctttagaatcacgcttataatcaaagaagttcccaagctggcaccatagatattgattctaaaccagctggtggttcaaaggggaatcccattaatattgtaaacaatggaattgaagattctggacagcctatcccacgaaggaggcacaacagaggcaatagaaaagcacagtcctctcataagcagaggttctttcctggtaactttgcgaataacaccaataatagatctcactatggcggtgtatcagagagccccccaagcaattcaattggatatttctacggatctactccagaaaaccacaggttaggttaataaattaattgaggttttatttctgtaaaacaaatacttatctctatgctttgtggctggtcatattgtcatatacctgcaccattcttagcaagagatttgaaaactgagtacatgatttgcgcatgacatttaagtttcaagtttatacacttgcatggacaaatccatctctgccaacctgttttttttattgaaggtggacagacacccactgttatcatgagtgcctttttcattgaagcaaagctattgaagttatcttaactaagtgttgttgtttagctatagaagttcaaggttgagctcatctcctcatggaatccctactggtagctcgcctgttggttctgtgcccaaatctttcccaccatttcaacacccaagtcatcagcttttagagaaaaataaattccagcagcaaaggtaagctgtcagtatagatctcaattgagttgcagttctttctagtactcattcctttgcaagtgtattactaccctttattcgttgtttcatagtaaattgatccgttttaatgttttcttctgcatgtaaaggtacaataagttcaaaaatcgatgcatcgctgaacgcaagaagttagggatcggttgcagtgaggtgcaacttcctcgcacatctctctttctatggcaacgttctaactagatatacataaatctgaccaagctcatttattactctctttgaatcattttcttcatatgtgaaatcatttggtgttactattgttttggcaattattactgattatatgccgcatgaatacttgttctgtttattgattatatactgatgctcttctatcttccaatgtaatgcaggaaatgaattcgttatatcgtttttggtcgtattatctaagagataattttaatgatgatatgtacaaacattttaagaagtttgcactagatgacgcggcagcaaattacagatatggacttgaatgtctcttcagattttataggtacggtacataaaaattttatagtaatattcccatttttttccttgcattccataatatagcagcaatgttcactgcctgcttgtatttacagttatggtttggagaaaaacttccaacgcaatgtgtatgaagatttcgagcagctgacactcgaattccatcacaagggtgatctttatggactcgaaaaatactggtaatttgcatttctctgttacttcctgtcccctagtaatctaattatgtggctactgtccttggggaaatatttagcacagagctatttacacctgagcaaacaccaaacagtatgcaactcaatggtgcatttccaatatcaaatattcacaaccttatgctgtggagtattggcatgataaagttgtacatgctcagtcccagcacaaagatcatcaacaagaaataccatctggtgtcactaatacgttacctcccttctcccacatgtgaacctcacactagatcgtattttccaatttatatttttttgtggtggcactgaaccaaatcttcttttgattataacacacgctattgttacatgaaagctggttcagacctggatagcctgggtacgccctgaaaagggtaactgaaaatgaatcttaaaattatgctggactagtggaattggccaacctagcagttgtaagatttttgagtttgcgatactttgttgctgacagatctgctttttgctaattgaaccagggctttccaccatttccgaaatcaagatagcagccccattatcaagcatccagaattggagaggctcctaaaggaggagttccgaaccatcgaggatttcaaggcacggaaggcagcagagaaagaaactggcagcagtactgctgccgccgcaggccataacaaggctgatgcgaagtaggtcctagcatggcatgaaattttggtggtcatcccacaaaaaggagaaagtagcaaaaccgtttttgtttggtgaaaaacttaaggatttgagtagacacctgtgcagattttgttctcccctgccgacgatacttgtgtggccttgtccaggaaattttcctctcgcattttttcccattacattcctggcgcnnngccctgtgggatttgtacataaagataataattacttgttgattaaatggacaaataatagagcctggagttaaaatgacacggcattgtcgtcttgccgttgcttttggaaggtttatcttaggaagtttcttcacctgtggtccggaggctggaaaccaagtcacggtcatattgcctttgtgagcttctctccatggaccatggtccttttcgaagtctctttcacttctctggtggcaatgcctttatttttgtcgtcggccgcacgttatatgtcagcacaaagtgccatattctcgttactggagatccggcgtactggcacgacgaggttttctcggtttgtgatgccttttgctgttgcagtaagggcctgttcggagaagtttccagctgcagcttctcccaaaatctctagctcacccaagcaatctagattgtcatccagattttaagaatctgtagttgtagaatccagaaaataaactagaactctagaactcagaagcttaaaaacccagctcatacagattctcagaaattggtcaccaactagaaaattcttaaaatcttaaactcccctaaatagggcctaaatcgtttcttaataagtactagtgccatgtgtctggggttggaaatggtaaaggaaattttcgattgacggagcacagtttccgtataaggggtattgttactcttttgttcccaaataaacactatgtttatttatggatagaggaaatatttcaaattcattaaaaaaaatcaacttctaagaacgagataaatgactattcagatttattctcgtaagttggttttcaggaatggaggatatgtacaagtttttcgattttttgtttgcaaaccgacataatggacgttggacccaaagccagcacggacgataggagaaaatacagtggccagggctgaggctctgcgtcatatggatccgagcctaagtggagtagatgctctcgtagttcgaatgagtacccaatgccagtgtcaaaggaccacctgttatagatgttagtccaaataatcttttcaatattgttagccatctatcgactcaatcataccaaattacgataaacaaaataatactacgagtttacgtatagcttatatctccagactctaattattaaaacacctcaaccaacatggcacatcggctactacaggtttaatagcctaactgtcatccttcctctatatgactgctacattgtcattatcattgttacattgtaatattcactctgtatttaaaagaataactagaggattagagtctgatgctaacttaactttatatcgctattaaaacttcaagtttaattttactttagtatagtatagtcagcgccatattttcacttctctcttagaagtcatttgatattgtcattcttgtttccaaaggccggtgttctatttaggttgtggtggtcttggagtgaaaatatttttgtcacatgtgattcattgtacatttagttaagaaattttgtattgcaactttttttcgcttgctgtttttcactctccacctttactagtaagacgtttggtcgctctctaaaacgtgtctaataattcgtcgatgattaactttagagattggtcctacccaatccccaaacggaactaactactactgtagttccggaattatttgatgatagaagacatctgaccctagatttaattagaacagtaactaagttggcgtgtacctaaaacctctgcataattgtgctacgagtcattcctaaatggacagaatgaacagctcacacatggacggtgacgagtgacgacaagccccagctagatccgataattttccagctcacttgggagttcaaatgttaaaaatctctgtaaagccgttattgcgtaattaatcgaaatgtgaccttagcaagttggcaaattgtgaaaaacgcctactaaaccaccaatatttattacttctaaaacgagccaatatttttgtaataagacgtagccggatacagactgacgtggatattgattgattttcatcattaaaagtacagtgtattcttaaaaacgattattcatgttttttaatattgaaataataatttctggcctctattcatgatgttgtacataatcgtaaaccgttgttcatgtaaatcgcataaacggtgatgtgggtattttaagataaatgggaatgtgcttaatatacttttggacaaaggaagtatctgtgtgtatctacacaaacatttactccccgatttttgtcgtccaaaacagttcttgggctgtgttaggactttggagtactggttgataactcattcccctcacaggaaaaacaagattaattaagtattagcttaaaaaaatagattagtaagattttcaaagtaaactttttatatattatttttaaaaaatgcatcgtttatatgtggtgaatggttgaaatcaatttaaactagctctctataatagtcaatactatagattaaatgtatttaggacgtgtaattactctcagttagagttaactaaatagagtattaccatatatctaacgctacaatagtgttgttagtgatgggagtgaggatgttagcatgttgcctcccaccaactaataatgcttttaaagagagaacaatcccacctactcaggttgattatatggtggacacatcccttattaagatcaactccaaggctcataatgctagaaaaagatatgaacgtacatgtataattgtgtcgcccaagcagacattataagcaacagaaaattaaaaagaaaacatacctactctaaaaactttagggagcatttgtttgcacaaagacaatattaatagctgtaatatttaaagtactatatttaattaaacaaatttggtcttgtagatgttgaattttttttataaacttgatgaaaactaaagaaatttgataagaaaaatcaaaacgacttagagcagatacaatagcaggctattagccagctgtaaacatattttactaagataaaagatgagagagaaaagcagcagactacagatctatagccagctgtagcacggactccaagatgtaatgtgtgtatgacgtatgtgaccatatattaatagtatagtaagcaactattgtatgaattggctattagattggctatagatgaattgaagctagtagtaggctatactattaaacttgctcttataatatgaaacatttggagtaggtacgaggcaagaccactcctaagctaagggcctgtttgaggagctttcagcagctgcagcttctcttagaatctttagttaccagacgctccctaaaactgtccagctttttacccagattctgagaatctatagctatagaatctggaaaatgaactagaagccagaagctgggtttcccagtttctccagattctcacaaactagcttctcagcagctgcttcttagaatctcaaactcatccaaacaggccctaagagcaattgaaaccccacccaagcaatcatcacaaatcaattttttagcttttcaatataagtctagaagtaagtgattttcacatgtaaatccgtccccttgacgaaattgaagtacactccttgtcgtttatcgtgtaaaccatccatgcatctccacgaaaacgagaatgactatcaattgcttgaatcggatagtttcttgcggatcttgtgcaagttcggaattccatttcaaaggccggaacttccgattcggcatgtttcaccggaaggcttggctgcggtgtgctcccgtgttttcgtgcaaacacctaactagaaatccgtatgattgtaatatacatgagaattaactaggattatcacacaattttccatgtacctaaacgttcctaaccatcaaacagctctaggtatcgcatgatacttgagtatcagccgatacctactaggtatcagtcgagacctcagagatattattccgttcgaatggggtatcagccgatatctactagatatcagacaatacatgtaaggtatcataccatccgaactagatactgttctcatttgccattttagtaatatgccacttcaggcttagaacggttagaagttgctgaggcccatgaaatttactcgaaaaggaagcaaaatctgatataaattcggtgaggccaccgccggccaccgcgtccctttcatcgcgtggctttcccacacatcgctgtgtctctggacgccatgacaaaacaaaccaaccccttcaaaataaaaataaaaataaaaataataaaaaaaaacaccacccttatctaaattattattattattatcatctcctcccgctcccgctcgctcgcgccattttccagcccaaagccaagcgcctcggctcgctctcgccgcctcgccgcgcgccgcgcgctcgccatggagatcggtggcgtgctcgtgtcgctgctcttcgccgccttctccctcccctgcctcctcctcctcctcgtcctcgccgaggccggcctccgcctcgcctccctcgcgctccgcggcggccgctacgcctggcccacccgctccgacttcctcggctaccgcatcgcccgccgccgccgcgccgccgtctccggcggcgccggcggggcggacggcgaggaggaggcgcagccgacggcggagtgctgcgaccgccttgccgtggcgatgtaccggcgcgggcgcgacgcggctcccgtggactgcgtgttctgcctgtcgcgggtggacgacggcgaggaggtccgcgagctccggtgccgccacgtcttccaccgcgcctgcctcgacgcctggctcgtcctcccgcgcgccacctgcccgctctgccgcgactgcctcctcccgccgccgtgcgagccgccgcgcagcttcccgctcgactactacgacgacgacgacgacgtccacttcggcttcaacgacttctccatcacctcctccaccaccaccaccacctccgccgccgccgccgtcgcctacccacacggcgtcgcgctctggcccatgtaataaatgtaataatcgccattgctgccgctgccggctgccgccatgcgagaagccgaggagcagagtgttctctctgtttttcttcttctttttttttggtttctttttgcatagttttttttagtaattagttgctaattaatttgggactgattgcttgattaatctaatgtaatctaagatgatctggctaggtggcccatgtaaagtaatgtaataatctccaattctccattgttgctgccacacgagagaagccgagaaacacacagggatcttttggctagctttacgaggtgataggctagacgatttgaatttgaagcctcgttctttctagctatttgatactaaatctttatctaatattcacgtcttttttagcatagtattctctctgttttttcatattttaggggttttttagtagttaattgctaattaattttgggacggattgcctgattagtgcaaaagacgatcaggcttaggtggcggttgctggctgctgtcctgtcctgtcttgctctctctcccggtaaatatcagcgactgataacgatgcctcacctgctactatttctcggatcgtccgtacatctttcatctactacacgagtacatggccatatgcattcatcacgagaaaacgctgcataatgcaaaccacaccccgtcccactaatgcttcatttctgggcatatacaaatactacctctatcctaaaatataaaatattttatccacgtagaagtagtgcttcattcctgcaatcctactgatgtatatatatagcgagaaatgaagtgttatgccaattcagaaaacacaaaaaggaaacagtaatatattatttgtgagcaatttaattaaaaatatggattagataccacctaataataggaataagtttgctgggatcgtgaaagaggaagtaattcgttggatcggttctcctgatccatcctccattatcaaaggatcagcggagtcccaatccatggtggaattccccgctccatggtggataatatcacagcaaatcgatggattgacctaacctagtgtgcaaagcacgtagactaatgcaattagggtaggtggcggtgtcaccgagcgagccagccagccagccggagttgacaacaccggtccatcgcgatcacgattatgcagcccccctacagtagtaatttctccatcacagtaaaaaacaatctagaagtacctgaagtagatttgacactatttgacactatttagtactccatccgtttcataatacaagtgatcttaagtttttacttatactacttcctccgttttttaatagatgacgccattgactttttctcacatgtttgaccattcgtcttattcaaaaaatttatgtaaatgtataagatataaatcacacttaaagtactatgagtgataaaacaactcataacaaaat

SEQ ID NO: 79402 - DNA, 3603 bp, Oryza sativa
cctcatcgttatcattgactgctacaccgctattgactggatcaatgatatcatcgtcttcatcaacatcctaccatacctcttcggctatgtctactctactgtcgttgatgcacaactttgtcatcatagtcgatcatctctattgatgctaatcatcattaccgtcggttgcatttgccatcgtcgactattttcttcatcttcatgattggtggatttcgccattgccattgatgagcgtttacgtcttcaccaccggcttgcctccgccgccattcatggtgtcttcgctttcatagctggtttattatgcctctactgatgggcgtcttcgtcttcttcaccgggcgcctcgtctgttatcgactgattattttgctgtcgtggctgcacaactttgtcgccgttgttgggcgccttcgtcttcactgctggctgacttgtctgctgtcgactggtttcttcgccaccaatggctatgcgacttcatcacctttgattggtgtcattgtttttatcatcaccaacattttcgtcacctctgactggcgatatcatccccatgttcgtcatcttgccttcatgtcgactacatcagctattgccaatggataattttgactatggcagaaggacaagttatatatgctcaggggcttatgaactcaaacacgaggattatatcttcaatttggacttgttccggatacattcaacatgaatttatggtcatgagtcgatttcttatgctcaacgactggactattcattatttcccatgagggccatcagctgagtgcttgcaccagtcgggattcaattatcacatttactttggtattctccatgagggacaattacgcttgatctacatcacccaggatatttatcacttgggatcatattatttggcgtgttctatgcgtcatcctttaaagggtgtcgaaggcatattttttggcctaggcctaatatgtctgcagcccatattatgagatgtggcctgtcacgttcttttagggacttaggcactttttgcttaggccaaagtgcgcgtgatccagtgcccaataccttaaaatccttttataccgcaattactcaactttttaggagttggtacaatgcatcttaaaaggtgtcaaacagtaaagctttatatagctgccccgctgacttttttatataagtcaaggtgatgtttgagtttttaagcaattgattggatacaatatcgttgctttttgccacgtaagtgtgcatttttatttactaatattatggcttaggctgattatatattgtggtcattttccaagcggttggtaaatcatttttgagtttatttactcggatttcataccacatatgccatatatttccaggtgtggtgaaaccatgtgtcttttagggacttaagcacatctgttaaagcagtgtgcgcatggtgtgtgcccaatactttggaaattttttattcacagcatataagcttctttatagctgttttattttcaatgatgtagtcaactttaggttgcactcatcatattttacaaagcagtcggtatatcacttggatcatgttatttgggggattcacaccgcatatgctatatattgatatcaagtcatttggttgattacaattatcaaaaccactcggttggttggattatttattccttgactatatgcttagtttgttcagctaaccacatagtcgagggctacacctattaggtgcatctagtcgatgcacctgactttatttttcagccctccatagtcttcatatttggtaaaagtactcgggagaccatggcaaagatgattgaagaacttggctttggagtaatctggttcgagagaagattatcttttcgactatgaaggtctcaggggctactgtagagattatgggtaccccatacccacacggcatagttatccgactggttataggggataacttatatctatggaatatgtaacggatcatgacttgggtattacgtttccctgtatattatggaacggcctaaagtcctggtttgataagattgtaaagtagatttagggaaccgataccgtattggttaaggtttctatcttgtaatcctgccccccatcctatataaggtgggcaggaggccctctagggggcatgacacacaaccatatcgtcagatctacaatgtacttggcggattcaaatcccaaaacaggagtagagtattacctctcattgagagggcctaaacctgtctaaatccttgtctccgcatccatccacttttaggcctcgtgcgctacccccttttattattgccgaattcatgtttcgacagttcgccgtcatccgagccactggtgagttttccgcgtcgcgctctacccgccggtgccctccaattgcgccgcctcgttgtcgttcgccgctaaccgtcaggtcctgagccgccgccgccgccaccggtggtaatgttgttgtgatgtcatcgccacgccagcgccgcgtcagtgccacgtcgaccgcatccccgcctcgcccgtgccacgtggtggaccgtttcggtgcacccggtacaccatgaacccaagcctgctgacgcaataaatctccttttctttttaaaataattttttattgcgttataattcaattaaaatctctataaataatttaattcggtttaaacttcaaaaattaataactaattcaccgtagatcggatttagttggttcaagtctctatttttgattgattttgttcttttatgtttagattccgatgttcccggagagtctgtctgtgcaggagaagagtctgatgagtttgaagggcagcaaggcatgtcacacagatcccaatcactctttgatcacgttattcccatttaatttctattcaactattgcatttattttttaatgtcaccgggtgggaatgacctattgcctttattatagaccattgttttttttactcaaagacaggggggaagcccccacggttaaattatattaaagaaggaaaaaataatacacacaaagaaacaaaagaagaaagcaaagattacagattgtcaatccatgattgaaccgtgggtctatgaacttctctgaacctaattaaatgtaggctcaaatcctccttcaaacccttcctccaattgtgaactgatggctgaataccttgaaaaataaggccatttctttctttccatatattccaggctgccagtagaaatagttccataaaactatactgagaaaaggaatttctttgaaccttcagcatttgatggtattctaatgaggagttccaaacccagcccaactttctccaacatgacttgctgaactgacattgaaagaagagatgatcccttgtctctcttgcattaatcccacatgtcaaacaataggcagtggcattcaaaggaatacaatgtttcctgtcaagaagatacttggtattcactctatccatcaacagtagccatccaaagactttgattttcatgttgagcttactttgccagatccaattaaatgaacaagggggagataaggaccaaaaggagagcttataa

SEQ ID NO: 79403 - DNA, 680 bp, Oryza sativa
aataaatacaatacccttggaatactctcgagtgaaatgctacaatggtatatccgtgcgcttgtggatgaactctgtaaccataatataccagaagtatttctgtgccattgctgggaattatatttctagtaatgtcgttaagaaataccaacaaacatttctggcgccattgccgaggaagattcgtaatagagattacctgaactaatagcaggataaccttggttgttttcgcttttattgtgaaaacagggtagtgcatgactggtttcaacttgtcggaaaacttcaaagaaaatccaaaagctttcgtccgaagcgtcagaccgcgagtcgttgctctgcagaaaactctacgacatagaaaccagtcgtaccagcaccaccaactttcaggactatggctgacaagacccttcacgagttcgctgctccctctactgacaatgtggccattgggccgcagatcaacatgggagacgtggatttcgacttgaagtccaatctcatcacgatggcgcaggctagcccattctatggcaagcctaacgaggatgcctgttggtatttcttacgaccacagataaatccgcaagcgcacggaatactgctgtagcacttcactttcgggtgaccccaaaaggatatcgaactcagggaatgtgtgtaatctacct

SEQ ID NO: 79404 - DNA, 1227 bp, Oryza sativa
accatggcagcatactccatccttcaactactgtagaattcatgtttgagaagtatagaaaggtttggtctttgaaacctgtctaaaacattgactatatggcttactttttttttctaaaacataatctatttttgcaaaatatatatactcaccgtatcgacaaattcatgattttgcaaatttccgtatccctgtatcgtcataccagtatcgcgtatctgtgcatacaccggagaggaggaagatgcaagccgacgcgattcaaattaagcctacgggaagccccgtttctgcgcttggagccgagctcgcattctcgttacgttgctcctggagccgttcgatcgctgggctgtccacgcgttgttcatccagaatggcattggtgactcatcatgctgataagtggacccgtacatatgcctcatctatctattatctatctatctatctatctattatatactaaagtccattaaactccctataaacgctctcaagctgccatgtggctccctcaaaacgctctcatattgccacgtggcactctaatataatagagaaatctgaccatcaattttcatttaaatcggtggacccattattttacatcgttagatctattttaaaaaccaaaaacctcccaccggccccaccacctctgtttagtacttttttttttcgtttgttcctttcttttctttttccaatcctaattaaaattgaacctatctttatagaaaagaatacccccacaaatagacatcaaacgcgttaaaatccattaaatatcatataaatgtttctaaccgttgtgtgccactcttaaattagagaaacgtccaaccattggttttcactagaatcgatggacacattattttacgtcgttattagatctgtatattaactaaaagtccataaaactttctatgaacactcctaagtcgccacgtggcatcctagaaacgctcttaagccgccacatgccactccaatatataaccgttgatttcattatatttgatggacccattatttacaaccattaaatttatcttatagaaaaagttaaccacccaaacctaaccccacccagcgtacgtacttatatctcatatacaactacctactatatatgaaaataataataatatacctcatgtattattattattattacaccaccctcttcctagattaactcttccttctcatattttt

SEQ ID NO: 79405 - DNA, 20381 bp, Oryza sativa
cttccagatccagaaacgaagatagggttaaggtagaacgagatggagggagagagaaagaggaagcaagtcagcacaggagctccccaaaggtggaagcagcaggacaccgtcggccaccgtaggcgagggaaggcggacggagagaccaccggatccgaagctcgccgacgtcactgctgcctttcctcccgccgggtctggcggaggagagggcgccaccgttgccgccgtcaccctaaggatccaccaccgctgggctgccaccgggccaccaccgcctcctctcccaccatcgggccgccacctgcaccgttcgctgcctccacgccgtttgccgccaccgcgcctcccctcccgccggatctggcagaggggagggcgccgccgctgctacacacagagagagagagaggagaagtggagaagtcaggatcgagagaagtggagaagtcgagaccgatcgagagaagctggccttatctcctccgggtgtgggccccgccgggagaagaaatatctcctccggctcggctcgatttttaaaaggtgtcagttcggctcttttaaccaataataaattaaaggtgtcggttttttctgaaaaacagacacctacagtataggtgtcggtttttatatagaaccgacacctataatcaattaaaggtgctggttttttgtgtttttgaaccgcggaggtgggaaaagttctttatgtgtctgttttagcacttccggcacctatagtgccgacacctatttgatgtttcatagtagtgaacgtggccaaggttggtgaagaatgacttgcgctattttattgattcatgatagttggagttacaagttatacgtaaaatcttctgaggtgctcgatgttccaagagttgtcgattaattcacctttcatagttgtgagccggtaggcaccgggtcgagtgacggtgatgactttataaggcccttcctaagttggagatagcttgtgcctatcttttgtggtttacactcgacgtaggactaggttgctgacagaaagagagcaatctcatacattgcggctttggtatttgcgtggtagttgctgataccgggctgactcaatcgtggcctcttcgccgtctccttcagggtggaccatgtctatatgcaacgagtgctcgacttcaccctcgttataagccccataccatggggcctccgagtgcgagcttagttggtaggactgccttggttccatagcgtaagaataatggagtttggcacgctgcccgacaaagtacgatcaaaatacctgaagttacaaggtttctttcagcatccctccattggcttggtggaattcaacctttccaccaaggttcaatgcctagacttggaaatagattctcacattttcaatagttagatctgagatatctgacatgcatgttcgtacaattatgtagtctcgggatgttacttcttttagagttttttttccaatgaaggatacacatagtatttctagccaagcttttgaatgcaatgacaaatttatctaagaaaaacttaactctaataggataatgactactgaataaataggctctagggtcgaccaagtaccattggatgagtccctaatagaatccaacacgatacagggcctgatgggcctaaatacagtccctaatgaactccaacttgataaatgacccagcaggcctaaaatatggcgacgtagcactcgtacatattctggaagtcagttttttctactattcctgttgacttatgaagaatttaaaaagaattttgatgtgagactaggtccattggaaaggagattgatgaggatacaactagctcggatataaccatgactaccttatgtattaatcaacaaaggtgcatatgttctatattagatttacttgttatatgtttgaacaaacgctgctacacaatgagttttgtgtgtttttgtttgcagcggtgcttgcttgggcgaaagaaaagagaccaagcgtaaagaatgcatggatgattaaagaagttgattgggaccaaaccaagaccttctccaagtattctttcatctcaccatgtcacttttggtccatagaagacaagagataaagttctacatgttttggattcggattcgggcctcctgacagcatcaacttcaaacggacccagtcacaaatctagaaggaatttcggggcccatgagtacttgttggaaagcttatggagtctaccttcagatggttttggttccacgtcaaactttctaccgagctactaggaatcagcaaaacaaaccgcgcacctcatccagtccgaatccaatttgtgttttgagccttgtaattgtgtcgtgggcttagcccaagggggtgtgcgccctagggcaaccctaggacgtccctaatcatacttaatcagtagccatcgtttagagtcaggttttgcttagattattctgttaagagcagtttcgccgctagatcggtttgtggaaccccaaattcgagtgcttaatcattcatatgcaatttggatgcaatctatcttgttcttgcttgtgttcttcgattcacatgcagggattagctttctcggcgaggtcaaccgggtttcggcgctattgataaccagaggatacgtggtgctgcgattgcgtggctcagtagcgtgttcgtttagaagccggatcgagttgtgtcatgactccgtccaaatcgactgtttatcaatacctatcagaagatcgggacctaacatcccttatcagtgatctctttaggttttcatacatacatatgtagcacattgggagtctgaatgaattctgggcaacgattttagtgtgtgctgttcctgggtttcaaggcaggttcaaacttgatatgaattagcccttcatctcctagcatctctccaattgcttattaaaaaaacagagggaacatatgtaagtaacaagacactacctaagcgtgaacaacatttagtttagccaagatgcttacctgtaattttcttttcttttgcaatccttgatacaatcaaagacgtatgcgtgcacgtacacgtgcatatatatgaatgcatatatttccatcacattatacaatcatagaaaggatgttattccgcactaattaagctgatgcttctcgcgatagagttcagtcccactaaatacacgtgtttgcgtgttggtgtgtgcattgttatggtagatcattgttacgactaattattatttcagtgatagacgatgtattcgtcaatagtgagatatctatagtaacatggtgaatctcaagctatgctggtcctcgaacagggtcggccctggccctatgcagctaaggcaaccgccgagggcccatgatggtggggggtggcaactctgaaaatttaaaatcctttgatgaagtgatctttggtcgcactgcaagatttttgcggaaatatttactcatgagaactcatccgatgttgagatcaatgatttttatttagaattaaaggtgttgcaaatgagtttgccagattccgcctgagattgtgaagtttgttatggatgcagattgctatccaaatatttcaattgtctatcgaattctcttaactgtacctgtgacagtagcttcaactgaaagaagtttctcaaaattgaagttgttgaagaactatttgagatcaactatatcacaagaaaggttaaatggcttggctatgtgctctattgagaaggatatcttagacactattaattttagtaccgttcttgatgattttgcatcaagaaatacccgaagaagtatcttttcatgagaagtaatagatatgatgtgatcctattcttcattaaggtaatgatattagtttcaatgtacaaatgtattgttattttggtcaactttatttctcgataattatcatacatgttaaatttaatgtatggatgtatttattttcgttttgtaagtaaaattagcgtatatatgtatatcataagattttatatatagcttagaggacccatcatgataagttcgccaatggccttcaaaatcataggaccggccctgtcctcgaagatatgcacatagtttgtagggtgtacatgcatatatagagagtgtgtatgcatttatacgagcgtatacatctattgtgttccaaaaaaaaagtgggtggaactttatataatcacccatgtgttgctttgcctaattaattagggtcaaactcgatgccaatcagaagcggatgtaggattggttgaaaggaggactgatcttctttctcttccttcagttcccctacgctcattccctttcctcttcttcccctgcattggatccgtctttgtgctagtggctttacaacacaacgcgactattgtggtaaatttctctctctcaatttgttatcatatttgattgattcacacctaaattaatgtactagtataggttaattatagtcattatttgcttctgtacatttgcgtatgcagtaaaccaaatattttaagacatgatattgtttgtttcagaaaataaatgaataaacatgtgacttgttagactctggacgtgtttagaatcaatttttttttcaaattttcaacttttccgtcacatcaaatatttggatacatgcattgagcattaaatatggatgaaaaaaaccaattacacagtttgcatgtatatcacaagacgaatcttttgagactaattacgccatgatttaataatatggtgctacagtaaacatttgctaatgatgaattaattaggctaatgatggaatctgtaatttattttgttattagtctacgtttaatactttaaataagtgcccatatacttaaaaaaaatttggcacacgaactaaacccaacctctatctagtgattgaaaattggattggcaaaatttgccctaggacatccaaaaattgtgtaattggctgagagacactgtaaaatctcgttgctgctgatagacaccacaaaatttgtgtaatttgctataggacacccgagacaatattttatcatttcttatcaaaaagaggagagagaaatttcaaaaagacaaaattgcccttagctctatctaatccccattgctggcagccgcttcccagcgtcgctcgccaaccgtcaccatcgaagccaccgccgccggctcgctgatcatcatcgaaactatcaccaccgcccgcttcctagcgctgctcgccgctgcctccatcaccacagtcgtcgggctcatcaaccatcatcgaagcagccgccgccgcccgctgctgcatcctctgtcacctccgccgccgcctccacaactagcgacaacgccgcctccaccgccggtgctgccgcctccacaacctgcgacgacgccgcctccacaaccagcctgatggcatgcgacattgttgttgggcgtcaccgtcaggctgagtgctagatgcgtgtaggcgctgaagatcccgcatgagaagaacgcccgcagcgacggcttgagcctcgccgcgccggcgccggcgccatccgatccaacctcctgaagtcggcctggagcagccgcgctcctggtgtggtcgcgctgctgagcccggccgtccttgcgtgcgcagcgccgccccagcgccgccccggcctctagctctggcaccacctctcgcatgaccgcgcagcgccgccccaaccaaggcgctgcaccagcccacgccatcgccagcgctttccctctccctcgggctcacttgaagattaaggaagaataaagaaaaataattcgaagggtagaaccgtacttacacagccgtttctctctcctattcctccaaaaataataaaataatgtcgcgggtgtccaggagctaataaccggttttttgtgatgttctacagcaaatacgtgtttttgcgatgtcccatagctaattacacgttttttggatgtcctgtagcaaattttgccaattggatttggagataagaagaaacagtcaccaagtaactaaatgttattgcattaattgtcacgctccgtatcagaagtacgaaataatatctctattttgaccaaattaataaatcgtgtagaatgtggaaaccacagtttaatgatgtcttgtctctaagaaaatcttcatctggccggcaggtttacaaccgaaagattattcaaacgactttaatttgtacttgaaaagtagagcttcgtcctctctattggttagttcaatttaatttcttcctaagagtggaaaacatagcgaacacatttacagatggagtaaacaaagactaatgaatcatagcagtctccatccgtcatattaaaatattaacacaacttaatttgcatctcgttttcatttttgatggatttgcctaatgcatgcgcaacaatgttcatactatcttttgtaaagtacttcaatgatagtccctccatttctaaatatttgacatcgctaacttttttaaatatatttaacctctcgtctaataaaaaaataaataattattaatttattttctatcatttgattcattgttaaatatacttatatgtatacatatagttttacatattttataaaagtttttaataagacgaacggtcaaatatttactaaaaagtcaacagtgttaaatatttagaaacggagggattataaagcaaatgcctgtctctttgcctgaaatttaattattcacgatgttccatatcaaagaaaagctacgactaaaataaattgcaaagctacatcacagacatgatgattacttgtttagtgatcctcttcaactcttaatttgaccgatcgataagcacagtttgccctaaaaaaatagaaaagaaaagccgtattggagaagacaaatgtgcatcataattaaccaattactggattgcttcaacggaaaagaaactaatgttggctgtttgcattttcagatgagctaagcctgctacaagaatcgcagatatatgcttcatataacacgtgagagagcgtgaagccatatctaatgttgtatttgagatagataatccttctacaggttttttttttaaaaaaaaagacagagatgtccttataaacatgattgaactatcacatttcttctagattgctccaacagtctatcattagttagctgcaaatttgctcatgacacgttgtcgcatttgttgagaagaaagataacagaaaaacataagagcagtgtctcttggtgtctcggtttacctttgcgtttttagttaaaatcgctttctcacagtgtcattgagaaaaccggcagaaaacacacaaagactgacttttttggtcaacaacgtactgagacaagctaaaaccaatcgagttttacaaaccgacaacaacagccagctgttttcaggaaatctgatcttgttgactgctttgtgaaccctctactctcagaacaagaagaagtctacacgtggtccgagtcaaatccgatccttgatgcggaagacaaaagaatgtatctgcactctgcatcacgaaatggctattatttcctacgattctaggcaaactggcctaatctttttcttactaaaaagctaatacccactagacatctaaagcctaagtatagtttttattagcactcttaaaaacctaacatataagtatgtcacatcaactcactaaatacataaagctcaacatacaaacatataataattatatctacaatttattccatttcaaaaactaagcatacgcatgctaaatcatgattctcaaattattttataatatttcaatccaaatcatttaatcatttctataatatctaacatatatcccgcagtcaaacgtgggacatcatatagtataaaaaacagttaatgtctagtccacatgtctacaaataaaaaatagaaaatcccttttttttaagaaaagacatacaattctgtctaagcaaaaattgggccaatatgggccgagaataaaggcatgggcctggctaggatggagaggtccaatggccttggcagcgcatctccaagttggcatgtaaagaatgtgcctgttccaaatattatacctacattacaaaggtcgcgctcgccatcccgcgcgcgactgaagacgtgttgcgcacagagaggaggcgacagacggcgcgtatggtttccttttttttttcctgtttttttcttccgtaccttttccagttttccttttttcttttttttcttctcgtatatttttccgttttttaatacgtatgtatgcaaactttgtatacgtataaatacaaactttatatacacgtatataaattttgtatacacgtatgtaaactttttatacgtgtatacaaagtttgtatacgtgtatttttgggttttatacatatgtataccaactttgtatacacgtattttttaggttttttatacgtacgcacacaaactttatatagatgtgtatatcttttatacattaaaagtgcatacatataaaaaattatttatatatacacacgtatatatatatagtatatacatacgtatatacatatatacatatagtacgtatagtagcgcgcggccgcgcgactgatcccccatattacaaatatataataaacaaatagcttataacaaagggtcaaaacaacttagaaatatttttttcaatgaaattatattttttaagcgtggagaaaataatccagggcaaattcatcatgtattaagttgaaaagaaggtattccctccgtttttgtttgacttttttctttgaccaagtttatagtaaaatatagtaacattttcaatacaaaataaacactgtatcaaaatatatttaatgttaaatttaatgaaactatgtatacaatgctaatttttttataaatttggtcaactctaaataactttgacacaataagacagtcaaaccacttgtaacatgtaacggaggggagggaataaaaaaagttttgttactttatacattatttaatagtgaactgtgaaagagaagtgaaagagggggcatatttgaacaacaaaacgatgacaaagagaggaggggtcacggggtgaaagaaagggaaaaggacgaattgtttaggagcatgtaagaaatatgaccgctccggcactccattcaaaagaatgtaattctagaaagagtcaagtgcacgggcggttcttaaacttgtagcgctgtgtcatctaggtctctgtcagggttacgggtcaggcataccctctacccttcgatatacgttacatatcgacatggcatacccacgcgcacgcggatgttttctacatattctaaggaaacctttcacgaaatctacagatgggaagagtccttctcggacagaactgggtcgtcgatatatcgtattgggtctaatatctctgagtcctacttggagacctctagatctgtgatataaaagggacccccccggggagggcatagatcattgaatcttagagccaacacaacccacacagcctacaaagccgaagtctgcaaggagccaagtcatcgagagctagtcgaatccactcaactacgatctcgccggatccgacaagttccatcattccctttgtaatatgtattttccaccatataatcccatatcaactcgattaggactattacctaccaagaggcctgaaccagtataattcttgtcttttgattgttcgatgtcgtactacatagatccttgtaccaacgtaccccaataccctctatatccggtctacgggtatcacccgtcgacagtggcgcgccaggtagggggacttgatactcaaggttctactactatgtcatccagcttcgtcgacaacaacgtcaacaccagcctcagccaagcgctccctgcttcaacaatgctggtatggactcaagtcggtgaaattgtcttcctggtttacaccacgacgccgatctcaactggtcctccaatgaccggaaacgagaacacagtggctacaaaccaaggcgactccatgtcgaaaaatccacccgtcaaaacggagaacggatcatcgacgacatccaagctcgggaaggattctgatacggccaaaccttgtccttccgacatgaaccacgagccggcaaaaatgacttccgaaaccacaaatccacaaaaccaagaaacacaccctgcaagattgctgggttttcctcaacgtccgtgctgaaattcgcgcctgcaaagaacgtggaattcagcgtacttctccaactcgggatgtctattgtcctattcacaagacaaataatcacgacctctcgagctgcaaagtcttcctcggcgccatgaaagatccgtctcctaagtcatacgtccccgtcagggataacggcaaggaacaaggagcgactctggcctcagatcgattcgttggggtaatcgatatcgatcctcacgaaccatcggtcttacatcttctcgaagactatgggtcatcgacaacgagcgtgccgcgggaggtattggctatcgatgacgtcggcacgtcagcgcaagccaacgcagaagcggcgaatcaatcgactactccagcccaacacatcagggccattcaagctatactgagggaaactccttacgatcccgttctgaacgatgacctcgagcgttggacagaacgactacgggaatcagtgaccaacctcagcaacgcgtttgaagaagccgctaccgcagcgcaccaagatcagccgccaactggcgacgccaatggtgaagatccggaacggagggaatcacctcaacgagccactcctccacctcacggcgctggcgatctccgagatcaaatcaacggccgccgagaagcacgacgcacacgagacaatgtaaatcgctctcggcgtcatgtctcttcacggcgccatgataacggaaatcgaggagaccgctcaaacgaggaccgggatcatgacaaccaccacgatcgcaacgatcgcgaacgacgggggccagacaatactggtcatggccgccgccgtaacgacgacgataatggagatcggcgccgagacaacagcgagagacaacgacaggattcccgagatccaggctgtcatcctcgtaatcgtacgctggaaccaagcgacccatcgtcatcatcatcatctgcgtcctcctcatcgtcagacagacatccacaaaggacacacgaccaccgacaacccaccgcccccaacgctgggtgcagggctttcggtcgttccctacgtgatgtccgatgcgagcaccgacccagaagaattccttcaagtctactccacagtactttatgttgccggagcagacgacaacgcgctagcaaactatttaccaaccacgttgaagggttctgcacgttcatggctgatgcatcttcctccctactcaatctcttcgtgggcaggcctgtggcaacaattcgtcgccaatttccaaggaacgtacaagcgccacgcgatcgaagacgacctacacgcgttgacacagaactcaggtgaatcattgagggaatatgttcgacgcttcaacgaatgcagaaacacaattcctgaaatcaccgacgcttctgtaatccgcgccttcaaatctggtgttagagatcgctacactacccaggaattggcgacaagacgcatcacaaccactcggaggctattcgagatcgttgagcgatgcgcccatgtggacgttgcggtaagacgcaagaacgacaagccgaagaccgggggagaaaagaaatcagccacagacgcatctgagtcaagcaagaagaaaaatcgcaaaaatgggaaaaggaaagctcaagccgaagtcctcgcagcagaatacgcgaaccctcccaagcgcccagacccacaaggcaacgacacaaagaaatcttggtgccccatacacaagacggacagacattctctggaagattgccttgttttcaaaaagtcgctcgagaagcacatggcgtttgaaaaaggcaagcgagtacgcgttgtcgagaagaacgaagagacggctcctcacgaatcggattctgcgtatccagactccgacctccacgtctcacacattttcggcggctccacaacgtactcctccaagcgagaatacaagaaagtggaacgtgaagtctgttcgacatggcggggggctgcacccaagatgaagtggtctgagcagaaaacagagttctcgaaagaagaccaccccaagaccgccgttatcccaggacgatatccgatcgtggtcgaacccactatttggaacatcaaggtagcgcgagttctcatcgacggtggcagctcgatcaatcttcttttcgccagtactctaggcgcaatgggacatccgcaaagtgagttgacaccaactgatcaacccttccatggaattactccctaatcatcatccagacctttgggcaagattacgttgcctgtgactttcggccgagccaacaacttccgaacagaacagatcaccttcgatgtcgctgaattcgatacagcttacaatgccatcatcgggagaactgcacttgcgaagttcatggccgcacctcactacgcgtatcaagtgctcaagatgccgagactgaagggaacaatcactattcagggaaacgcaaagctagcagtgcagtacgacaagcggagcctcgacatagtcgagcaaacgcccagcccacccgccacgactgagccacccaagaaagtgagcaagacaaataagacgccgaagccggacggtgccatcaagatcgttccactctccagtgccaatctcgacaagactgtcaagatcgaggcgacactaaacgagaaataggaactcgcgctcgtcaccttcctccgcgataatgccgacgtgttcgcttggcagccgtctgacatgccgggggtccccagggaggtgattgagtacaaactaatggtgcgacccgatgccaagccagtaaagcaaagactgcggagatttgcaccagaccagaaacaagccatacgagaagagctcgacaaacttctcaaagctggcttcatcagagaagtacttcatccagagtggctagccaatccagtcatggtgcggaaggccaacggaaactggagaatgtgtgtctacttcaccgacctcaacaaggcgtgtcccaaggatcattttcctctccctcgaatagatcaattggtggattcaacagccggttgcgagctattgagcttcctcgacgcttactctggctaccaccaaatcagcatgccaaaagaggacgaagagaagacatcattcatcacgcggttcggggtattttgctatgttaagatgccgttcggactgataaccgccaggaatactttctagtgcacggtccagggcgcacttagcaaccagcttggcaacaatgacgaggcttacgttgacgacatcattgtcaaaaccaagacaagtgactcattgattgacgatttgcgggaaacgttcgacaacctccgacgatatcgcctcatgctcaatcctgagaagtgcacgttcggagtaccgtcgggtaagctactcggattccttgtctatggtagaggaatagaggtaaatcccgagaagatcaaagcaattgagaacatgaattagcccacgagactcaaggaggtacaaaagctaaccggatgcatgacatcactaagcagattagtcgctaggatgggagaacgagcacaacctttctacgctctattgaagaaacaagacaaatttatatggacacaggaagccgaagaggcatttattgcactcaagcgctacctatcaaacccccctgtacttgttgctccccaacctactgaagaattattcctctatattgccgccacgccatattccgttagcactgtcattattgtcgagagagagaaagtacagcgatcagtttattacgtcagcgaagctctccatgacgcaaagacaagatacccacagatccaaaaactgctttacgcagtcatcatgacatcaaggaagctgcgccactacttttaagctcacagagtcaaagttgtatcctccttcccccttggagaagttgtgagaaacaaagacgttgtcggccgcattgcgaaatgggtagtcgagctaagccaatttgatgtccactttctgccgcgaacagccatcaaatcctaagtactcgctgacttcgttgccgattggactatgccagacaacaaatcagacaaccaaggcgacaacgaaacatggacaatggcgttcgatggcgcactcaacagccaaggaccaggggcaggatttatcttgacgtctccttccggagatcaattcaagcacgcaatccacctcaacttcagggcgaccaataacactgcagaatacgaaggactactcgcagggatacgagctgcagccgcacttggggccaagcgactaatcgtcaaaggggactctgagctagtcgcgaaccaggtgcacaaagactataaatgctctaaccccgagttatccaagtatctcgcagaagtcaggaagctagagaagaggttcgatgggatcgaggtccgacacgtctatcgcaaggacaacgtcgagccagacgacctagcacgacgtgcgtccagacgagaaccgctcgaacccggcacctttcttgatatcctaacgaagccatcggtgaaagaagttagcggcgaagttagcccgaacacccccgacatcagctcggaggtcaccgaggcagaacgcgccattgctgacatcgaaaccacagacgactggcacatccaattaatcaaattcatcagcagcaaggagttgcccgaggacgatacagaggccgagaaaataacccgtaaagcaaagatctactgtatggtcggtaacgatttatataaaaaagcgctaaacggggtacttctcaaatgcgtctctcctgacgacggcagacacctcctcctcgacatacatgaaggcatatgtgggtcacacgccgccggtcggacattggtcggcaaagcttttcgacaaggctttttctggccaaccgcccttaaagatgcatgcgacatggtccaacgatgtgaagcctgttaattccacagtaaacacacaaagctacccgcgcaagcgctccagactatccctctgacttggtcgttctcgtgctgggggctagatatacttgggccattcccacgaggacagggcggctacagattcctattcgtggcgatcgacaaattcaccaaatggatagaagcagtgcccacgagggaaatcaaggccgacaacgccatcaaattcatcagagggatattctgcagatacggagtaccgcaccgcatcataaccgacaacggctcccaattcatcagcgccgacttccaagattactgcatcgggttgggagtcaaaatatgtttcgcctcggtctctcaccctcaaagcaacggacaagtcgaaagggcaaacggcatagtactacaagggatgaaaacccgcgtctacgataggctcatgtcacaagacaaaaagtgggttcaagaactcccatcagtactatgggccgtacgcaccacaccgacaacgtccaataaggaaacaccattcttcctcgtgtacggctccgaggccatgctccccggcgagctacgacatcagagtacacgagtacagaagtattccgacgagaaccaggaggaacagtgagacatcgatgcaaatcttctcgaggagcatcgtgagcgagttgccgtccgagcagccagctatcaacagtccctccgccgttatcacgagaagcacatccgagcacgcatactttcgatcggcaactatgtcctccgacgagttcaagcccaagcagggtgaaacaaactctcaccaaaatggaaaggaccttacacgatcacacaagtcttgcggccaggcgcattcaaaatcgcagacggcgacggtcgcgaattagcaaatttttggaacattgaccaactacgtaaattctatgtatgagtcaataccactatacctgtaagtacccttacagtatcaataaagcctatttctaggccccatatcacaatcaaagtgttttcactcgatgatcccttactctgatgacacctagcgttgaaacctgtccttatatccctttatgccgtctcgacaaggcctccgaggaacctaagggatcttcggctggggacgcccagagccgataaggccttgttagatcctatagagacaaaagaccatgtaagatctggtcgtgtaagagttctcgccgtgcatattaaccaagccgtgaaatcggaaatcaactttccaacctcacggctgggggctaggatcaaagcttattcaaccaaggcaggtcaagggtccaagagccttatcctccgagaaaactcctccgacgacaaggttagggtctagggagagtgtacgactcaaacggcttaccaaagtcgttaactgagaacacactcttacacacgacgtccaaagtaagatacatttgtttaaggaatatttctttattcacaaaataattcttacagtttttacataaattttccactacattacatctttccctaagatatctgtgacagggcacgagtactaccaagaaggccaacgccagtccatagactggaagatcttctcggccagcggcgacatcgacctcgctagatggtctatctccgccggtgttctccgagaacgagcaaaaccatggcggagaaactcgaggtccaggcgcgggcggtgatctcgtaggcaagccagcacatgccctccggcgtatcggctcgctcgacaacactcttgcttcaaggcctcgtcgatatgcttgctgatgccatcgagttgggcacaggccccgtttagccaagagatgtacccggccgccgactcctcgggatcacagtggactactcgaagttccctgcatactctgaccatggaggcatagcaactcctcaagtaagagttgaaccacacctcgcgacctcggagcgtctccacaacctgctctttcttcacggccagcatggttctctcaagttccgccacttcaaatttcatcttccagtattggatacgacgatcttgatttgcaagggcaccctcgagatctgctaaacgtgacgaccactaagacaagctggatacctcctttacaacataaataacctaatcaggaggtcactaagaggtgaaaaggctactcacttgaggtggccgttgccatcccggcctccgcatcaagagtttgatccacattgtcagacgaaacatgtggttcaaaatcgagtaccggaatcatcgccagtgactcaggctgcccgcgctgctggacatcctcgtcatcaacatctctacaatggacaaaaactcccgagatcaacatacaaaattggacaagggtggtaatcgcacgaacgaaggcggccagagttcaagatttacacaatatataacaaatacaagaagtcctactcttcaaaaagggggagaacagactcccccagatcaccgacttcttccatcacctccttacgcgtgtcgcttgccgccccctgatccaagatctcgcgcagatctagttcaggatgcgacaatcttacacacgcgaggacgtgacacgccccggtgtagatgccgttcgacgtctcctccgcgatcctggccgcatgtttggaggggattttccccatcgccatcactagttccacaagagaggaagtcagcgaaaactcgtcgggattcgccgggatcgtggacttgacgccgcactcctcggcgagctgatggtggccagtataggtgacccacaacgagccacggatctcggagagattgttcccgagttccgacattcggtcctcgagccccttccgttgacgatcgttgccggccaccaactccctcatcttcgtgaggtcctcacgggcttcagctagctcgcgcaccaatctctcagcacgcacgttcgccgtcgccgcttccgacctcgcctccgagatctcgtggccgatgccgcgagtaccagctccgagaaggcgcccatctcgacttggagctcatcccaggtgagaacggccgctggcagaccacgacctgcagcgggatcgctgacggggccgctaggtgtcacctcccggctcccggtcatgggcacgacgcgctggaagctcccccggacatggcccgtgcggccttcgcccgcgcctccctacggacgactatgaatcaaacaccatttgaacgaaaagcacgagaatccaagaatctatttacttacttctcgccgatcgtcacaatgcgctgttgtcgtggaggtggaggggacgtgtctgaagcctgaaagacaatcaatacagagtaagaagaaaccctccttgctgcacgatctggcgacaagatgaaattaccgatggggtcgctgccttgcgacgatgtccgagtacagacgagaatttcctcgccttggtcgggactttgccaccgctagtggtggccgtatcatatgcctccttgacaaccttctcctttagagatgtcaccacctgatggtccgcgagcggcctgatgatgtcagtcaaaggaagggcctacgcttaatcaggtcataacgtgatttcgaaaggagaatacgagatgcttatcaaatacacttacgttgatggcttcatcgcgttccgccgcccccttttcacaaaggggcacggggatgtagctagccgtggtcggaccgctgatcatgtcacgtcccaaaacgaccctaaaatatatcctttaaagttatgcctagaataattaaaatccatgtgaaagcctccaaaaattaaaatgtgcaaagttaaaagtcaaataaggcttggaggatttttgtatatttcctaaaagcctaaaatgtgtaaataaattttagtggaattttcagagcacaaataataattattaagaaaaataaacaaagttgaaaaagttttataaaaagaaaaaccctaaaaagtcccccttccctcccttgggccggcctggcccatctttccccccgctctctctgtcctctcccccgcggcccattcggcctccctccccgcgcgcacgccgctgacaagcgggcccgcccgccaccatcgctgacgggtggggcccacccgtcatccccaacctcccgccgctcacgccgcctcgtccgtgcctagcgccgccgccgccgcgaatcccgccgcctcccgtcctccccgcgtgcaataaagtggggggaatcattccccgtgatcccctctccctttcccccatttttccctctctctcttgcgttcaaacgggcggatttgcccccgcaaatctcgccggcgccattgatggcggccggacctcccgcgccggtttccttcctcctcggccgccctctcccccttccaaccctatttaaaccctccccgcacttcctccgaccgtttccgcctctcgccgcccttcctcctcgctggattcgagctcgcgacgtcgctctctctctccgccgtcgccgccgagctccggtccgccgccgtcgtcgccccggaccgcctcccacctcggcgccgcctccttcggcttcgccgcatcctcgccgacctcgtccacccctccgtttcggtcgccgaccgccggagcgccgccgaccccgtcgacccgagccgcgccaccgcgtccctccgcttctgccgcctcctccgtcgccgccgtcgcctcggggtgagccgtggaccgccgcctcgtttccccctttccctcccctctctcggccgccactccgccgtgcctatggccgccgccggcgaccatagggacgcgggcgcgccgcctcccgccgaccgcgccggcatggccgccctcgggcgcgccgagtggctgccgcgtggggcccggccgtcagccgcccgcgccctcgggtgcggctgacgtgtggggcccacggcgccggccggtgtgagcccgggtgcacccggtccaccgtggaccgtgaggctgccgcgtgggccccactcccgtggacccggtccgcgcgcccctccccctcggctgacgcaataaaccctttttaaattaaattttaaatgaagaaaatcgcaaatattcatttaaagagcatataaacttcaaatggccataacttggccatttgaactcggaattggaccattcaagtctctattttttccttaagaagtgaagaacccatttttgtgctttgttcctgcttgttatatgaagtttattagagtaaaagcgttttctttt

SEQ ID NO: 79406 - DNA, 12555 bp, Oryza sativa
aaactcgcctttggatgtatgagcgtgccagttgatttgatcctgcaaacaacaagaaacaaagacagagaaaccatgattaaattcataaatgatagccgatcggctagatgacgatgacatatcatttatctttgagccgatgtcatgtgtaaatcgatcggcaattgttaagtaaacaaatcagaactaaatctactcaatcggctgtagatatcaatgatatataatccttatatcgatatatacttgaatcaagtgattgggatagatcggtcaccttgccgagacagtataaatcacctagatcgaaatatatattaataatgagattatatatatatattcatagcatagccgatcagatagatgtagcgtgtatcggctaatactgcgatactactttatattaagatattaaagcaaatagaatatactaaacaaaaatctaatatacttaaatgcaacaagatcttaacaagatggaagcgctaatctcgagaacacaagccgccataacaagttttacctcttgttgaagatcgaagccgatgcagctcaacctgaaagcaataactcgtcgagataaaatgaaagcaaaaagggtggcgatgcgccgaaattgtattgaacgtgtgtatgtttttattacatagggctcggggtctatttatacccgagaaatacaagatatgtccatattggacacgactcttatctctaacaaactctaagataccataagtctttgcggcagacttttgcccacattttatctctaaggaatttagataaaatatcctaattaatggatacaattgccttctcaggactctatccatgcgtggcaatcatcttgaagcacatcaactcgaacccaatgtcacacacgggtcgtattgtcggaatcggctgtatcacttaaccagtccaactcagacttagccgatcccagtcgtagccgatccaaactccagccgattcttactctgtttccgaaaatacccttatcttctattccgctttgatttcatcttcatctccgatgctgatattaccaaatttggttgttaacaccttgccactcaccgtcgcagacgacgcagctgcacccgagatggatctggtcgtcccgaggatggcaccgccggatctaccgcccttgtcgtgcgcccaccgcgacacccaagggacacctcctcgtcggcggcgccacctgtcatcagaggagaggagatgagagagagaggagaggagagaaacagagaaaggagagaaaaatatagagggagagaaagaaggttgaaaaaaattaaagtggtgagggaaagagagaggaggggataaaaaatgaggagttatttttgcatgcaaatcacataagaggagctatccattatctcttaactttacgattcaataacatgcatgtctagattaatctaggataaaagtactgcgaatttggataccatgtctaaatatgtagtcttagaacatatggtgtgtcagggttacggataaggtataccctctacccttagatatacgtcatgtatcgatatggtatatctgcgtgtatacggacgttctctgtacacgctaaggaaattcatcacggagtccatagatgggaggattcctactcggatagaactgggtcatcactgtattatgtagggtccgatgtctccaagtcctacttggaggccaactgacctgcggtataaaagggaccccccgggaggacccaaggcatcgaatcgtaccgccaacacatcgaccacagcctacatgagccaaatcgcctggtgatctagtcgaaccaactcgactatgatctcgtcggtatcatcgagttccactattccctttgtaatatgtgatttatgtcatataatctcatatcaactagattagggctattacctaccaaggggcctgaaccagtataatccctgtttttgttgcttgatatcgtattacgtagatcctcgtaccagcgtaccccaataccctctatatccggtctacgggtatcccccgttgacagtggcgcgccaggtaggggcctttggtgctcaaggttctactactatgtcatcaagcttcgtcgacaacagcgtcaaccctggcttcaaccaaggagtttctacttcaacaatgctggtgtggactcaagtcggtgaaatcgtcttcccggtttacacctcggtgccgatctcgactggtccatcaatggccggaagtgagaacgccgtggttacaaccctggacgactccatgtcgaaggatcctcccgctgaagtagagaacggaacgtcgacaacatccaagcccgagaaggatcctagtgcggccaaaatcttgtccttccgacaagaatcacgagccgacaaggacaacttccgaggtgacagggtcctagtgtcctatccacaaaaccaggaaacacaccttgcaagcttgctgggtttttctcaacgtacaagctgagattcgtgcctgcaaagagcgtgggattcagcgtacttcttcaacccgtgatgtctattgtcctattcacaagacaaagaatcacgacctctcaagctgcaaggtccttctcagcgccatgaagacgtcgcctcctaaggtccagcagttacaaatctctcttagggatgaggacaaggaataaggagcgacgcttgtctcagatcgattcgttggggtaatcgacattgatccccatgagccgtcagtcctacacttgctcgaagaatagggctcatcgtcaacgagtacaccacgcgatgtatttgctatcgatgggaccagcacgtcagcgcgtgctaatgtagaagcggagaatcaagtggttacgccggcccagcatatcagggccatcaacacaatactgagggaaaccccttatgatcccgttctgaacgatgatcttgcacagtggacagaatgactacacgaatcagtggccaacctcagcaacgcgttcgaggaggccgctgccagagcacagctagaacaaccgacagctggcggcgccgatggcgaaccacctgagcagcggacatcacctcaatgagccactcctccacctcgtggtaccggcaatctaaatgaccatctgaatggtcgccgagaagcacgacgcgtgcaagacaacgagaaccgttcccgacatcgcatctcttcacgatgtcacgagaacgaagagcgaggagacgctcgggcgaataccgagaccgtgataactgccacgatcacgatgatcacgaacagcagatgccgggcgatactggttgaggacgtcgccataacgatgacgacggtggagatcggtgccgggacaataacggggggcgacgacaggattctcgagatcccgaacttcatcctcgtaatcgtacaccggaaccaagtgactcatcatcatcgtcatcatcctcttcatcctcatcgtcagatagacatccacgaaggacatacgatcgctgacaacccaccgcccccagcgtcgggtgtagagctttcagtcgttcgctgcgtgatgtccgatggcctgagagattctaaccgggagcagaagtacgatgggagtaccgacccagaagaattccttcaggtctactccatggtactctacgctgccggagcagacgacaacgtgttggcgaattatttgccgactgcattgaaaggttctgcgcgttcatggctgatacacctctcgccctactcgatttcttcatgggcagatctgtggtagcagttcgttgctaacttcctagtaacttacaagcgccacgcgatcgaagacgacctacacgcgttgacacagaacccgggcgaatccttgagggactatgttcggtgctttaatgagtgcagaaatacaatccctgaaatcaccgacgcttctgtgatccgcgctttcaagtccggtgtcagagatcgctatactacccaggagttggcaacaaggcgcatcacaactactcgaagaatatttgagattgtcgatcgatgcgctcacgtggacgacgcactaagacgcaagaacgacaagccgaaggcagggggagagaagaaaccagccaaggaagcacctgaatcaagcaagaagaaaagtcacaagagtgggaaaaggaaagcccaagcggaagtcctcgcgtcagaatacgcgacaacgaggcatggacaatggcgttcgacggcacactcaacagccaaggagcaggggcaggattcatcttgacatcaccttcgggagatcagggcaaccaacaacttcagggcaaccaaccaacaccttcaggagatcaggggcacgcaattcaccttaacttcagggcaaccaacaacactgccgaatacgaaggactactcgctgggataagagcagcagccgcacctggagtcaagcgtttgatcgtaaaaggggattccaaactagttgcaaaccaggtgcacaaagactacaagtgttctaaccccgagttgtccaagtatctcgcagaagtcaggaagttggaaaaatgatttgatgggatcgaggtccgacacatataccgcaaggacaacatcgaaccagatgatctagcacggcgtgcgtccagatgggagccactcgaacccggcacctttctagacgtcctgacaaagccatcagtgaaacaggcaaacgacgaagatagcccagtcatccccgacgtcagctcgggggctatagaggcagagcgcgccgtcgccgacatcgagaccacggacgactagcggaccccactcattaaattcataagcagcgacgagttgcccgaggacgatgcagaagccgagaaaataacccgtcaagcaaaaatctactgtatgatcggcgacgatctatataagaaggcgccaagcggggtacttctcaaatgtgtctcgtccgacgacggcaaacatctcctccttgacatacatgaagggatctgcgggtcacacgccgccagtcgcacattggtcggaaaagctttttgacaagggtttttttgggcgaccgcccttaaagatgtttgcgaaatggttcagcggtgtgaagcctgtcaatttcacagtaaacacacaaagctaccagcacaagcgcagaccatccctcttacttggccgttctcgtgctgggggctcgacatactcggaccattcccatgaggacagggcggctacaggttcctattcgtggcaatcgacaaattcactaagtggattgaagcgacacccacgggggaaatcaaggccgacaacgtcatcaaattcatcaaagggatattctacagatatggattgcctcaccgcatcataacggacaacggctcccagttcatcagtatcgacttccaggattactgcatcaggctgggagtcaagatctgcttcgcctcggtttcttcccctcagagcaatagactggtcgagagggcaaacggcatatcactacaaggaatcaagacccgtgtctacgacaggctcatgtcacacggcaagaagtgggttgaagaactcccctcggtactatactatgggccgtacgtactacactgacaacgtccaacaaggagacacatttcttcctcgtgtacggctcagaggccatgctccccaccgagctacgacatcagagtacacgactacagaagtactccgatgaggatcaggaggagcagcgaaacgatgatgtcaatctactcgaagaacatcgagaacgagttgccgtcagagcagctagctaccaacaggcccttcaccgataccccgagaagcgcatcagagcacgcacgctttcaatcggtgactacgtcctccgacgggttcaaagccaagcagggcgaaacaaactctcacccaaatgggaaggaccgtacacgatcacgcaagtcttgcggccaggtgcattcaagattgtagacagcgatggtcgcgagttggtaaattcttggaacattgatcaattacgtaaattctatgtataaatcaatagtattcatacttgtaagacatcttacagcttctataaagtttattttcaggtaaagattacaatcaaagtgttccttcctgacgatcccttaccacgatgacacctagcgttgaaacctatcctactgtccctttacgccgtcttgacaaggcctccgaggaacctaagggaacttcggctggggacgcccagagccgataaagccttgtcggatcctgtagagacaaaagaccatgtaagatctggtcgtgtaagagttctcaccgtgcgtattaaccaagccgtgtaatcggaaattaggttttccaacttcacggctgggggctaggatcagtgcttgttcaaccaaggcaggtcaaaggtccaagagccttatcttctaggggctagggagagtgtatgactcaagtgagaagacactcgtacacaccgcatccagagtaaggaaacttagtaagatatatttcttttcaatttcacaagtacttcttacagttcgtaaaaattccaaaatatattacatgcctccctgagatatttgtcacaggatataaagactaccaggaaggccagcaccagtccatggactgaaagactttctccgcaagcggcgccatcgactttgccaggttatctatctctgcgagagtcctccgagaacgtgaaaaccctccgtggaggaactcgagatgcagctgcggacggcgatctcgcatacaagccagcacatgccctcaagcatatcggctcgatcgacggcactcctgcttcagggcctcgtcgatacgcttgccgatgccttcgagctgagcgcaggccctattcaaccacgagatatatccggctgccgactcctcgggatccccgcgaggtactcggagttccctgtagactccggccatggccgtgcaacagctcctgaggtacgagttgaaccacacttcgcgacctcggagtgcttccacggaccggtccttcttcacttccaccatagtcctctcgagttcggccacctcgaacttcgtcctccagtattggatgcgacgatctcggtcggccagtgcactctcgaggtctgctcagcatggaaacgactaagtcaagctgttcttctctctcgagaacacagcaaattaagtcaatcccgacagaagagcaaaggagatgaaaacaaaaaaaaaaaaccaacctaaggaagtcgtcgccatgcccgctttcatgggcaagttctaatctatgtcgacctgcagcacatatggctcgagcgcaagtgccggaacgattacaaacaactcaggctgtctgcgctgctggacatcctcgacatcgacatctctacaacgacaataaagtactcgggatcaaaatgctaaagaaaacgaaggtgatgactgcacacacaaaggcagttggaaccaacaagagttttacaagcacgactaattaaggagtacaggggaactgaaatcctactcttcaaaaaggggaagaacagactcccccagatcaccgacttcttccatcacgcccttacgcgcgtcattagcagccccctgatccaagataatctagaggtcaagttcagggtgcgccaaccttacgcattcgaggacgtggcacgccccggtgtagatcccgttggacgtctcctccccgatcctggccacatgcttggaggggatctcctccatcgccgtcaccagttccgcgagcgaagtcgtcagcgaaaactcatcgggattcaccgggatggtggtcgtaacaccgcactccccgacgagctggtgcaggccggtgtaggtaatccgcagggagccacggatctccgacaagttgttctcgagctccgacatgcagtgctcgagcccctgccgctgccgctcgttgccgaccaccagctctctcatcttctggaggtcctcacggacctccgccaggtcacgcgccagcttgtcggcgcgttcgttcaccgacgacgccgctgccgccttcgcctcctcaatctcgcgccctatgccgcgagcaccggcctggaggatgcgctccatctcgatttggagctccccccagatgaggatgtcagcgggcgggcctcgagcgggcacaaggccgcctgcagggccgctgggcgtcacctcacgactcttgggcacgaccatgacctttgtcgaagccgctgcaggagacgcactggagttctctccagacccgtcttgcgccgccttcgcccgtgccgccctgtgaaggattgccgtaattgccatcaagacgggctgccagagttcgatgaattaaaaaacctcaaatttgtctacttacttctcgccaagtgtcaccagcctctaccgtcgctgaggcgggggagacgcatccgaggcctgagtaaaacgagtacggtgtgaggacaatatcttccgactacacaataaatgaccaaaggtgcttaccgatggggtgggcgccttccgacggttcttcggaatgttgccgccactggtcatggcagcggcagcagcagtagcaacatcgaatgcctcctgggcgacgccctccttcaacgaagctgccgcctagtggtccacgagcagcccgaagatgtcagtcagagggagagcctacactacatgaagtcacaatgcgatcctagaagaaaaagataaaagggtcgtcaaatacactcacgttgattgcagtttcacgctcggctgtccctttctcgcaaagggggacatggacgttgctcgccgttgtggggccgctgatcatcacttgaccgacgcggctctccacggtttcgctgttcaaacctgtagatcgagaaccagaattcgataagtcaagaggaacatgcacataaggaatggaatccgaaatacaagaaaaataccccgaggagaaacccgggtcgcgtcctccggcctagaataatcaaaggctggatgggctcgagcctggagcggctggatccgcctaccaatgaagtcggcagtgacttcataccccgacaaccctcacactcggaggtcatcgatgatatcgatgaaggactgaagggagggggttaaggcgggtttgacggtccaagacgaaatcttgtctggttgttcctcagggacaacaaagactggatccgaattctctatctgaaaatagaaccacctcgcccgccatttgctatgagaaaaggggcactaaaaggggatgtatcgcgacttcaggccatcccgaagtcggaaaccgacacatccggacacctttttaggttccatccagcgcaactcgtagtagaaacgaaagagatcaagaaacggctctaccccaatgtaggcctcacaaagatgggaaaaaatactgaggaaggcgatggaattggggttcaaatggagcaaagaaagaccgtagaaattcaagacgagaagaagaaactcggaaggcggaggaagaaaaccacaaagaatatagtcctaaaccgcaaccatgcggcccaagacaggttcgggttcaaccatactaggacaggtatatacctcctagttctctctccatggtcccgcgaccggggagagcgtcgtcctcctgcagcttcttcagggacgcgccggtggaagtggacttgtcgagatccatagccgccggagatcgctgaagaagggactgagatgagcaagctagggtttttgcgggagcggagaagacgaggagcgcttggaggctggaaagtttttcacaacaggcggacttcaaaatggatcctcaaaactcccttaaatagacgcactaccgacagtatgaattccaaggaaaggagagagatggccgccggaaatttctagccccgttacgcgtggcagttttcggacttcaatttaaattcacttatgaccgttgaacttcgcacggggttgtcgattactccatgtctctacggttctcacaccgagatcgaccagtagagaacgacaataaccccgacatcagaagtcgcgatcggtcacatgagttcatttaagcagaagtcgggggctactgtcagggttacggataaggtataccctctacccttggatatacgtcatgtatcgatatggtatatctgcgtgtatacggacgttctctgtacacgctaaggaaattcatcacggagtccacagatgggaggattcctactcagatagaactgggtcatcactgtatcgtgtagggtccgatgtctccaagtcctacttggagaccaactgacctgcggtataaaagggatcccccgggaggacctaaggcatcgaatcctaccgccaacacatcgaccacagcctatgaaaccggagcctacaggagccaaatcgctgggtgatctagtcgaaccaactcgactacgatctcgtcggtatcatcaagttccactattccctttgtaatatgtgatttctgtcatataattccatatcaactggattagggctattaactactaaggggcctgaaccagtataatccctgtttttgttgcttgatgtcgtattacgtagattctcgtactagcgtaccttaataccctctatatccggtctacgggtatcccccgtcgacatggtgtatattatggaggcacctacaaatccctattttcttttgcaaaaatcgggcactgtttcaccaagtagatcggaattgtttcactaagtagatcgaaaatttttaatattttaaaaaaactgaaacacaaccaaatcaccttgtgaaacattttgctacaacgtacgaaacaatggttttcaaaaaaaatcgggcgttgtttcaccctatataaaaataatatttcagcaaatagtgaaagaatgtttccattcactgcaacatttgatctatacatagtgaaatattacgagtatacttgctgaaacattactagatgaacaaaaaataaaacggatttccttaatacaacgtttccgtaatatgcggatgatttgttgtaacggcgtgtgtggtggggtgcgcgtgtgtgtgtgggagggggggggacagcgcagaggcgcgggcggcggcgggcgcccgatcgctgccgttttcagtatattatctcatattaggttaaatatatagtattatctaatttctacatgccatctaagatctgagagacagacttaattaaaattagaataatgcattaacaatgttagtgtatgtaccgagttgcgtccacttgtacgtgccaacccatcgtgtcttgcactttggaatgcaggaatttcacaggaaatagttcggttcgtccaaattaaatttccctgaaattaatttctccaatccgaatatatagggcctaattatatatgctgaacgagatgaaccggccggtaatggcgctggtcagcagtaacagattggtaagatctgttggaatgcgcagcccatcaatctctgcgatttttttttccttctccagcttctcacgtggccgatcgacgatgacgtacgcgtatacgcctgcatacaatgcatgacgagattttcaccagaaggagagcctagcttagctagcagctagatagctagattatcgatctactggagtagctaggacggcgacggccggccaccatgtgcgtacgtgcgttgtgtctcccgcggacagaccggtaaaaacgacggtagagtgagtgatgagtgatcgttgaggttgacgagccgagtggggtcgtaagtacattttacccactccaatcatttatttaagagtaaattttactttggaccatatttattgaccaaaattttacattgggttagggctagactcatgttttcgcttaacaccacgtataattaccgttctttgaactttggacctgattttatagttaccatcacacgagttgttatctaggtgcttagcattttacaagaaacaatgatatggaaatttttgccatgcaaatatgcttagcacaagaacaatgatgtaacatgttacaggatatcctatcagattaatgggacttcattactactacatatgaacattcacaacccttatactatagacaaaattggagaaatattgagtttaagaactatttttttagaaaagatattacatgttttacaaacccaactgtagtgttagtacaaattgttgaattctaagttttctaacacaaaaaagaaatgagatcagctctacgatcattatactatgtgtaatttgtgaaacccggtccaaagtgcaaatgatggtaactatatatggtgttaagtgaaaatataagtctaattctagtccaatgtgaaaatttggtaaataaaggttgaccaaagtgaaatttactctttatttaaagagagaatatcttatataccactagtctaatcccttttatgccattaaaaattagcttttcccctatataccattgttcaaaatttgcacatcctctcatgccactcccgtatgttgaccgttaactctaagtaaaaaagatacatttgcccttctgaatataggatatgtctaacaactcagaagggcaaat

SEQ ID NO: 79407 - DNA, 6612 bp, Oryza sativa
  unsure (1)..(6612): unsure at all n locations
aatgtggaatggttggctgggttgggcttnggacgagctaggacccaaggtcgggtgcccagttcggtctgaatcatcgtagccctggggttaagccaggttcgtgtgggttcacgcccttgattaataatattgtatacctctagggtcgtatttataaaatagctttgagcaaccaagtgtcttttaatgctgtttactgcaaaccctaacccctatattatggctcccttgtactcccttgcatttattctgcacttatggatgtgtcttgttgagtacggtggttgtactcagtcttgctcaatttttcccaaacccagaagaggagttcctggaagatgaaggctttggtgtctagctcatgcctgccgtcaagcgcctgtggtcgtcgccctagtcttccgctgtttttcgtttgtcttcttgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttatttccggtcgtgacaagttggtatcagaacctccttgaccctagaacgagctttagatcccaagccttagcaatattttcgaaataaaaatccttccttatttgtgaaaatcctctagtctctctctgtcctgctgcttcatttatcgtcaaaatctgatctttaaaatgttgcttttctcttttgtttttgtttgtagatggccggcagcatcaaccgtcgtggcctggacctgactggcttcgttttggagctgcggagcatgtgcgttgtcctagggtatccgcatggagtggactaccagggcaaacagctcccggagcaggagggtgacgatgcagagccccacgctatttgggaggtcactgcagtgatcctcactggctcacccgagaggactttattggcagtcaccgcgggtggagattctttccccgccgcttgccagaacgccgcactcctcgccatcggcactcttcaccagcgctacccggacgagttgcagcactcgccgtaccgctaccaccctcgtcgcggaggagcccgtgactacgccaccttcagggatgctagctcggaggatgacgctaccatcatgcacctggcacgcatggtggaggcgtatgacgcagcccgtatcgacttccatcatatggtgcgccgtgggttggtcgagaacaacatgaagatcctggagctgcgtcaggagaatctgcagctgaagaaggacttggacgcggtggaggcgcagctgtgtcagctcaagatcgcccaatgagaggtctgtcgccccaagcaccgccgcgtctgccgcagcatgaagatcaccgcccgcaagagtacctccaggcccgagcttgttcgtcagtccttggcatggacctgcttcgtcgagacccctcgcgccgagcccgcgccctcggttcattaggaggcgggagcctctggcgttggcagcacggaggatgcgctgctgctcaccttccgccctggcccgtcgcagaagtaaacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaaccaatttaatagcagtaataaattcaagaattatggtggtcgtgggtggttagttttaatagtcagctctctctgtttgccggttctgtgtgggattttcagatggtgacaaccaggagaagtgctgctaccggtgaaggcagtcaccccgaaggcagcaaccacaacaaccatggcagcccacctccacctcctcccccgccaccaccaccaccaccaccagacaccaactccatcctcacccaaatcctcgcccagcaggccaacatgatggctgctttcctccatcacatccaaaatccgccacagcataatgttccacctccatcaccacccccgcaacattctaaactcgccgagttcctccgcatccgtccgcctaccttctctagttccaataaccccgtggatgccttggattggttgcatgccgtggggaaaaagttggataccgtgcagtgcaacgatgaggaaaaagtcatctttgccgctcaccaactgcagggacccgcatctctatggtgggacaacttccaggctatgcagccagaaggacagcctattacttgggcccgcttcaccgccgctttccggaggacccatgtgcccgccggagttatggcccttaagaaaagggaattccgggagttgaagcaaggcaaccgctccgtgatggagtatttgcatgagtttaacgacttggcccggtatgccccagaggatgttcgggaagatgaggaaaagcaggagaagtttttggcaggaatggaccctgagctgtccgtgcgtctggtctccggggattatcctgatttccagcgtctggtggacaagagcatccgcttggaagccaagcacaaggaactggagtcacacaagcgtcgcttggcaaatttccgcaatcaacaaggggctaaccaaaggatccgctacaccaatccctatccagggggatcctcctcgcagcagcagcagcagcagcaaccacgctccgcgccccgacctcaattcgtggtgcgtgtcccacagccgcagcaacagcagagtcagcaagggacccgtgcgccccgtcctcatgtgccagccgtgcagcctggacaaggccgcagagacgctcaaggtcagcagcgtctgtgcttcaactgcttcgagcccgggcactttgcggataaatgcccgaagccgcgacgccagcaaggccaagcgcctccccgccccaacaacggtggtaaggatgtcattcggggtcgtgtgaaccatgtgactgccgaggatgtgctgacgactccggacgtcatcgttggtacgtttctcattcattccatccctgctaccattttgttcgactctggagcttcccactcgtttatatctgtgccattcatggggagaaatcagttgggggtagaaaggcttaggaaccctctgctcatcaccacccctggaggggttatgacagcaaagtattatagccctgccgttcctatagaaatccagggaattcctttcccctcggatttgattcttctagacaccaagaacttggatgtgatcctcgggatgaattggttggcacaattccaaggagtagtggattgcgcaaggcgcactgtcactctgtaccgggggcctgatcaaccggttgttttctttgcacccccaacctctgtcgacaattcagaacttcatcagattggactgtcaaaaatccccatcgtccgtgagttcggagatgtgtttctggaggaactacccggtatgacgcccaagcgagagattgagttccggatagatcttgctccaggaaccactcctctatacaagcgaccctaccgtatggcagccaatgaactggccgaagtcaagagacagttggaagagttgaaagaaaaggggtatatacggtcgagcacttccccctggggtgctcccgtgatttttgtggagaagaaagacaagacaaagaggatgtgcgttgactacagagctctcaatgaagttactatcaaaaacaagtaccctcttccccggatcgatgatttgttcgaccagcttaaaggtgccactgtcttttcaaaaatcgatcttcgttccggatatcaccaattgcgtattcgtgaagaagatatcccgaagaccgcattcaccacgcgatacggactgtatgaattcacggtgatgtcgttcggtctgaccaatgctcctgccttcttcatgaacttaatgaacaaagtgttcatggaatacctagataagtttgttgtggttttcattgacgacatcctggtgtactcacaatcagaggaagaccatcagcagcatctctgtctggtgttgggaaagttgcgggaacaccacttgtatgccaagcttagcaagtgtgagttctggttgtccgaagtcaagttcctagggcacgtgatatctgctaaaggagttgctgtggatcccgaaacggtgaccgccgtcactgattggaagcaacccaagacagtcactcaagtccgtagctttttgggtttggccgggtactaccgaagattcatcgagaatttctccaaaattgccagacccatgacgcagttgctgaagaaggaagaaaaatttgtgtggagcccgcaatgcgagaaggcgttccaaactctcaaagagaagctggtttcctcgccagtgttaatcttaccggatactcgcaaggacttcctggtgtactgtgacgcttcgcgccaaggattggggtgcgtgctcatgtaggaaggccacgtggtagcctatgcctcacgccagcttcggccccatgaaggcaactaccctacccatgatttggacttggccgctgtggttcatgctctaaagatctggcggcactatctcattgggaatcgctgtgaaatatatactgatcataagagtttgaaatacatcttcactcagtcggatctgaatcttcggcagaggagatggttagaactcatcaaggattatgatgtgggaattcactatcatcctggtaaggccaacgtggtcgccgactctctaagtcgaaaaagccgttgcaacactctcggcgtccgtggtattccactggaacttaatcaacagatggaagccctgaacctaagcatagttggtcgtggattcttggctacgctggaagccaagcctaccttgcttgatcaaatccgcgaggctcataagaatgatccagatatgcatggactcctcaagaatatgaaacagggtaaagccgctggtttcacagaggatgaacacggaaccctatggaacggaaatcgggtatgcgttccagacgacagggaacttaaacagttgatactttaggaagctcacgaaagtccttattccatccaccctggcagtacgaagatgtacttggacttgaaagagaaatactggtgggttagtatgaagcgggagattgcagagttcgtggccctttgtgatgtgtgccagcgtgtcaagggagagcaccaacgaccggccggacttctccaacctctccaagtaccagaatggaaatgggatgaaattgggatggatttcatcaccggacttccaaaaacccagggcggttatgattctatatgggtagtcgtggatcgactaaccaaggtagctcggtttattcctgtgaagactacctatgaagggaacaaactagccgaactctactttgctaggatcgtaagtctccatagcgttcctaagaaaattgtatctgatcggggaagccaattcacctctcatttctggaagaagctccaagaagagttgggtaccctattaaatttcagcaccgcgtatcacccgcagacagatggacagaccgagcgtctaaattagatcctagaagatatgctttgggcatgtgacctagatttcgggaagacctgggataagagtctcccctataccgagttctcctacaataacagctaccaagccagcatacaaatggcaccctacgaagcgttgtatggctgcaaatgccggacaccgctattgtgggaccaagttggggaaagccaagtgttcgggactgatatcctgagagaagctgaagataaagtcagaaccattcgggataatctaaaggtggcacagtcccggcagaagagttatgcagataaccgacgccgtaacctggaattcgcagtggacgattttgtgtacctatgggtcacgccattgcgaggagtacacaggtttcagacgaaagggaagctcgcacctcggttcgtgggtcctttccgtatcattgctcgacgcggagaagtagcttaccagttggagctgcccgcctccttcggcaacatgcatgatgtgttccatgtgtcgcaactcaagaaatgtcttcgagtgccatccgagcaggccgattcagagcaaattgaagttcgcgaagacttgacctacgtggagaggacagtgaaaatcctggacaccatggagcgcaggaccaggaactgggtaatccgtttttgcaaggtccaatggagcaaccacgctgaggaagaagcaacttgggaacgtgaagacgagctgaaggcagcccatcccgatctcttcgccagttcttccgaatctcggggtcgagattccgtttaagggggtaggtttgtcacgtcccaaaacgaccctaaaatatatcctttaatgttatgcctagaataattaaaatccatgtgaaagcctccaaaaattaaaatgtgcaaagttaaaagtcaaataaggcttgcaggatttttttatatttcctaaaagcctaaaatgtgtaaataaattttagtgcaattttcagagcacaaataataattattaagaaataaacaaagttgaaaaagttttataaaaagaaaaaccct

SEQ ID NO: 79408 - DNA, 1861 bp, Oryza sativa
attttttagaaaaaaatgataattaatttattatttgacggcaaacattgattggtcatagctatggataattcctcataggaaattgtgattccatagtgaaagagaaaaaacttaagttataaaagacattacatacacaaaccatatataattaatggctctactgatttatatagaaaaattggtaattaatttattaaacataatatatgaccctcgagtttagaccattatttgtaaccattggatatgtagaagatctaacatattgtgtagagtccaactaagcaaattattcgtcttccctcaccatggatggtagacatgttaattcgtgtctccggcagcatgctcacatcatcatacttagaagaaaaaaaagtgcccttcatgtatatacatgtaactacctcatgcccctcttttcattaaagaaaaaaagttctatacccatgcatgcacaccgggatgcaccggttagccctccaatttgttcactccatggacggtatgttcctttgttctagtgattagataatttaataagtacaaataagtatttgaaatcaatttttattagtaaaatatccataaggactgatctgtagacaccctctgttcttcttcttttcttggtgtattagttggatttaagcaacgtgatataggtattttgggatataagttaatgtccaacttccaaaggattaaggtttcccaaccctcagcaccgaacacagcataagatcgtacatttatccttaaaagaagatcatatattttatcagggcattggaattaagtaaatagcatccacatatatgtcgagagaataattaagttggttgtgagtcaataggtccattgatgctataattaaggttaaggttagcggtttataagttattttgattttattaaaaaactaagttggatattttgatttgtaatgagaacatttaggattttttgcgtatggatgtgggtccaaaatataataattttattagcaattaaatatggttggtatagatattaaactattgatttaattaaaaaaacacaatggaattaaatatggttggtatagatattaaactattgatttaattaaaaaaacacaatggttcaaacagatcataaattgaatatataatttaaaatttacagctattgaagattctttatttatttataaaacataccaagatcaatatgtatgagatatattatttatacctatatttgcaagtgtatgcaatctttgaaagtatgataaaattaacttactaatatagaagatattatatacccttaagccttaacttaattaccatcgaaaaaagggaggcgagcaaggaaaaaatcacacagactcttatcatgcgtatggatggaagcatgtatatgtgttgggcggactcgtaccgccagattgatattaagttttttactaaagataaatctaatggtatctgatggtaaaaaaaatattaggtccatcagattaaataaaaccaatggttagatgttctcctttttccatagattttctacgaattaattagagcgttaggtgtcatctttgcactgtttcttggaatctcacgtggcagtttaggagctttttaggatgtttaatggacttttatataatagatagatatatctacgtgggtttgtgaaatttactccataatatatatttccatttttaatattttgtttttatttggttgcattgcaaagaaaaatagtatatattcaaagttaggaaagcgtttttcttatataaagatttgataggttcaccggtttaaaccatctatatacctaaatctaatggttttaatgtttg

SEQ ID NO: 79409 - DNA, 2135 bp, Oryza sativa
gtggggccaggccgtcagccgcccgcgccctcgggtgcggctgacgtgtggggcccacggcgccggccagtgtgagcccgggtgcacccggtccaccgtggaccgtgaggcttccgcgtgggccccactcccgtggacccggttcgcgcgcccctccccctcggctgacgcaataaaccctttttaaattaaattttaaatgaagaaaatcgcaaatattcatttaaagagcatataaacttcaaatggccataacttggccatttgaactcggaattggaccgttcaagtctctaatttttctttaagaagtcaagaacccatttttgtgctttgttcctgcttgttatatagagtttattagagtaaaagccttttcttttccgttggtcttgtagacgctgcagcttcagaagatccgctcttcgtggaggttgaagccgacgtttaggaaagcgagcaaggcaagtcacatcatccttgaacatattgaatcccaatttataaaattattttgatttaaattattgcattatcgctttatttaaattcccgcgttatcactgttttatttagccatgcctatttacctttgttatgatcttattattattgctattgttattattaccttgttcaccctagaataaacaaaaccccaactagtggacactctactcatggtaccactagtatgaatttaggtagatgcttcgccgcttaattaggcaacattaggtggttttacaactctagactttaggaatattcatatcacctggacattatggaatggttggattattgtggaattggattcacacctccccctctattcaaaaccctcaaaatggttttaggctgggctcggggtgcatggttttgatagtagcacctcggccatataaggaccggtctttgggcctctgttgcaaagcactaccgtacttccatatgtctagtgggtaaggcttagtttgtggctcagtctggttataaataaaagtacacggatggagatggacgaagtcggggatcgatggacatctctagggcaaatgaaggctacacgagctgcggcccggtagtcgagatgtcatggcacagggccggtgtcctgctgctaggggctcagttgtcacaccctaaaaatcctaaatatataaattgttgtttaattagaattattagaatttattttaaaagtatagaaaagaagatctaattttaaataataaattccaatataaaatggggccagataaaatttcattaaatactttgcttaattctataattcctagatttttctgagatttatttgagctaaggaagtatttttaataaatggaattgcatttcatgaataatttaaattgaaaaaggtttttaaaatcctcttttggctttgggccgaaagtcggcccaaaaccttctttctctctccctcggcccagtcggcccagtcagcccgcagccgcccgcgtgagcgccctcggccgctgacaggtgggtcccacctgtcagactcgtcgtcctcctcgcgccgtcgcccagccagaaccctagccgagctgcgtcgccgtctccttccaaattcgctcgcgcctttccttctccagtgaaatcaattgaggggaaatgtttcccgagatctcctctaccttttctcttttggaatcgtcggctaaatcgtttggaaatccgtggattcgagttcgattcggatcgatctctctcctccgaaccctaaactttccttcgcgtcgccggtcgccgtgggccttcgccgccgcctccttgcccctataaaaggacccccaagcccaccgctacctgccgcaccctcgccttcgcctctcgccgcccgtagcgccctagccccgtgtagcctagcgccgcagtcgtcgccgttcgtccagtcgtgcgccgccaccgatcccgtcgtcgtcgttgctcgggaaagtcaccgtcgtggtcggcgtcgcgtcgccgtcctcgtccgcccctccagcgctgctttagaccgccggagcaccgccgtcgtcgtcaagccgaaggttgccgccgcttctttctcattgctgtcgccgtccgttgatcttccgccgccgctttggtcaccggtgaattcg

SEQ ID NO: 79410 - DNA, 10620 bp, Oryza sativa
aagtggaaggaaatcggtatggatttcatcactggtctacccagaacatcattaggccatgactctatttgggtgatagtcgacagacttaccaaagtggctcatttcatcccagtaaagacaacctattccggaagtcggttggcggaattgtatatggcaaggattgtgtgtttgcacggcgtccctaagaaaatagtgtctgatcgaggcagtcagtttacttcaaagttttggaagaagcttcaggaagagatgggttctaagctgaactttagtactgcttatcatccgcagacagacggacaaaccgaaagggtaaaccagattttggaagacatgttgagagcttgtgctttagacttcggtggaagttgggataagaatttgccttacgccgaattctcgtacaacaacagttatcaagctagtcttcagatggctccttacgaagcactgtatggtcggaagtgccgcactccacttttgtgggatcaaacgggagaacgtcaggttttcgggacggatatcctgagggaagcagaagaaaaggtgaaaatcattcaagaaagattgcgtgtggcccagtctcgtcataagagttatgccgacaatcgtcgtagagatctaagttttgacgaaggagattatgtgtaccttcgtgtcacgcctcttcgaggagttcatcgttttcacaccaatggaaaattggcaccgcgttttgtgggaccttataagattgtcagtagaagaggagaggttgcttatcagttggagttacctcaatctttggcaggaatccataatgtgttccatgtgtcgcaattgaaaaagtgtttaagggtacctaccgaagaagctaatcttgaacagatagaagtccaagaggatctgacctatgttgagaaaccaatccgtatcttgaaaatagatgagagaagaaccagaaatcgagttatccatttttgtaaagttcaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctaaaaatcctaaatatataaattgttgtttaattggaattattagaatttattttaaaagtctagaaaagaagatctaattttaaataataaattctaatataaaatggggccagataaaatttcattaaatactttgcttaattctataattcctagatttttctgggatttatttgagctaaggaagtatttttaataaatggaattgcatttcatgaataatttaaattgaaaaaggtttctaaaatcttcttttggctttgggccgaaaaccttctctctctctccctcggcccagtcggcccagtcagcccgcagccgcccgcgcgagcgccctcggccgctgacaggtgggtcccacttgtcggactcgtcgtcctcctcgcgccgtcgcccggccggaaccctagctgagccgcgccgccgtctccttccaaattcgctcgcgcctttccttctccggtgaaatcaattgaggggaaatgtttcccgagatctcctctaccttttctcttttggaatcgtcggcttaatcgtttggaaatccgtggattcgagttcgattcggatcgatctctctccttagaaccctaaactttccttcgcgtcgccggtcgccgtgggccttcgccgccgcctccttgcccctataaaaggacccccaagcccgccgctacctgccgccacccttgccttcgcctctcgccgcccgtagcgccctagccccgtgtagcctagcgccgccgtcatcgccgttcgtccagccgtgcgccactgccgatcccgtcgtcgtcgtcactcgggaaagtcaccgtcgtggtcgccgtcgcgtcgccatcctcgtccgcccctccatcactgctgtagaccgccggagcaccgccgtcatcatcaagccgaaggttgccgccgcttcttcctcatcgctatcgccgtccattgatcttccgccgccgctttggtcaccggtgagttcgccgtgccgtccgctacccctaggtgctctccgttcgcgctgtcgtgccgtcgttcgccggcaagcatgcacgcccgagccgccgccggtggtggcgtcaccgctgacgtcatcatcgtcgtctcccgtggtcctgccgtggaccggtcgatctcggccgttcgttttggatggaaagatctcggccattcgttttcgtgagccgccgccgtgcacccgattcaccgcgaaccctagccgctgacgcaataactcgcttttccttttcaaaaataattcattattgcgtcataattcaattaaaatctaaataaatgatttaatccgatttaatctttgaaaattcataactaattcatcttagctcggatttagttggttcaagtctctaaatttttctaaaattgagatctacatgttaaatatatccacatgtactgttcatgcttgtttatgtgctgttttggtgattttgctcctttctgtttagattccgacgtttccggagagtccgtttttataggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctatatatattggttcagctagatattagatatgattgcttagccatgcttagaaacattagcacactattgggataacttatgactcactattatttaatgttggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcactggggagtccatgccttgtttataagggggtgattatgatccaggaaaggtgcgctgtggtggattgtgttgtgcgaggggtactgtcacagctcctttccaaggtactgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcatcataataaaagatgctataactggtaataatttgattagctcctggtttggaatagtatattcctggtttggagatagatctgtacagccgggtatggttgttcgggatggttgggcctgagcagcatgggtgtgctgtttagtgttgattaaaattgatgattaattactctactgttttataattctcaaatgtttgctaaatgctgcttttgcaaatgagccctatattatgccattctttggtatccttgtgcacttgcatatttgctacgtggcttgctgagtatgtcatatactcaccttgcaatcattcatcagaggaagagttctacagtgatgctgatggtgtggaggattaggtgtagccctggtcaagctgcctgtggagtggagtcgtctgcgccatttatcttttttttttctgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccaggcgtgacaagttggtatcagagcctccttgaccctaggttatgccaaatggttacccatagaagccctctaaaaatattggaaaagtagaattgttctcctccctttctcttttaattaaaccaaactaatagcacatgcacttcataatctcttttagtggttgtcattcaaaatttattccagtgttgttagtactgtacatctaatactgtactaatggctcatttaccagcaaatgttttgcaacattgttttattttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggttttgagggatttgtccaggagttgcgtaccataggatttgggactgcccctttgtatgcccagattcctcatgatcgtcacgaagagaagtgccgagtcaaagtcaccttgaacagtaatagtgaagatatcccatcagtgatgttcgaagctggaggaggaaactacatccatgcatgtcaggaggtggcaaggatcgccataggagagctccgcgatcgctacagtgatcagttggctgacactgagtatcgctaccatcctcgccaaccccagggaagtgaccgtggcagctaccttgagactgaggggattgagaatgatgctaccacaaggcatttggttgagatgctgtgggctatggatgaaacccgcgcggaggttgtgctagcagctcaagatcgtgaagaccggaatcgtggtaagatttgcaggctagaggacaaggtggatcgtttgaagaaggaactagccgcgttgaagggagaagcaccaccgcagaaggccaggattcatcttaccgcaaggaagagagctctatttgtccctcgctaccaattggcgccaaaggtccgtgtggtggagaaagaagttaccccagccctagcggatcctccggtcgtcaatgtaagtgatgatgaaggagaagaatcgaagcgcacccattcaaaggtcgagtggggagctactcaagatgatggagacgagccgaacgagccttcaatcaacttcgatgcccggaagacctagagtgccttgttaagccgttgtcttagatcgttgtgttagtttgttcgtttaagtttggttgtgtgtgtctcacatgtgatttacattagtggtgggatgtaagtgcatgcgtttgtttgcttttgagtgttaggaagttggtgagtttagtggtgtgagagtcttcagttttgtaataatgaaactcagttaagatcagtaaaagttaagttagtagaaaaattaattctctgtcctaagtagtttccccggtttctcttcttgtgatcctgcccatgccagatggtgctcactcgcagcaatgggaatggtcccaacaacaccaataacaacaacaatggagagaatcccacactggcccaagttctggctcaacaggcacagcttatgaacatgatgatgcagcaactccagaatcagtagaaccagggaaataaccatgcacctccccagaacaagttagcagaatttattcgtgtgaggccgcccactttctctagcaccactaatcctgttgaagctggcgattggttgcatgccatagagaagaagttggatttgcttcagtgcactgatcaggagaaggtctcatttgcatcacatcagctgcatggccctgcctctaagtggtgggatcacttccgccttaacagaactactgctgaacctatcacttggcttgaattcaccgctgctttccggaagacgcatataccatcgggagcggtgtctctcaagaagaaggaattcaggtcgctcacccagggatctcgcacggtcaccgagtatctgcacgagttcaaccgtctggctcgttatgctccggaagatgtgcgcactgatgaagagcgccaggagaggttcttggaaggacttaatgatgagctttcttacccactcatgactggggattatcatgatttccagaagttagtggataaggctattcgccaggaggacaagtacaaccgcatggagcagaagaaacgccggattgctcacttcaaggcacaacaggggaatagtcagaggccgcgtcttactttaggaccccagtccatgccacagggaggttcttcgtctgttgttcgtccgcagtgtcagttcttcaacaacaatgctggcaacaacatccgcaatcaagctccacgccctgttgcagctccaacacagcaacagcctgccaagagggagcaaggtagcaagcccggggtgtgcttcaactgtggagacccaggacattactctgacaagtgttcgaagccccgacgcgtgaaggttgtcccggcccagagcaactctaccgcaccagcatcaaaggctcgtgtcaatcatgttgctgctacagaagctcaaggtgctccagatgtgattttgggtacgttccttgtcaactcagttcctacaacagtgcttttcgattctggtgctacacattcatttttatctatgagttttgcgggaaatcatgggatggaagtagaagatcttatacgtcctttgatggttagtaccccaagtaatcaagcactctctttgcaacgtagcccctctgtcagaatagaaattcaagaagtaccatttctggccaatcttatcctgttagaatccaaagaccttgatgtcatcctagggatggactggttagccagatataaaggtgtgatagactgtgccaacagaaaagtaactctcaccagcaatgatggtcgagttgtaactgttcatgcattgtcttctgagtctttaaggtcaagactgaaccaaatgactttggaagagattcctatagtccgggagtatcccgatgtgttcccagacgatttacctggtatgccgcctaaaagggatatagagttcagaatagatttggtaccaggaacaactccgatccataagagaccttatagaatggcggccaatgaattagcagaagtcaagagacaagtagatgatttgcttcagaaaggatacatcagaccgagttcatctccatggggagctccggttatttttgtggaaaagaaagatcatacccagaggatgtgtgtggactatcgtgcactaaatgatgtgactatcaagaataagtacccgctgcccagaattgatgatttgtttgatcagcttaaaggtgccaccgttttctccaagatagatcttcgatcagggtatcaccagttgagaatcaaagaggaagatatacctaagacagcttttatcactaggtatgggttgtttgaatgtactgttatgtcttttggacttaccaatgcccccgctttcttcatgaacttgatgaataaggtgtttatggaatacctagacaagttcgtggtggtctttattgatgacattcttatctactctcgaacaaaagaagagcatgaagaacatcttcgccttgcactagagaagctacgagaacatcaactgtatgccaagtttagcaaatgtgaattttggttgtttgaagtgaagttccttggtcacgtcatctcagccggaggagttgccgtcgatcctagtaatgtggaatccgtaaccaactggaaacaaccaaagacagtttcagagattcgtagtttcctaggcctcgcaggatattatcggaggtttatagagaatttttccaagattgctaagcccatgacacgattacttcaaaaggatgtaaagtacaagtggtcagaagaatgtgagcagagttttcaagagttgaagaatcgcttaatatcagctcctattttgattttgcctgatccaaagaagggttttcaagtgtattgtgatgcatccaagcttgggttaggttgtgttctgatgcaagatgggaaggtggttgcctatgcatctcgtcagttacgtccgcatgagaagaacaaccctactcatgatcttgagttagctgcagttgttcatgcgttgaagatttggcgtcattatcttttcggtactcgtacagaggtatacaccgatcacaagagtttaaagtacatctttactcagccagatctgaacatgagacaacggagatggttggaattaattaaggattatgacatgggaattcattatcacccgggaaaggctaatgttgtagcaaatgctcttagcaggaaaggctattgcaatgctacggaaggacgacagttgccattggagttatgcaaggaatttgaaagattaaatttgggaattgtcagtagaggttttgttgcagccttagaagcaaagcccactctaattgatcaagttagagaagcccaaattaatgatcctgatattcaagaaatcaagaagaatatgagaagaggaaaagctatcagtttcttggaagatgagcaaggaactgtatggttgggcaagagaatctgcgtccccgacaacaaagatttaaaagatgcaattctgaaagaagctcatgatactttatactccattcaccctggtagtaccaagatgtaccaggatctcaaggaaagattttggtgggcaagtatgaagcgtgaaatcgcagaatatgtagcagtatgtgatgtttgtcagcgagtcaaggcagaacatcagaaacccgcaggtttgctgcagcctttgaagattcctgaatggaagtgggaggaaatcggtatggatttcatcactggtctacccagaacatcattaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtcttcagatggctccttacgaagcactgtatggtcggaagtgtcgcactccgcttttgtgggatcaaacgggagaacgtcaggttttcggaacggatatcctaagggaagcagaagaaaaagtaaagattatccaagagaggttgcgcgttgctcagtctcgtcagaagagttatgccgacaatcgtcgcagagatttggctttcgaagaaggagattatgtatacctgcgggttacgccgttacgaggtgttcatcgtttccaaaccaaagggaaattggcaccgcgttttgtgggaccttttaagattgtgagtcgaagaggtgaagtagcttatcagttagagttgcctccgtcaatggcgggaatacacgacgtgttccatgtgtctcagctgaagaaatgtttacgtgtacctacagaggaagcagatcctgatcgtatagagcttcaagaagatttaacttatgttgagaagccagtcagaattttggaagtaagcgagaggaataccaggaatcgcgttatacggttctgcaaggttcagtggagtaatcattcagaagaagaagccacttgggagcgagaagatgaattgaagtcagctcatcctcatctgttcgccagttcttctgaatctcgaggacgagattccgtttaaggggggtaggtttgtcacgccctaaaaatcgattaaattaaaaatgcatattttaaatcatttttagaaattattttaaaagcctacaagctaaaccctaattttctaggaaaattttcaatataaaaatgagttagataaaattttattaaatactatgcttgctcctctattttctagaattttctgggaattatttgagcaagggaagtatttttaataattgaaacaacatttcacaaattgttttattcaaaaaagtttaaaaacccctccctaagccgttgggccgttttcggcccaacatcctctctctctcgcgcggccgaaccggccaatgccggcccaagccgacgccgcccgctcccctctctcgtggattccgacaggtggggcccacctgtcggatccatctcctacctccagccgccgaccgagcccgagccgccggcttccacctccaaattcgcctcaatccgactccgattccttcgggtttttgaggggttttggtcctctcgatctcctctttcttttttcccaagaatcaaagagaa

SEQ ID NO: 79411 - DNA, 2464 bp, Oryza sativa
ttaaagttggttgcagccttgggtttgacatcaggcttgactttcttgttgttctgggatgcatgagggttcttcttctataccatattggcactagaacctccctcaacctttttgccccggttgtcctttccctcgccttctcctcaacacccaaagagccaatgagatcagaaacactgaactcttgtctcttgtgctttagagaagtggcaaagtccgaccaagaaggtggcaatttggcaataatgccacctgccacaaacttgtccggcaactcacagttgttgtcctcaagttccttagccagcatctgaatctcatgagcttgttctactacagaacggtcatcgaccatcttgtagtcatagaattgctccatgacatacagctcactgccggcgtcggaaactccgaacgtggcctcaagtgcatcccacatgtccttcccggaaggcatgtgcatgtacacgtccactatgttgtgagcgagtacactgatcagtgctccatggaacaggcaatccgaagcctcgaacttagcctcttcctcatgagagagagatggttcacttcgtttgccctgtgaaacacagaagcattgcatcgctgtcaaccacaatagtgcacgtgctttccacctcttatagttagaaccatcaaatgcatgtggtttcagtgcagcagcaaagccaactaccgaaaatgacctatcaggtttttggattgttggaaatatggtcatatatcggcatattttaatccaaaatattaagacaataaccatggcatgaacaatgtggggtgatctagtgataacatgtagcataaccagtaatatgcttaaggtatcataagcatcatgcacataccaaggacgcaattgacttgcgactagcacgactaacagcggtatgaacgaatgagttaacaacaggagaaggacataccccgagaatggccctccgctggattgtgaggtagaattgcttccgttggtgttgacgttcgcaacggctccggttcccggcgcgccatctccagagacagcagcagcggcgccggcgacagatcaggctccggctccaggcgcagacatggtggatgagacaacaacgaacagagcagtcgtgcgggaagcactccccaaaaccctaatcacccgcctacccggtgcagatctcaggcgaaggtgtggttccggaggccctgctccttctgcgcgcaagcgatcagaagcgaggaagcgaaacagcacaggcgcacgcggaggaggaagaacaccagggagaggaaagcaagcgaatcattctgatcggactagcggcctccttagatagaaggagagattccgcaagttgcagcacacgcgtcgtgggatcgtgggatcgtgcacgcgctattacggaggcagtcgtgggaacgtgggatcgtggttgcaaaagaatagagacgtgacgtgacggcacgcacgcccgccagccacgcctcgcccacgcccacgccctggcccggcgcgcgcgcgcccgcgcgtgtggctttccgactcccacctcgaccggtcaacagggagcctccaataactccctatttaggttgagatactcctcacttaattcctaaggtggtattattatccttaacacttattatggacctttgagatttaatagaataaatcgggcctagcccaattattctaacaatccccaccaaatttcaaggctcataaaaaatgttctcaaggttgtgcctgtttgatatacctgtgttttggtggagactgttaagttgaacttccactaggatatgagctacatcagaccacaactgaacaatggactatgccttgaattgtcagtcttgtgtgatcaggtttcactcaaacccttgactggtactgggctgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaacatctctgcttgaaaaagccactcggatcacattaaggtatgagccatcctaccatgcagaaaagaatagaagtacatcatgaaaatgagcctttttcaagggtctcttctctctgtcacacaatagtttgtttcaccatctaaattcacgggatctccgatcacaatggacaggtttccactattgtgcaaccttaggtgggtatcaagcccatttccctcgatgcactgtctatcacattacatggtagccccttggtaaactgatctaccaaatttctagccgtttggacatagtccaatgctatcactccggagtttttctgctttctgacagatttcagtcttctcttgatatgcctagatgacttcatgttgtcctttgaactgttcactttaataatcactatttg

SEQ ID NO: 79412 - DNA, 890 bp, Oryza sativa
gatgactttatttcctatgggttataatttgattagcatgaaccttatatattggattggttcggctaaatgctatatgtaagtttgcttagccatgcttagaaacattagctaacaaaaggagttaaatataaattatattacataattgttattattaattagggttatattcaatggtagctcacgatggtaaatcgtgtgatgttaattaattgataattaaaacctggataaggtgggttgtgagcatatggttttgatggttgtgctcatgacaattaaggaccggttcgcgagctactgttgtgaaacatttatcgtgccaaccacaagccagcgtgggcaacggctttatcttttctatagcgtgattcattatagtgcgcccgactgagaagtggcgagaagtccatgggggtcgctggggagtccatgccttgttttaaagggggtgattatgatccaggaaaggagcactgtaatgggttatgttgtgcgaggggtattgtcacgactcctttccgaggtaccgtggtggtactgaggcacatggtgacatgatgtggggttgtgtcttgtgggtacagtggtacacctctgatcagagtttaatctattcgaatagccgtacccgcggttatgggtgagttgagcaatatttttcgtgattagtctcacactacccattaatggtaataatgtggtaattaatttgatgcctagtttggaatggataattcctggtttggaggtttaatttgttcaactggggttggttgttcaaatgtggttgggcctatgcaacacgggtgtgttgtatggtgtttatttaatattggttaattatacaactgttttactattctcttaaatatttatgggctgca

SEQ ID NO: 79413 - DNA, 6055 bp, Oryza sativa
agttgataattttctgagcaagtaacccagtcattcatcttggaacaacccaggttccaccatatggatacaaacttcattcaattggttatgtaacataaaattttctgaagtaatcgatctgataatacattctgaattcagtcagaagatatgaacaagagtacaagagtaggtaataatacgaatagagacatacctgatttgagcaattcattctgcacgaagggtgccatgaagaaattaaacacctaatctgcagctctgaacagaaaagatctttaattaaattaaacgtggggttctgcaatttcttaccggcggtggagaccagacgatcggggaggtggcggtgcagaggttgcccgccggggttgccggcgcagagtggagcccaattagctaataagattcaagacactcaatcaaatcactcaagtacttgaattgagttctatgctggcatttaagtgctcagagcaccaatgctatggagctcctaaataaaaaagcacaacattttcatgtgaaaaggcatataaatatgctagaacagtattaccatttatactaattatgctagtccagatcaaatcagtacagtgtcattatttgcaaagatcaaagcacccgtccagtcagtagagggttagtatatatatgtaaagtctacatagaagaatagaaaagtattaataagaattcagtggttgcaaatattttgaattcttgaatcatatagacaaatatcggtaacgagacactcttatttgagtctaataattgtgcctcatattttctcagatgattatcagtttgcagatccaacttgttgaaaaggcttagcagctttgacaaaggttaatgtagaccaattactgggaaagggtcttcagtcttatgcacaattaccgagcaaatcgacaaagttacgagaaatgtgaaaaaaataaacttcttatgagctgtattttatagctcaacagtagtacagtacttctgtgtaagattgactggataagggctgcaatataaggtcaaattttacatcaattaagcatttcacccagatcaagaccagtcctataaatctcaaataataacaagaaacaaccaaatgctggaaaaaatggaaaaatatttgacccataaatctgaaacaatgctggcccagttttagagggctatcggtatttccaatacaaagtccagctatgttggctttacagggaacaagtccgaacgtaaattatgcagttaacccacaataataaacatacaagtgtaatactatggtttccccaaaaagtgccctgtaaaatgccatggaacatatattcatcatttgggaaagcgaaaataaacagatagttgatatgtatgactgatagcatatgttcatataaacaccgatagcaccttgtacatattaacaatagcagaaacaataggtcaaactgtctttaccttcactgcatgggaccaacgaaaatggatttccagattgaaactacaaagcggtctttttgtttgaagctatgggaccaaaagtccagtgtcctcgatgcaactgtctgatgaactgacaataatcagataatgcagttacatatgaaactacaaattaagagctcacctcgtcgattggcactgtctatcagtctatggcacaagtactgctccagttaactccttcctagctatcctgcacctcggtagcgaactgcaggcctatctgcatgatcattcttgttgaagtgcagtgatgctattagtataactttatactgagattttggagtccttccatcaaccgattaaaaattgcaatatacaagtagaaaatcatgtttatttacctttagaacaacggtcatgagccactgatttaaattttctgaacctctcttccaatcttccaattattttttctattttgtcttctctctgtttttaactttttttttctcttttcatcccttatttttttttatgctccttcccctcccttaaggctggagctcgcgactcccatcctcttgcacacgctgcgtcgtcgtctcccagccacaccatacaagctgccgcatcagagctgtagctagctagctaggtggtcggcaggagcaacttgctaaggaggctatcgtcgtcgtcgtgtccgctcagcccgtgcatgtcgttgaagggaagcccagaatggggatgggcagcaggcggcgtcggggctcgtaggagagtaggtggagattgtgagctgtcatcgttttgctcagatctggcgcccctgagctcgtccgacaaccggtgcggcctggacgggaaggcggcggcggcggcttggagggcgagtcggcgacggggatcggtggcggcgaggagcagatcggcgcggtgttgacggtcgttatcgatcaatttcgaccgtaaatattaccaaaatagaggagaactagtgatgcttgcaatgcataaatatgttagaataataatattccactagtattaggtatactaacctcttgcagggaatgacactaaagtggaggagaatcgacatcaacacaaacaataaatcaatcagacgatgtcgagaaccagacttatgtatgaatggggcaagaacacagaaataacacgacacattgggccaaaattcacaagtctgcggagaagaacaatggagaaggccgccaaccgaaattgggctggattgggccggccccaggttcgactgaacctggtggttcggccgaacctccctcgcctccgttggcatttctggcaccattgctggggaagattcataatagagattacttgaactaatactttatatttatctctgtataatcatttactttataggctaacattggttgttttcacttttgttgtggaacacagggcagtgcatgactggtttcaacctgccagaaaacttcaaagaaattccagaagctttcttccggagcgtcaggacgcgagtcgttgctccgcagaaaactctaccgacagagaaaccagtcgtaccagcgccaccgaccttcaagactatggccagcaagactcttcgcgagttcgctgctccctctgctgacaatgtggccattgggcagcaggtcaacataggggacgtggatttcgacttgaagtccagccttatcacgatggcgcaggctagaccgttctgtggcaagcctaatgaggatgccaatgctcatctgcaacagttcctggagatttgtagcacgtataccatcaagggcgtcagtcccgatgccgtcaggctgcagctgtttccgttctccctcctcgggagagcaaagcagtggttctatgccaaccgtgcttttatcaacacctgggacaaatgctccacggcattcctctcgaaattcttcccgatgggcaaaaccaatgcccttcgtggaaggatttccagtttccaacagacaagggatgagtctattccggaagcatgggagcgtctgcaggaatatgtggccgcctgtcctcatcatgggatggacgactagctgatcctagagaatttttacaattgtctcaccccaatgtcccgtgatcacctggacgcggtagctggaggagctttcttctctaaaacggttcaaggagccgttgaactcatagagaagatggtctccaatatgggttggagcgaagaacgactccaaacctgttagtgaggcatgcacaccgtcaaggagacggaactgcttgctgccaagctggacctcctcatgaaacgtttggacgaccaagagaaaaggccacaaggcaccgtcaaggccttggactcacacgtcacgtgtgaggtctacggtggcacgggtcattctgggaatgactgcccagaaacccgtgaggaggcgatgtacatgggcaacaacaacgggtatcgtccacaaggaggtcaagggaggaaccaaccacgcccatattatcaaggaggtaacaataacggtaacttctccaaccagccctcctagaaggatcttgtttttgcgcaagctaaaactactgattcgctaagcaaaaagcttgctgccaataataaggtcctggaaaacataaatgtcaaattatatggctttgcttccgcatttcaaaatcagctgagctttaataaaatgatagaaacccaattagctcagttggcatctttagtccttgcaaatgaaactgggaggattccggggcaacctgactcctccattgaaaatgttaaggcaatcacgacgaggggaggtaagtccaatcatgatccgccgtatcctaaccctacaggaactgataggatgtcaaaagaagcgtcatctagtgactcggctgacaaagaggttcagccagagaagacagtgccgcatgagtattgcgacacacggttgctgccattccctcagcggagtagaaaaccgtcagtggacgagcagttcgctcgttttgttgaagtaatccagaagatccacatcaacatgccattgttggacgctatgcaagtgccgacatacgcccgttgtctcaaggacatactcaacaaacaagagaccgctcccaacaacggaggtggtcaagctgacggaacaatgcagcgacctgatactccacaagctcgcggagaagaagaaagatccggggtgtcctacgatcacctgctcgatcggggcacaacaattcgaccaggccttgtgcgaccttggagccaatgtcagcatcatgccaaaagacgtttccaacaaacttaacttcacggtgttgtcactaacaccgatatgcctccaactggctgactcgtcagtctgttacctggcagggatagcggaggatgtgccagtcaagatacgggatttcttcattccggttgactttgtggtgctggacatgcacacagggaaggagacgctgctcatcctggggcatccgttccttagcaccgtaggagccaacattgacgtgggaacggggagtatccgtttccatatcaacgggaaggaggaaaggtttgagtttcaaccgaggacggaacaatgctccatggttagaatcaagtatgggccaaacccgcagaatattcaagtggtcgaagtggagccacccaaaacgaatagcctggcggaattcatgtagaatttccaggagaaggaaacaacgatgccaggaaccgttattgaaggacaccggtaaaatcacctgtaccggccaagaagttagagcagccggctcaaaagaagccgtcttccgcaccgaaatcaaagaaggtgtggaaggaaaagccaaagacgcccgctccatcacctccggagagcggtggaaaatccgcgcactgaaccgaaagaaggtacggtcctacacgtcggacctaaaacgacgcgatcttcgccaacaggtaaattggtatgtatccgcatatttgctttcaacaatttgaatttttgcacaatcacatgtttaaatttcaaaattgcatttaggattttgaattttgaggaaattcttcaactgaatttttcagagcaaaccaaaataaaattttcagcgaaaattcactttgccatgaccacactgaccgttcgaatccaatggctgaaagtggggccggctgggcccaccaggggttcggccgaacaccctggttcggcggaaccggccaggcaatggctccctgccactttttgcaaggtaacggctagtgggtcccacatgtcatttctaaccgttgtgggcaccctaaaaaagccagccggctgggagagggaattccatcccatttcaacacattttcattccctctccaaagtttgctctcaagttcattcaagctttgatagtttccctcaaattcaaatttttagttgcatatatacaagttgctttagtgaaactaaccggcgggtgaaactcttgtcattcctaacccccgccgagttagtccgttcttgcttcattatgcagaatgaggaggcgattgtctcgtctgttcaaggggtccggctcttcatcaagtcatcatgacaggtccggggtgcaggaa

SEQ ID NO: 79414 - DNA, 1138 bp, Oryza sativa
attgtgtgcctcggctgattcctggacgagggtttacacacatgtaagcgtttggaattttggatagaaattccgggcgtcataagttggtatcagagccacattgaccctaggttatgccaaatggatacctatagaagccctctaaaaagattgaaaaagtagaactgttctcctctctttctcttttaattaaaccaagctaatggcacatgcagtttatagtccctttaattgttctcattcaaaatttatttattattcctgtgttgttagtactgtacatctattactatactaatggcccactttctagcagagattttacaacctttcatttatttatttatttattcaatcatgttgcaatataatttagcatgttgattttataactctcttttattttatttcttttgaaacctgttattcaaaagtgcaaatttgtgattctgttttcaactgtttcaacttatcttgcaagattggtttactttatttatttaccttttactttgattttctaactttattcaaattaatccaaaaacttgtgctattaattggataaatgtcttaactccctcctttcacttgtctttagatgccgcgcttcaagcctgagtacttgttcggtactgagggatttgtccaggagttgcgtacgatgtccttcgccataggatttgggactgcccctttgtatgcccagattcctcatgaccgtgatgaagagaagtgccgtgtcaaggtcaccttgaacactaatcatgaagacatcccatcgctgatgttcgaggctggagggggaaactacattcatgcttgtcaggaggtggcaaggatcgccataggagagcttcgcgattgctacagtgatcagttggccgacactgagtatcgctaccatcctcgccaaccccagggaagtgaccgtggcagctaccttgaacctgcaggaattgagaatgatgctaccccaaggcatttggtcagatcctgtgggccatggatgagttccgcgctgagattgtgttagctgctcaagatcgtgaagaccggaatcgtggtaagatatgtaagcttgaggacaaagttgatcgtttggagaaggaactagccgcgttgaagggagaag

SEQ ID NO: 79415 - DNA, 11101 bp, Oryza sativa
aggcagctgcgaggggcccgagctggcctcggggactgagacgggctcgagagctggggtccattctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccaagcggcctcgcggggcgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgtttggctcgggggcctcttctccctgctctctcccgggtcgagtcggcacagggttatcctcggggtcagagggcgataggtgcggccttcccgcagtggccctctggccatcctgggggtcgggggcacctggcaccgtctgacaagcgggcagagggcctgctccggtcgtcgggggccttgggccactgttcggctcgggggcctctcctccctgctctctcccgggccaagccagcacagggtgggggtgcgcggaatgaggatcgtcctcatcgcgctccacaaccaacgccgcactaaccacttgcggggtcgccgctaagtagagtagcaagggttcatttggctccgaggcgaccagaactgggggagagctgagatacgccttcaactgagtgagggcacgttcagcttcctccgtccaagtaaatggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttcttggggttggcctcgatgcctcgggtagagaccaaaaacccgagaagcttgcccgcaggtacaccgaacacgcacttatcggggttcagttttatgcgggtggagcggagactctcaaaagtttccgctagatccgagagtaaggtctcttggttgcgcgtctttacaaccaagtcatcgacataagcttcaacattacgtcctatttggctacccaaagaaatccgagtagtacgttgaaaagtaggacctgcattatttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggcattgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttaaccgggacctcgtcgcatgtgactatccgctgcctcggggcggcgggggcggaggtgccaagcctctcgtcgcctccctcgggcttggacgcggcggtgaggtggtccgcgcgctgctccatacaagcaagcgcgactttgaggtcgccatggacagagatggggccaccggggcccggcatcttcatctggagataggcgtagtggactgccgccatgaacttcaccaacgcgggcctccctaggaccgcattgtagggcagactgaggtccgccacatcaaagttcacccgctccgtgcgaaagttggcggatccaccgaaggtgaccgggaggtcgataggacctagcggccaagtgtgacccggcgtcacaccgataatcggctgggacggccggagccccatccccggggccttgatagcgtcaaaggctgcgggggaaaggatgttgagggctgctcccccatcaatgaggacacgccccagcttcacgttgcaaacagtgggggaaaccaccatttcgatctgtcctccccgggcaacgcacggtgggtggtcggtctggtcaaaggtgagggcaacctccgaccaccgcgtccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaagttttgactgcgcggcaatccgcgaggtcgtgaagggaggtgttgtggacgatgcaccacttgccggttgggcgctccctactgggagcgccggcctccttctttttgtcgctcgcaggcctcccctttcgggtggcccgcgaaacgccctcgacggcgaggacatgaccctcgtcgtcggaatgggctgacctcttcttcctcctcctgtcacgccgccctgtccgagcagcggatccgggggcggccgaagctgccacactggaaccggaggggttccaggtccatgcctcttccttacgagccactcggtccgcgtgctgaaaaagctccgcggtagtctggggctctttggaggcgatcttttcgagcatgcggttgtgccgcacacccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgatcctgtcgtcacccccggcggcctcgatcccggtcgtgtagacctggagaaactcgacggggttgacgctcccgtcatatttttcggcgatggtgggccggaaccttgggggccaatggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggcaccccacgcagatcttcctgggtcggaggcgttgacgaaggagtggcggccgaatggcgagcaaccgccgccgctcgccgcgcccttcgccttgacgacacggagccggtggtagcagcgccagaggttttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgactctctcgagcgcctcctcccgcctaggactttggcgtggagggggcggtggagtacgagctcgacggcgtgggttcggctccccttcgtcaccgctaacactcggagagaggttgtgcgcctttgcttgttcagccattgggctgaacaggaaaagcttggcgcacacgaaagagtgcgagagcttagaagaacacacgtagaaccccctacctggcgcgccagatgacggagcgtggggctcctcaccgggagaccgcgcaggcccccctttgccagttcggccgggggccctgggtgagattctaagctccttgtctgtgtgtggaaggttcgcgagaattgaaacacacaagacacgggcgatgtatataggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgtcggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaaagtcttgcttgtaatggttaggatgaagcctggtatatatctgaccgggaccaacgtgccatctccaggagctaacacgccggctccggctagggacgagtgattggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccacaaggggtcggggcgcctcgaccctcggggccgagacggatgcggtccgacccctcggggagacaaagagaagggcggccgtatcaccctcgggcccgacccccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtccaaaaatcgggacaagccggttcgtttttcctggagatatggtgatggcgcttcggtcggcgagcgtaattaacgcgcgcacgagatgttccatctcgactgccacggccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcatcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttccttcctttcgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccacgggggccggtgctgaaccgctacattccctgcgtcctccgcaagaagtgggatgactggaagagcgactggttctacacccccctcgccgacgaagcgcgcctccgacttccgagctagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactaggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggtgtcggaggagcgggctcctcgaggccacgatggcgtgggcgggagccgcagggggaacaatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaaggtgggggggacagaaccatcccggggaaagctcatttcccctccaaggtggtcgtttaaccgaccccctcgcaggttcgtcccactcccatcgtggccgtattcattctctcaacgcgagttttcactcatccatcttgtttgtcttctggtctttcttctgtttcagcgagatcccgtcgcgtccctcccgccattccaagtccggccagcctgaggccgaggacccggcgaccatagaggcccggaggcgggaatctgaccggcgagaagccgcggatcgccttcgagaaaccgaggaggccgctcgggaggccgcccgggctcgccagaccgaggaagccgctcgggaggaggccggactccgccaggccgaggcgacgacatcctccgaggcgacccgtgaaactgacgggcaagaggccgcggatcgccttcgagaagccgaggaagctgcctaggtggccgtccgagctcgccaagctgaagaagccgctcgggaggaggccagacttcgccaggccgaggcgacgacgacttccgaggcaactcgtgacgaggccgcgggcgcatcgcttgggcccactccctcgtgcgacgctcagatcaaaccaggtccgggggacatccctgagtccggcacgtccatcggcgggccaagccgcgcggcatcctcttcgaggcggctcttccccacgccttccgttgctccactgagcgcagaaccccttctgcaggccttagccgtcgcaaacaccacagtgttggacgggttaagtgcccaggtggaggccctgcaagcagagcgggcggagctcgacgccgcatgggtgcgtgtcgatgaggggcgacgctcggtggaggccatggtggaggtgggccgcaaggcacaccgccagcacgtctcagagctcgaagtccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaaaaaactcgacgcagcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgctattcgggaggtcacactggcggtgcacgaagccgcctgtgccgaagaagagtccgcgctccgcctccgcgaggacgcgctcaccgagcgggagcgagctctcgaggaggccgaggccgcggcgcaacggctggcggacagcctgtccctccgcgaggctgcgcaagaggaacaagcgcgtcgcaatctggaaagtgcccgcgccgagagggccgcactgaaccagcggccgctgaactcgaggcgcaggcaagggagctggatgcaagggcgcgtagcggcggggcggccacgggcgacagcgacttagccgcccgcctcgcagctgccgaacacaccatcgcggatctgcagggcgcgctggattcgtccaccggggaggtcgaggcccttcgcctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggaactcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggtgacccgggtgcatcggagtgagcccccaggcccccgccaatctttaaatagtttcttcttttcttcttccgagtccttcgggcccccttcttgtatagactaatttaatctgcaatcaaataaagaggaaattttttgtgtcaattctatttgttgtgtgtatgagacgaggatgcctgtgccgcggtccttttgtgtcttggcttgaacaagggctcgtgcccaggtcctagtcctcaaatggctcgggttggggctagtgcctggggagatccacatgtcgagactggccaggccgggagcgtggtgaccgagggttatgggttacccgattgtgggtttttgccgattcccccccggagttcaccacgccctggggcacggctcggttctgggccccgtttggcgattttagccgacccgagcccccgagggcaggattgaacacgagtgacctatttcaagtcaatatccttcaaaaggaaacaatagcacagatacagcctttaggaaatcgaaaatgcttttattgaaatacagatataagagaaataagaatagacatatgtggtagcccccggccaaccctgcacgcccgaggggggtgcggggttggcccaagcccgaaacctgacacccgatccccctttaggggtagaagcgacgaaggtgttgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatgatagcgccgtaggctctgctggtagcgcgcggctcggagggccgcgcgccaccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccacgaaagtggtatgatctgcagggcctgggccggctgatggatttgcttggcgtggaattgacacgctctgcatcgccggaccaggtcgaccgcatcattgagagctgttggccaatagaaaccttgacgaaaggctttgccaaccaaggtgcgcgaggcggagtgggctccgcattcgccttcatggatatcggcaagaagctcgacgccttgttcccgagggatgcacttcaggaggattccgttagccgcgcgccgatagagggtcccttctaccagcacgtagcgtttg

SEQ ID NO: 79416 - DNA, 7067 bp, Oryza sativa
cccccccccccccccaaaacgagaagcagcgccaatcagattcccctacaaccccacgcgtttcctcataatcgctacagctgatgcacagggacagggtgaagctttcacaaatttggatcgaacggggccttggttttccttccaagctggtcatggatgattcaatgcctctgcacgcttggtcccgctcagccgtagcgtccgagtccgacctcgctgctgttgctgcaactacgtgtctcagtgcctgcagggaggcaggcggtccgtggacgtggagagaaagccctgcttcccgtgcaatgcaaaagtgtccagcgtgcaagcgtacacacaccggtgatgggcgtacggtcaaaccggctcacttcaacgtgccataaatactcggcgccaccgatacgcaggcgctaccacaactcgacatggcaacgagagacgacacattggtacgcacgcggcacgcaccatctgccgatcgatccgccaggcccatcgttttggctgatttgagaaaaaaaaagaaacgatatatctataaataaaaaataattcatgactaaaacttttatacatttgtaaaagtaagttgaaaaataaactatgatgaaaaaaattttaaaattaactttaaatttaagatcaaaaatttaaattttagttgatataaatataaactagcacggtggcccgcgcagattgcgcggctagcatcattatattttctctcatataataacatatatgttctctcattatgttattcaaatatattaaaatgacaacatagttttaaattttgcaacaactttacaaaactactaatatgtaatattcatattgtattttatatacgtgttagttattaattatttttaatatcaaattttagttatttgtaaatcatatatattcctatatggactctagactcgtcttttaatatttattttttttaattccgaattttctgtaaattgtatatctatatagactctatgctcttcttataatattatttactttttatttataattttttattatttctaattgtatttctatgtgtactctaaactcatctttcaatattctttaatttttaattttgaatttcagttacttctaaattgtattcctatattgactttaaactcttcttcccatgtttttcttaatttcgaatttttgttatttgtaaattgtatttttatacggactctaaactctacttttaattttattatgtttattccaaattttagttagttttaaattcctatatggactctacactctacttctaatattccttattttttaattccgaatttctattttattcttaattgtatttctatatggactctaatactctcacttctacatattctcttatttttcaattccgaatttcagttatttcctaattgtatttctatatggactctatactcctcttctaatattccttattttttaatttcgaattttagctatttctaaattgtatttctatatggactctgccttttctttttctccgattaatgtgagaatttctaggccatgagagcgaacgtggaggctcctttttctattcctttaataatataatagatataagtataagcgaaaagatgagagagttttttttttcactgcacggcacggcaccacgcgaggggaggcgactcttccctacgaaccgaagggcacgagacgagcggcgagcggacgatttcggtaggaaggcggagtaaatgagagcattcaaggtgaagtgcgcggttgggtgcagctggtcgccgcccctgcctgcgtggttaaaaccgacgacggcacagcaacgctgcgatcactgctcaaacccgtcaatccaattcaatgctacgcgacggtgcctcttccttgggtggcagtcaccaccagtcggttgtgtttggtggtagcagcagcagtagcagcagattagcagtggtagtagcagatttagcgttagtagtagcaggctagaaaatgatggtagtgggctggtggcgacgagctaacacgatcagtctggctgtgcgagaagaagccgagagcatggcgagacgatcgaattggttttggcatttgttcaggtatcgcgatgcaagtacttaatccgatgattggtcaccaggtccacatccgaggagccaccaacgctaacgagatcggagatctcagagactcacatactcccttaattcctaagtataagcactttttacactgtatagcagagattaaagataggagggaagatttcttttcagtcattttgttgatcgaatttcgaattttaaatcgcttgattctcgtcacttgtttggttgaaaatgttttgattcccgtgcactgaaatccgcgtaccaaaaaatagttgtatttaggaagtgagggagtatacatgataaaacctgaattcatattccccgggaaagaaaaaaatctgaattcagtatatgctactaggagggattggcaatttggcaccattgcaccaagcctccagcccaccaaccatatccaatgataacaaggaccaccgggcaggctacccaacttagcaagatcctcgactccatgacagagacaagccaggagcatgctacggtagcaacaaacaaagggaaaaaaaaactaaaactgtctacatactagatccaactaggatcactaatccattctctcagtaatgtcctaaactttttttttgttacactcttcaactgggcacaagaaaggatcaccacaacgaacaaacctgaagtggtgtgtcctcagttcgcaggggattggacacgtttttgactgcaagcctacgacgcactagggcactaagccacggccatggatccattccacccaacacaagtgattcagaatccacacatctgcacaggctgcaggcgcaccaccaggcttcagagtagccgcgaccagatcagctataaaccacaaggaaaaaggagcaaacagcacggcgtggcatcctgccgtgtgcgattcgcccggtttccccctccagaaaattgcctctccagaaaacgaacgaatgaccagtctccagtggttacaatctgagcttgaataccgccaaaatttgcgaggattgatgcgaggacaggaggagaatgggaagagagaatggcgacgatgttgtccaaatcgatggaaggttcagagttcagagacgttaagctcatctggggctggaattttttttctctttacaaaatagtcctagtaaaaaaaatgtggaaggaaattgacaaaaaaaacctcgtgaggtcctgtaattacagggggctagttctatacgcctacgatccaacggtacagcgtgacgaagcccggctcgtcgtcgtccaccccgcgcggcgccgacatcaccgccgcctccgggtcccaccgccacgagtcctcctgccggttgctgtggtggctctggctccaccgcgcgctccaccgcccgctccaccggccggagagggacgaggcggaggaggcgaggcggtccacgtactcgcgcagccatccccgcgaccccgccgcctccgccagcgcctcgccgggggccggcgtcacggaaccggtcgttgacttggccgccgcggggcgcgcgatgcgggacacgacggcctccacctcctcgtccacgcggtagtcgaaggacccgagcgagtaggtgcgccggtcgtcggccgcggcggaggagcggcggttgctgatgctgctgatctcgacgcggaagctcctcgagttgttgctgctccgcgagtagaggggatcctgttgcaccgcgttggagacggcggcggcggcggcggtgaggagtggcgggtgcgggagcgagacggtggcgcggcagagcgggcaggacggggtggtgcggagccaggcgtcgacgcaggaggcgtggaacgcgtggcggcacgccgggagcagccgcagctcggcctcgggcgcgaacggcgagaggcagacggcgcagtcgggggagctcttgggcagcgccgccagcgccgacgccatggtgaacaccgtcagcgacgcgaccaccgctccttctcgtcgtgacctcctccccaccccccgccgccgcctccccctcatggctcctccccaccgccgacgcggcggtagcctccccagcctcgacggcggacgccgtcgtcgcgcgttgggccgccgccgacgccctgggcagcgggctcggagccgggtgcgacggccgcgcgaggcagcggaggaggaagtggatcgacacggaggcgaagaagacgaaggcgaggagcgcggtgatgatgagaagcgacggggagaggttgagcgaagacgacgacggcgccggcgacggcaatgagggcggaatggtggcggcgagcgggtcgccgccgatggccggcggcgcgggcggcggcagggaggccatgggggggaaggagacggtgtgtttaaggctcggccctgcgtgtggtctcgcgcctttatttatgggttttggggtgcgcggcgttggcacggagagcgagcgaaatcggagcgcaaataccaggtgattagccgtgagacgagtagaagtagagcacacacaagcacacacatcactagagaccaggtcggagattactttccggtgagtgaacatgtccagttttttctctctactttccttgttcatctgtgatttgtgtctctgactttggttgctttttctgaccttgattgttctcagtgtcatttctctgtgtcgagatgtggtttttggaggtgtaggacatgagttgtatccgtctcgttcttctctgattaataacatacaaattggagtacatctcaatttttattaacactttttttaactgctaaacgatactcttttcaaaaatattttatataatggccgttctaaaatattaatttaaatatatttttattgtttataataaataaaactttattaattaggtgctgatgatttttttgtttagcatatttttacttaatctttatcttcatcaaactcaaacggcaccatattgttcccttcattacattttaatcgttggtagtttatcttatttttgcctcgtagacaaagcacatcattgtagtacaagtaactttgagaaagatgatgtactaccgtgaaatgggcacaaatttacttcagattaaagtggtactccaaaagatcagctaatgctctacttcatgtcctttgatcatatcactatatattttagcccagagtaatcccggttacaggtttatcagcctacgtgctgcacgaacgacaaaactaaatattggcgctggcgggtgtcaccgtgcaatgtagccgtcaggttaccatctgtcacaacgagaacaaggataaaaaacagaagagagaaagaaatggtttcagctagctatggcttcctgcatttctgaaacgaggcccgagtacatagatcaaaagccgtttgctttgacgctttgttgcctgtatatatctagaatgtttgttggtcgaacaatctgtggggcttgctcaagtagtagctttcaactctaaaagagagccagcctcatagttcttccggatgaagctcaagctaacatgagcgtcacatcaacaaaaaaaaaaatcacgaggttgatttaatttactgcagagctttctgaaaacatatcgaatgatcgaactgtacagtaaccgcaccgacagagaattcgttgagagcccattcaattcagctagacatgaatacatggacacacattaaaaatcattggtacatatatacatgtacgtgtatgtacctctgtttctacacgcatgcatgccaaggccatagtgtccatggaaatttatacagatcattgaaagttgctttcattttaatccatgcattgggtattcttaccaactagataaaacggcgtggatcgttgtcagagagagcaaaggtaccgtggccagcgtaatgggcttcctgtacgcatgctgtacgcgccttcaatatctcatctccgagaatttatgaacttcatcagacacgcatcaaccatgtcggccccttgatccactacactttatggtgtatccaatgggagaaaaaaaaactccaaaactacactccacttaaaatgtctcatgtcggattttttttaagaactgttggatttaatttgttgaacggttgattagccacagctttggatggtgcatgaatcggagttcagagcctcctttcgtaacacaagaatttcgggggaatttaggtcttgtttagttcccataacataaactttttacccatcacatcgaatgtttgacacacgcatggagtattaaatgtggaaaaaaatcaactaaatagtttgtgtataaattgcaaaatgaatcttttaaacataattgtgccatgatttgacaatgtggtgctacagtaaacatttgctaatgatggattaattaggcttaataaattcgtctcgcggttttctggcggaatctgtaatttgttttgttattagattacgtttaatactttaaatgtgtgtccgtatatccgatgtgacaaccaaatctaaaatttttccccaactagataaggccttaatctaatacgggaattttttttttcgtctcattatacacgaaatgatcggattgcgttgttaattaaggaatgatgatttggagacatgaggaattttgactttggattagtaaactcactcgcaaattccccttgcacatgcatagagaggtcgttggcgttgggggtaggagtatcgtgcagctgacaataattacaggtaccacgctgaccattaataataaatttattatagcatatacgagcaagcaagcctcacgtacgtctatcactatactttgcccttcaggagcaaatgtggattcgagcttcgtcacaccagcaggttgattaactggctcacatgcacgacgatgccatgattccgggaacagcaagcatggatgcatgaataatctttcaaacaacacaaaagaagaa

SEQ ID NO: 79417 - DNA, 1027 bp, Oryza sativa
tgtgcactttgaaagaaatagaagatggtatttcttttcgctttttccatgaggagttcacgctcacatggaagggcttaagtacacttcttagctttctcgattcctgtaagatcgatatccagaaaggaatttcagggttcgagaaaaataggttttgggaagatatttctagtgctccaatttgcaagaaacctagaacggatgatatccataatcctacacttaggctcatgcacaaatggattgctatgactttgtttcctagaggtgatctgagacccattaggggagatgaattaattatcatgtttgccatggttagaaaaatcaaaattgctcctgtgaaatgtatgataaggcaatggttagaaagtataaagttctctgctcctgttgagtgcacttctctgattacttggatagcaaaagggttaggggtcgttagcaaccaaattgcttttatctcagccgctcgtccgcgtattgatgaggcttatctagtgcaagggaatattttgaaacatggggcagatggatctttgatatactttttccccggttgaacaaatgaaatcccgttgccaaatgcggggtatcatttgtacaactgccatgaactaaccattcccctgcagaccatagaagaatatcgtgcaggcagaacatacagggagacgcgcaacatgacaaggaacgaacgagaaagttcatcatcctcaacacccgtgcagatgtatgaggcaggttgggcaccaactggggatgcacccgggtggacccaagctacacgccatagcaccggagtctcgacctagacaagcgctagtgaggaccggtggcatgcgcctcatgacatccaatgggaggacaatcaaccttccagatcaagagatgtgcctccatctccaagtgaatggcgctcaagttcctctcgttgggacttgggtgaaatcactaggagaatagacacccttgatatgcaaacaggggagatccagtacaacctcacggaacacatagctca

SEQ ID NO: 79418 - DNA, 5524 bp, Oryza sativa
tggttgaacctttagctgacttcgactgggttgtggcacttgatgatggggcttcagatccagaacttctcatagttcgtatctttggcgtcagcctcatacaacttacccacttcatgtcacgcgtcaacactagcttgtcattactaggataccatgcttgtcatctacttctaagttgccacaaactgcctcatattagttttcctggtctccgggtgctagctacttctgctatgcgatgcgagggtcaataattttcgcctttcaattatgtttctcaacagagtcaacttatcccacttgacatgctttgacgcctttccagatgactttactgctggacttgttattgtttgatcgttaccctgccaaatctgaagcttcgctgttagatgcgattttaatctgacctctatagactatcttcgaacatatcacttggttcataactgggaatagttcccatgaacagacaactcggattcactttctttacattcagtttacttcctgctattctcttcatgttgtcattatttagcattcaaagtattccttcacacattcaaccctgatgtattcttttcagatttctcgtatcaatcacctttcgacctacttctttgcccgacaataaacacctttgctggtatcttctatcagtcacctttggaactttgtcaaccaagtactcttcactccgagagttgtggatgcttctggtgacgatgtggtcctttggtctgctgcctttcagtgaaaccttgaagtgttttcgccaaaagctatactgactgtcattgcctttgatccgaaaaagacatgtctgaaactctcagtccaaacaaatgtctctttggttaatcgcttgattttcttttccatcatcaggttggttattaactcgaggttagaacatggttcctctgaaatgagaccctaggtctcctttgacagtaaacaattatacacataatcccatatcagcatcttccgaaataatcctcatagaacttgtttttattacacatgtctcccttattacatgaatgcaaggccttgccttaaacaaaaagggaaggtgcttaacatcagtacattgcatcctcaacatgaatcttccataaacataacaaactcattgtttataatcatgaatgtatttatttattacatgattgctgcaaactcacgattacacaatgataagtagcgaactgaaaaccacaaacgtggctactcattttgattctggagagatatagctggcattgtcctagtgactgcatccttgattggttctgtgatgatgtgttaggactgcatattgctatcattcacaggagaagcttccttctgattgctatttgaagcagataacggtcttctgcttggtatcgcactcctgagattgattgcccttcgctcggcctggagtaggtcggggagagacacaacttcttccatcgacgacaattctttgctgaggccgtcggtgcagagaatggttggtgttgaaggtattattgctatgatttactgcagagtcaggtgcagcaggaggagcattggtgctgtggatgatatcgtcgaggttgctgttggagctgactagctgatgagacaatcgtagggttgttcgttggatttctgcggtcttggtcaacaacacactgagttggcaatccttgggcacatggttggtaccttcgcacagaaaacatgtgaccttgcgggtgggacattcacctggtggatggtcttcttcacaatgagggcagagtgtgagacacctgctagcaatgtgtccaatttctccacaacgggtgcatgcctttgattccatctcttcctcgccgagatgtcggggagactcatcttcaacatccgaggagacttgatctgacccttcactatcagatactctgccaccatggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggtgcttttctcttctgattcttactcttcttgcctttggcttgcttagtacgtgaccccacgtggtacgaaaggctaggaggaaagcaattcccgggattcaatggattctctccattgggctctctactttgcacactaggctgcaagcttgacttggtgcgaggaggctggtttagcgatgtctgccctgttaaaccaaaggaaggggcttctttggcatatacccatggacaattcaaggcatagtgtccttattctctacaatcatgacaaaaggggacatgctcttctggcattggaagctcattgatctgggtggcaaatgctcgatcaaacacatactgattttggtcttgacttccaaccaatggtagctgggaactaagcagcatgcttggaatggaccaagggtgtgccctggttaactctcttgaggccagtggtggattgagttgaaaacttgagttactggaggcataccctctgacattctttcctttttctctgttaaacatctgttacagggattgaggtgagagaggaaacaagctaggaaagaatagaccagaactagagacaggaccttaaaggaactaactcttcttgttgatgtgttgtttgtttcacttattatgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttcactccttcacagctggcttcactgcttcctccacttcgctagcggatcctgcagtcttccggagcttcggcgaacaactgacgatgtcttcttcttcactgacctgaccatctagtactagttgaaatttgaagaaggaagaaaagggtaaacattttgcaaatagcataggggaaaggaggaaaaaggaactttcgcaaatagtttcatttataaaatatgtccttaggttttatccacttggcttatcatacagtcaagatggctctgataccagcttgtcgcgaccgagaaaatttgcattttcccgaacgctagtgtattaatccccgtcccagaaaaagccggggtacaccacacaaacatgatataaaagacacatctttattctatcgataatatttacattattacaaaggcacttcaggcctggcaatcaaaaataaacagcagcggactagcgggcctacggctccatcttcacaggcgctcaactggggtataagccaggactccacctaagacatcttctccaaagcctctcttactgaagaggggaaagattgagcaagagtgagtacaaccacagtactcagcaagccacaccggagatgcataattaatgcaagggagtacaaggggataattatataggggttaagttttgcagtaaacagcatttaaaagtcacttagttgcccaaagccattttataagacgatcctagagctacacagtattattaatcaaggccgtgaacccccacgaacctgccttaacccaaggcctacgatgattcagaccgaactggcaacccgaccctgggtcccagctcgtcccaagccaacccaagccaaccattccacattttagttgttgagcaaattttaagaattaaaacactaacttgggtacattgctcggcttgcccataaccgagggcgcggctattcgaatagattatactctgatcagaggtgtacgtctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccttagagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaaacaggttttaggggctttgaaagaggaagagaggggtatgtccaattccaccataagccaaccattccatagtatccaaatgatatgagaattcccaaagtctaaagttataaaatcacctaatgttgcctaattaatcagcgaagcatctacctaaatttatactagtggaaccatgaatagagtacccactagttggggttttgtttattctagggtgaacaaggtaataataacaatagcaataataatgtcttaacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacacgaagcacacaagcaaagctacaagcctaaaaagaagcaataacaatacataaaaagaaagcacacggttctttaggttatacaaacattaggagacttgaacgggtcgattcagagttcgtatgaccaagatatgatcatccgaagtttaatgctgttgtatggagatttgcggattattataattaagctttgcaactttaaaacatgtgtaagcgctagcctggaaaagacaggaaggctgcgccgttgacatgcggaccccacatgtcaacctaaaggaccgcggtagaccgggtacacagagacggtccacgggtcgacggaagcggaccgcgtgtgtcaaccgaggcgagtggccgacaaacggagtccactagacaccacacgggctgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacgaggacggggcagcgagaggagagagatccttaccaccacgcgacgaggcgcgggaacgacaacgacgaacgggcgcgcggagacagacgggcacaacggagacgaacggcgaggggacggcttcggcggcgatccttggacgaaggcgagacgcggccggcgcgagccttgccgacgcggagccgaggacgaagacgaggacggggctg

SEQ ID NO: 79419 - DNA, 927 bp, Oryza sativa
tcaagcgcttgtggtcatcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcatgacagaaggcatgacaagcagcaggacaggtatcttgaagaagatgatggtggttttgatccgtattgggattgtgagtttttcaggttctgctggaatgaagggatgaggctgccatcaatagaagattgccctggatgcagtgataatgcaggaagttcgagccgatcttataatagaggaaatcagctgaatcagaaaaggttgcctgttcattagaggttgggtccggtacaccaagagcattttcaggatgaagatgaaggcagaaattcacagtggtgcccttctggtatttttactaaaaatcagaagagaagggtccagaggattagaaatagggagcgttttcaggaggtacaacaagagatcaaccatcggctgaagaagacaaagaccaagcaggagtggcgcgttaagagcaaagtgctgtcagccgatgagattgaggccgacaaagcaaagaggctagccagaggaaaagctattgcatcttcatcggtaaacatggtgttcgtcctgccagtagaatatgaagctaatcaagccgatgtgaatgatgtggaagaagcttctgctgattaattttgtcaccagaacaagcaatttttgagaaatcagaggggacatagaatcggcatctcaagccattgtatgttaatggatttgtcaatgggaagccgatgtccaagatgatggttgatggtggggccgctgta

SEQ ID NO: 79420 - DNA, 1164 bp, Oryza sativa
agtagaaagaaaagttacagccaaaaacctaatagttggcatgtatattatcatatagtagtaatgatatttatatagcataaatcaaactgttgggtaaagacctggcagtaccttcattaaaaaaatgatatttatatagcatatatatttaattatgtgttgaatatgatgacttcttggtttgaatatgacgtccattttatttgtttttcatacacatacgcatcacatacgatatatatctatttcttttataaaaaatattagatattcattttaatactcttgaattatgctgggcttgcctttggtcaatatgagtaaccactactacagatttggtttttttttatgcggctaaaatcgacttttgcatgtggatgggcggcccacctgtgctcaaaggtctacgaaaatcggattttcccatatgggcgcttaagctgaccacatgagaaaaggaaaaaatcatgaaaaaatatatataaattctgaaaattgaaaactaccccactaccccgatacgctaaccctagaatcctctcattgtcaacgccatccttgtcctcgccctccggttggcgtcggcgtgcttgtcctcccatcaccgtcgccgtcatcgtcgtcctcattgcgtcgccgccaccgacggatccgcgcggaagggagaggggcaccggatccgcgcggggagggccgccaccggatccgcgtgggggagggccgtcgccactggatcagggctggggacggcagccggccgccgctggatctgcgctcggccactcctccgtcagcctctcgctccctctgccagacccatgatgggatagccgccgtggccctcactcaccgagagtgaggggagaggggagaggagtggggagaggacttagtgacagagagaggagggcagaaataaaaaagagtggcaagagagaggagtattttctcatgcaggtcacttcatggatgttgttacttactttgtgttagaataaatgggctaggcccgatttttctattaaaatctcaagggcccataataaatgttaaagataataataccacactgggaattaaaagtggagtatctcaacttaaatagggagttattggaggctccctgttgaccggttgaggtggggatcggaaagccac

SEQ ID NO: 79421 - DNA, 13273 bp, Oryza sativa
cggtgcacgtcgaagtcggtggagcggtaggtggggacgagcaggagcttgacgcatgtggcggcggcgaaggtccaggccgccgcccgcgccggggaggtggcggcggcggccgccattggggacgagtagatctggtgatctccagagaggggttgcgtttcgggtggttgcggtgatgagacttcagaaaattcgtaactttagggctgtttggtttccggagacttattttaaatccctgtcatatcggatatttgaacattaatttagagtattaaatatacactaattacaaaattcatttcatgagcttggactaactcgcgagacgaatcttttaagtctaattacgccatgattttgataatatgatgctacagtaaacttttgataattatagattaattaggcttaaaaaattcgtctcgtggatcatctcttatttatgaaattagtttttttattagtccatgtttaatactctaaattagcgtccaaacatccgatgtgacatggtctaaaaagttttagccccatctaaacaccccctttgtggtagtacacaggatcgttactggttactcattttcatttatcgccaaattgtgagtaaataagtactccctccgtttcaaaatgtttgacaccgttaattttttaagtacgtgtttaaccattcatcttatttaaaaaatttaagtaattatttattcttttcatatcatttgattcattgttaaatatactttcatgtacacatatagttttatatatttcacaaattttttttaataagatgaacggtcaaacatgtgctaaaaagtcaacggtgtcaaacattttgaaacagagggagtactccggataccagatatatacatattagtagtacgattttgctatatatttgtcgacaaattttctcctaaaaatttgacagatgtaattacagtacaatcgtaatataattacactgtaacttgcatgtaattacactgtaactatagtgtaacttgtatgtaactttcaaaaatgtctctgtaatatgttatttcggtaaaatagagattgtggaaacaaatccttacacatatatgtgtgctgtgattttatttttcttccttaccaaaacaaatcttgtaatagatttaaagattcaaaattaaatgaaacttatttacaagttacactgtagttacatgcaagttacagtgtaattacatataagttacagtgtaattacattacgattgtactataattacatctgtcaaattttttggagaaaatttatcgacgaatatataggtggtcccttagtagtactaaacaaccgtgttaagtacaaagaattgcacccccgccattatttacatggtattgtactcaattaactataagagaatcgttgaacggttttaaccagccatccgcgtccacgtaggaagcgtccaggtatatctgcgcctgctgctccgtcagcggtttggcatatggtactctaccggtcatgttggcgcccacacccgtacacatgtattcaccgtagaacatcgtgctgttaaaacaaataaaaccgtagtatacatgtttagaaacatacagctaatataaaatgaaacggaagtagtagtagaaagaatacgtacgcatctcgttgcgggtcgtcccagtcgctccaaccctcggcacaatgataccgggcatgtccgtgtgcgcgaagaccacgcgggagtagggcctccatgcacggcccaataaaatcagcccactgccggtgatgcgacaattgacaaaggcaaagcccgtgtcatcggccgcgtattcacggccttgtgcacatattgcaccgttgatcccatcgcttgtagctaccgagttcaaaatacacttctgaaaaacgcacagaaacttggttagatgcatggcaagtttgttactcactcaatgaaaataaaacgtaactagaaccatcgaagatttgtgtggtacgtacctcataaaatgatctgccgttgccaaagataaaatcaatcgaaccttcaataaaacaatcactaaagtaatgacggcctaaatcatcaaataatgtatcttggtagctatacatgccgcaacccaaaacgctgcttgatcacctgaaactctaattgctacagcctgtccgtcacgatcacccggctttggagctggggatgcattctacacagaatgaatcagtagataaactaaacccttctgccgtatacataattaagcaaattaagttttgtgagcacaagaacataccttaaaactgatgttgttcgttacaaatcctgtagcaaaaacatcaacggtggcgctgtaaaatgtgcctgtattttttgcgctattgttccaaacgatgatcgtcgactcaaaaccttgtccttggaatgttacattaggctttgaaaagttcactgtcaccttttcactgtgcaaaagaaagtgtacatcccttaaacaatgcatgaatgtatccagcagaattagcagtccaataaattaatgcaaaacacttacatgtatgtgccggagttgattcaaacgacacttcttgtcaatctattttcgggaatcgcatcgacggctgattgcacacagctgaagttgcagcatccattggaatcaacgcaataaatagataaagcagctgcatcactaggaggctggaaattagcacatgggttattcctaaccgaagaatcagtgaaaacaggtaagcagagtatagcaactataactactatgcaacacactccagcagaacttattaacccaccgggcatacataaagatcatatcggctgaacctctagtgtatacccaccgggcatacataaagatcatatcggctgaacctctagtgtatagttgtatgaacccctttgcctcacgatatcgattaagctcaaggctagatatgtgccatcctctaatagctcaatcattcactcgaacctgttgatagattatataacttgtgattgactcctcaatcacctttggtatggccatgcacttccataatctgcaacatcgaggggtccagagatatctctccataggaggggcaaatcccatcttgattattcatatcccactatacatgtttcatagcatactcgaaaactacttttataactacccaattacggagtagcgtttagcagtccctaagtaagctactacacatgttgagaaccatgataatctcaggtctaaggattcaacatcaacactcaatgagatcactgatgacacaacacatatggctcttgcagtgtctcatgttgggtctacctaacaacatgttcaccaacatatgtccacattattaatttggtatctctataccatgatccatgagacataatcatcaattaatacatgtgctgatcatataaacatatttgttccacatatgatatttgatcagggatcctttagaaatagtaacaaacaacataaaaagtctcatgaaagaatcacatattcattaaccaataaggagttatctatttcaaggaacaatgtcggataaatatgtaaacataatatgtgatacaatcatctctatgattgcctctagggcatatcactaacatgaagtagagacagaaagtgtgttacacgccatagagaacatgtggtatggtcttggtgtcttttttcttggagaatgttagtagcataatttggcttttggttaggtcattttagacaggccaaattatatagaatagttggtgtaattgttttagtggtttgcttaagaattggttagcttgacaagggcaggaatttgtgatgcatcgggaggtgtacgagttgctggggagctgcagaaactagagaagaaggttaggacttgggaggctgcaattctcagattttgtcagttcaagcagctagcatgcagcgatggagcttttgccgattcaatggatgtgaggcttcagtggttgattttatgtggctggggttggatgcatggctatgtttgatgatatgcctgttgaagtctagccacacaggatcacattgttgccagagtaaggggagacaaattctgaaacttgggctggagcagcgttgcaggatagaggcgactttcggctgaggcgtgtatacgtctgcatggaagctgtcgtttaaaaatgacggttttgattagatagaattaatcacggatttacctagagttttctatatatgcagtacagtgtattcctttactatatactatggattttgcacttggtagggctctggaacaattatcatcctatattattttcttctactgttttcatcgtacttttactcttgtttctttggccaaatcctagttatctagggtgcagatgatctttactggtttgcgctgaaaatcagtcgggttcttccacgaaagtgaagatctttgctagtttgcttgaaaactagtcgttcgtcgtcacgaaagcacaacggttttcattgttgttgcgtgaatcaattttacgtgtcaacagagaacagatggtgttgttggtgttatgcgtgggaggtttttataagtgaaatattggatgaaaaaaaaaacaacgttaacttgcaggcatgctaaacagccattgcttcatttttgttcgatcccgtagcccgatatgagaaatcaagccgtgaaagtaagatagtattgcatatacttaagaagtaagatcacattaggttgttcaccggccaattccctcgaaaataaaaattgttcaccgcccatgaccatatatatatatagcatgttcaggtctgcatcttcttcccaattacttgatgatgcatatcttcagcctgtggcgtcaaatcttactaaattaactgaagaagtaggagaagccggtggcgtatactaaaatataacctatacgtggaacttgcttgatcatgtccatcagccgtcctgcatctcgtcttactaaatcagcacgaagaagcataacaggagaaggcgagtgggcgagtggcaatcccacataatccataatcgcatcacaagggctcgtgcgcgcccatggcacgtgttgtcttggttcactacaacgtacactctttgtcatcacgttggtgtgatccataccacccataacctcatctctcctgccgtgttttcagaacaaagtgtttgttagtagtagacggcaatgggagtccgattccaatctgaaagaccacggatcaatccatggtgcacttcttcctcccgagcgcgcgccctttgctagcacttcttcaaaaattgacggtgcaggttgggccttccgggccttgaggagagaattggttttccgttcggtcccttcctcatttacacgtgggccagaatttcaaggggcagcccagctttggatttccttgtctcgtccacagctgctgaacagtcgtgcatctttctttctttctctttgaaaaacaatgtatttatttatttaaagaagttcagaagaacaatatactccttccgtcccatccagttttgcaaaggagccccttaacaatgggcagattacactttagctcaacattttgtagtaaaggacttaagaagaaaagaaaaaaaaaacaattgagtcctgctcgaactgcctctgtcttcaacgtcgacgacgaaactttgaatcctaacatcggcggaggttggatccaagtgagctccaagtgagctccacaagatgacgccaccgcacaatccttaacggggcctctcatagatgatagatggaggttgaggagatggcaaacaaataacaacttcagctacgccgaagggcgacgcgggcggcgaaacctcgccgtcgcctcctcactctcctcctctcccccaccttgccgccgcctgagcagccgccggcaaagccgggcgactgcgaagatggcggcggcggggctcccttctccctcactcccggtcagccggttggggcgccgacgacaccaaagagcgagagcgtggtcctggcaacgacagccaaatccggcgccgttcggtttggatccggccccttggccagatctgggttgggacgcgcgggtcggcggcggtgtggcgcgtgggccacgcggaggcggcagagtgcacggaggcggcggccgcggcagcgccgcgggagacgcccatgcgaaggtggtggggtagaggtccgcggctccggcgacgggcaggcgccagatccggtcgccccgcttggccgaggcgaccggcgacgggctcggtcgatgccggcgccgctccacggacctggcaggggggtggctggcggcggcgatggtggcggatgtagcggcgacgaagttggcgacgaaggcggcggactacggcgcgtgccgcgacgccggccctcgtcaagaaccttgccgccatgagggaggcgcggcgcccgtcaattgtacgccgtgcccgtgacgccttcctccatggcgccggcgacccgcactgtgcgctgcaccttcaggtccgcgccacccaggccggtctggacggttggcggctggcgatggtggaggctgacggtggcgactggacggtggtggctgatggtggcggctggacgggggtggcggtggcggtggtggtggcggtggcgatggtggctggcgatggcggctggcgacggtggtggctgtggcgctggcagtggcggctgtcgacggtggtgcaaggccatcatccgaggctgacggtgcgtcatcgtcggcagcggcatgtggagacggggaaggaggagtccgggtgcgggcgcgctgtcaagaactgtgggcggtggccttggccgaatttctaaagggacaatgttgttgatcgatgaagatccttcttgtgcggattagtggtgtgggtttggacagggaatcgcgggcgaaagccttgccgagccgtttggccggctgacgacggcgacgccgtttggcatcgttcccctccttggaggcgtcattttagattacccctctccttttctaaccatattctccgggtgaaaaccttgcttccttccgaacgagcggtggcggcgatccacgtcgcgtcctccttgggggcaccgctttggagaaacctcttcgtgcaaggattgtcaatggtctatgcattggcttcgaacttcagtcctaggctttgacgaggccttctagctccactttttgttttgcttttcttagtttgtgtcctctcttttcctgtttggtgtgttcaacttgtcttgaactacactctcttctggagtggaattttgtaataattggctgtagctctttttgagcaaaggccgagatattatattccattatctaaaaagctacgccgaataagaaacccaccagaagttttgataggggtcgacgccaaagcagataatccaaagaagccagccccatccataccaccggcaaggatagcaagagtaacaccactaactgcaaaagaaactgaggggcatccccgattagggcctccacgcatgggaggttgagaccatctcagcaaaacttgaaaccttcagccgtgtaattgatcttcactggaggtcaagaagaagaccacctcctttgtatagaactcgtcggagaaatcgagaaaggttggcgcaacctttttttcccagatctaaaagtatctcatccaacggctgggagaagaaacccggcaaagaggtgaccaatcactggctaaaaaaccggtgatgctcaccacaccaccaagacgaggagcgtcgaagccgacggacaccttgagcagtaaaagatggatgataacgagaagaactcgaactaacacgatgacctgaccaaacgagaaagcaagactactacttacactactagatgagaagagacatccgacccccctttcatccatcgttggtggtgatccaccggagaggaggaagaggggtcggagaatgaacgaggcgactgtagcggagattcgcaaaagctggagtggccgaggtctctcaaattctcagcagtatctttttggggctccgaacagtcgcgcatcagaacccacccacccccaaatatggactatgggcatttaacattttgttaagcacaacaatagcaacagaattcatagaaacaatcagacgcagccttgccagcaaactgtattagctgatgcctggaaatggcatgatgctacccacagcctcccaatacaatacatgggtagagtaagattaaggaggaggagggggaggtggacctatccatgcaacttaggctaattgtattaatgtaccaactggtacacgatgtcgctggttaactttgaaatggcctcgttgtacatgttctccgagctcaccgggttcttgtgggcgcttccctcaaacaacattatatcacagttgccgggctcgtccgaggcccggtgcagtttgtagaacgaggtaacggcggggcgcccgacacgcaggtcgtcgatggcgctggccacgagatcgtccatgtcctggtagtacttgatgcagagcttgagctcctctaccagctcggtgaggacgcgtaccgtggacgtcacgttgcgcatcgtgatgttggccgcggcgatggcgaggccacgcttgtccgtggcggaggcgcctgccggatcagccgagagcacgcccaagcagtagccatagttggaagttgcggtgcatgtctcgttgatgagagatggggaacccaccgtgagaccgggggctattgcggcggcgaggaggagtgtagcgatgatgggatgcatcgggaattctcaggccggggagaagctaatgatgcttttttgtggtttggctcctccaggtacactgagatttatagaagagaaaggaccttcaaaaggaaactgatcaatgtaataaattctaaattcaatgcgattgatcatgaaaatcgactctttaatgtacttccggctatattccaattctttcctcaataaattgccacctcctttaaatgggtgtacattgtgaataatcacaaatgtgtttgtgccgcgtgcaaacgtccgcacgtgaaacagaacatcccctcgtgcgacccttcgctctagtacgtgcctacgtgctctcctgcctgctccccacgcatcgtgcaagagtgacatttataagttcagggggagaaaacccatatagcattattggaaaatcagacttagtactcatttacagcaaacatgaaattatagatttgaatcatatttaacgcaggagtatagtattttactaatttccttgtgaagcagatttcataaaaaaaaactcatggaggccacttgaaccgggggaggctaatgggcgatcgatcgccagggcgattgcccagtgatcggtttcccccctccccctatactcctccctcttgttcccttcctcctccccttcttctctttccactgcagtgcaccacacaatttttttaaaaaaacaaaagttagaaaaatttatatatagaaatactatataaaaaaatttgaattcaaattcaaatttgaatcgggtatgtaaacttttaacttataaactttgggtctataaactttaggtgtataaactttagatgtatagaaatactatatatagaaaatatttgaattcaaattcaaatttgaatcggatataattcaaattcaaatttgaatcgggtatataaacttttgacttataaactttaggtctataaactttaggtgtataaactttagatgtatagaaatactatatataaaaaaatatttgaattcaaattcaaatttgaatcggatatataaacttttgacttataaacttttggtctctaaactttatatgtgtaaacttgaggtgtataaactttaggtgtataaatttactaaaatagaaaagtaatgcggtgccaaaaaaggaaaccaggtggaggggtggagggagggaggggggaggggatcgatcgctgccccatccccagggcgatcgatcgccgaacaacattctcgcttgaaccgtggctacctgacggcccacatgcatagtagagtaaggaaataagttcactttattcccttacctagtggcataatctgattcgtatccttaaaccacaatatcagatatgttgaccctcctaagtcctaactattaaaaccggtgcaatttgactctgtcggcggttggagggtggtttccttgacgtggtgactacgtagcggcattgacttggtcttcatcttacgtgacgttgacgtgacgcttatgtgatactacctccgtcctaaaatataagaagttttaggcttgggcacgagcattaaaaaagtaggtttgattaaatggaagagggttgtgattagttgagaagagaaagtatgtgaagaatttgaatggtgaaaggttatgattggttgagaatgaatgtaggtgaaaaagttatatacttttggacaaactttgaatgctaaaaattgttatatttttgaacgaatggagtattagaattaaaaaaaatatgtgagacccatttgtcattcacaaaagaaatattgtgggacccacacgtcatcctctctttctccttcccttcttcctcctccctctctctctcccttctctctctttctatttctctcccctttcgccttttgcagggagagctggagcagcggcgaagctccgacatcttgaccgaccggatggcgatggtgacatgccattgctccccgctgccttcatgtcccggagctcggggtatgagaagtgcgacgagtggaagtagcacgaggaatggaacaaagtcgacggcttggtgccattgtcggacatagcaactccgttgtcttatcctcccacctgggctctttcctcagcccgaccaactctggcaacgtctttacaacaccgctcgtcgtcgccatggtcggcctcgacgtacggcttaacgacgtccaggtagaacaggtccgggccaggatcgaagctaaccttgtgttgtgccgctttggtaagcacccggcatggccctcctctggaacctcccgcacgccaggaacaccatgaggacaacgaaggagcaccaacaccgcgtcggacagcgcgacgcccgtggcgacgacgacaagtggcatgctcttactcccttcctggttgctgcctcctgcactgcaccgtctgtgcgccatggtggtgttcccccttctgtggtcgactctaccagcgacggggtccgggaaccgtgcgttcttgtgcggtggcggcaggtgggcacgagccagcgccgaagagacaccacctctatggcgatgccgatgctgctgccgcctatccaagcaacaacctcatagaggagacgatgagagagagagagagagaggaagaaggtaaggagaaagggaggatgatgtgtgggtctcacatgttagtgtctcccggctcccgcaatattccttgttgtgagcgataaatgggtcccatatatttttttcattctaataccacataagcaccacgtcaacgccacgtaggacaaagacaatgtctacaccaccacgtagttgccacgatagcgaaacggcctttcaaaatcatcgagggagtcaaataacatcgattttaatagttggggtcgacacagtgactagttaaggtagtcaaagtgaacttattcttagagtaagcacatcaggcctcatcgcactcgtataagcatagtagagcccaatggctgcatacatagacaaatccaaaagcccagagccacttcccacttggaaaaagtacaccgaaggtcccccaacttgtcatggagttacaaaatcgtcctccaaccataaaaccagatatctagcgtcccttaactaataaaaaccggccacaataggtcctttggtggttttgacaccggttttatcctacgtggcggctgattcagccatgtcaggctgagtcatctatcttccccttcttctcttcctcggttcctcctctctctctgcacctgtaggtcggttggcggagcgagggggaaaaggaggagcgcggcgccgcgatggcggccgccggcggcggccacagtggggatgcccgacggcagcccggcggagctccacgacgcgggcgtgcagcgaccttgcgcgggcgtcgacagggaggcgcaggcgtgtgcaggcgtcgcgggcggctggaaggcgcgaacgacgcgggcatcgacagggcgaggcgggagaggaggaggacggcggcgcgacggcggccggcggtgggcggtgggcacgaaggtcaagctcccagccctcaaccgagctcgagcagaagggaggtggtgctcaccgacgctagttcatggtgctgttcattttctcagctcgatactctcccgctcgtcaagctccactacttgaccgaacaaatcgcggtcacgctgactcaaaacagagcgagcagaaaaccatgggaggagggaaaatagctaacaaactaacagaaagtaaataagagtataagatcaaggcaagatcaaatcccaactgacataagttcatttatttaacacataccaccttctccggcaccacggcagcatcatgatgggccagatcaccccacggcgatggcggcagcgccgctttccgccgctgacattccaatggacggtgcaccccatcgagttgtggagctggttcggcgtctccggcggtgagcagctgagcttggcgtccgctacaccaaggtctagctggtcggcgagttcctccagcgaagcggttcaactacggcactgtcattgccaattcgctgctgagctacccgaggaaatccggcgacgccgtcaacgagatgactagcctgtccaacctcaccgaggagctcacgctctacgtccccaccgttccggagccattcccacgtggacggttcgggtggccattccttcagctcaagatattctcgcttggatcgattgtcggtcgagcctcgccagcgtcgtttctagggacgccagttgcagaaggacgcagtggctgatgaacccgcagcggcgctgcctaccgtcttcatgggcgcctgggcggcgacatcgtcaccggccactcgtcggtggatgcggcgtcagagctggagctgctcccgtcgacggagtccgtgaacaccgtctcgctcggggcctccctcacattccgtcctgctgccgtcacgtctccataaagccatcgccgccctgtcgagcgagcgtgcggcgg
